United States Patent 7,625,699 (GENETIC POLYMORPHISMS ASSOCIATED WITH CORONARY STENOSIS, METHODS OF DETECTION AND USES THEREOF) - sequence listing, part 11

SEQ ID NO: 12492 - DNA, 14369 bp, Homo sapiens
aaagtcaaagccacacagggactccttgatcccagatgggctggctctgaaggtcatgctcctttcatcccatgaggcttaccttcgtttcaccttcagtgtcttacagtgttgttagaatgtcttcattggcttaacttaacagtattctctttactgtgttcaggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcgaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgccttcgatgctgtcattgcgttcagcccagcacatcacagccccatcagtgtgtagccaccgctctcgtttttctgtatcgcttttatctcctgaaaaagatgcaccaaataagagatcatctatatcaggaattgaatgtctaactcaaacctctcatttttgtttagtaggtagatctcatttgaagtctcctatctgaatctctgaaacaattatagtttgattagacaaaggtttttaataacacttcttttttgctgtagtcaagcattaatagaaactagtttaattttcacagtggtaaatatttttattcttgagttatctaggaatggattttccacgatgtctagtgacttaaaaaaaaaaaggaaaaacgtttctacaaatccctttggttttccatgggatctggaataaaatgtcagtgtctataaactgtatgtcatggagtttagtccttgtttcaggtttaatagaaaaaatcaggaagtatcatggcattgtctagacatcatgaagctattttatttccatagttggtaaacagtgaaaatttcattatctccaactactaggtacaactttaggccacaggaaaggttatttggcccgaaagtttggaggtgctccttgaggtgggaagtatcttgtgggaaagtagttacttgattcaatttagttcattggtagggttggggacttggtgttggtttctttctttcttttctttttttttttttttttaattttcccagcaatatttagcacaatgagcgtgtatgtgctttggggttaaaaattatctgctagggatgataggcctgggtttctcgttgacatctagatgggcctgattagagcagtcatctcctggtaggcacaaaataatcaccaacagtaatgttgtatctgtaatgtttgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaaagtagctgttactgtgcaggctgtctttaactttcatttcataaagggtacattattgttaaactctactacatggtttggggagaaatccagtggttttatttaaatgaacactctcacactgccttttgatcaactttcaaagtattttgcagatgcattttgagcatgaccatttttttccccaagtaaaaacaattgtgcgtggcctccatataactcagaaagcatgctcttactacctatgcaagcaaacaataaaacatatagacatgaaatgttaagtcttaaaaaaaaaaggcaacaattatggagctctatttttaaatttgtgattttcaaaatatggcttactcatcattgtgtagaagagcatgaatgcgatttcttgttttgctctgcatatatttctctgctgtttttctgatcattggcgagattgtaaagtattttgcaagcagaagtggaattggatatgttgaacacacatcattggtgtacatactgtatttagcctgaagactttcctaaagtgttttgttctaaaaataacctgccattttctatagattttaattttttatatcttcaagggttctattttggtcacaaggaaagaatgtggcttctaatagtgctaagaattaaaagatgcttttatagagacttagagctattttgaaaagctttggggcttcccagccactgatcacaattagactaagcccatggaatttctgggagtgttgtgcagtggattcggttctagatccatcttacatttgtttagtgtttcccaatttttgggagaaggggtgcacagcaaatttgagagacttttttgaatctcacacatgtattttcctcaagattcttttaagcctcttctgaatgacttgtctgagatagtgaagacccacattractagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttkaaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcsaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacrttttatttctgaaacagcgttgattatatagtatacagttggaattaagagaaaagtggaaaatgtaacaaaatacaataaatttattacaagatgtcctcttcaagccacatttctcctttctcccccttgccaactgatatctttttggtgttgactataataataattgtactgcatcagtctttacaaaatgccttaaaattgcagtgtttaaaacacaagttacagaaagatgtatacatatgttttctgtgtaaaagtttaaaacaaaaaatcacatccatgcttgtataattttcacaatcagggatggttcttcccatttcctccatgacggattagagacagtttgtcctgggccatggaactggacaaaaactcacattctggttcaatccaacagattttcaacatttcgcattattttccccctcttaccaaacttttatgatgggaagaaatagcagtataaaaggggccattcttcctgcgctgtctcataccctagatatttaatatttttgatacaaacaacatttttccagctgtctttcccacccttcaggacagaactccctactgaggatgtcacatcacctatggccacgtgggggcactaaagatctcttatgcattttagaagtccagcctgcaggtggttagcctctgagtgtggaaatgtttattcagtatgagttggggaatacggtatcagtgaacaggggtttctgtttaggggagtgccaccagccatcatttgttcccggaaagtgttgagtacagatcaggacagatcttgtttccctaaagcacagcattatggtttagggttggggtggggggagttgatgttcctgacaagtgtgaaccacatgccgtgctaggtacagcacttctaaagctctctaatttgaaatggtaagatttcgcttaggttctgttagagagtttaaccatgtagtacgctgattattcaagaggcttcattatgccacaaagtgttcacatgtcataaaatatgtagatttaatagttatgcagatatttaaggatcattttgcctgtctccttaggatttggaagattatctttcaatacttgaatggtcaacgtctctctgaatacttttcgggtccctgtaaatcttcctgaagaaagcaaaggtgtgataacaccccttgcccagagctgcatgttcctgtgtgttaaactgccccgtgggtgattctaggccactctgactccgtgggatgtagcttgaggtcctcccccaccccagtatcccctttctcccagctgggttctgtgtcatatgttctaattctgtgtacatcatctaacataacgttgaacggttaatcacttcgatttactaatacattcactttccattgctcttcactccttcctgggttctcccagatggatgcttcaggtttcctctctgcgaccctgttcctttctcaggcttctccacgagggtcatctggtagatttcaccttgctgggtgggttgggtctaccttctgcaaacccctctggaattcggtcttggtttggtctggtcttagctacgtttttcaccctctgccaacacctgctatacacagaggacagggctgtcctctcccttggtggtgcatttttgcatgccatataacccaatggccttgcactcgtttcttagagctttcagggatttgatatcagtttgacttgctctttggatgtcttaacagctccatttttcttgtgaaacgtgagaagatggtgcaaatgagactgcagtgcctagttggaatcaggcctccctgcccccggtggggtctcagggatcttgcattccagcacaccacccctgtgccttccctttgtttaggaggactccagagaggcccacagtgcacagatccagttccagagacacagggaaaagggtgtaatacgtctttcctctccgagagtctggagtggacagtgtgtggggattgtgcactggggactgaggatgaatggcaccagcctcagggttccaagtccacaaaagttgtggtgaggaaggtgcccctttactgtttcactcagaatcggagtccaggttccttcatttagtaatgtcttctgtgtgcccagctgctggggttatgaccacacttggaggggctcacctgccagtcaggaggtcaggttggccaacagataacgtttcagcaagtttgccacttattccctgctctttctcaaggcatcgtccctagaatgctcttctccgagatgccagcctggctcattccctcatctcctccacatctttactcacatatcaccttattgaggccttcccttactacctttttagaacactgcaacctgcttcacacgctgtccgtactccctattttattttctgcatatcacttatcacaactaccataggtcatatgtgagctgatgggtgagcttacatgagagcggggaggtttgcctgttctattcactgctctttttctcagcatctaagagggtgccaagcttatagcagttacttagtaaatacatactagctgaattagtaatctgcctgagtctttctatccagaagatggaggatactggtacttgcatcatagagtggtgagagttagatgggaatgatgcctataaagccttcagcacagtgcctggcacagagaaagcgctggctgaatggagccatttgtaatgataacaatagtgatgaggaggaggggccgaccctcctggggtcagaggagggggcagtgggccataactcacactttccaggcaggggaaactgcttgcactctctggaaaccctgagtccagtcttcctggaatgtagggcaggaaggcaagaagcgttggatgaagggggcgggagatcccatctagggggaccttttatgaactgctccatttgtcctgtagtaaatgaaaatccaggaagagattttaatttaggggagaggagatccagtttgcaccttcgcatggtcaccatgacaagatgtgtcatgagagagccggttcggagctggttgcaggagtctgggtagagtgtgcggaagggctgaccgaaagcagtgctgggtggctggagaacagggagacgcttggaaaggcaccgtgctcagggtccaggagcaggctgcggggttcgaatcttgctagctggacaatcttgggcggattactcaacagctcaaattcttcacacctgtaaaatgtggataacggtgtctacatgatcatcacgaggcttaactggaatgcctggtttatttacatttaatataatcactaatgtatttggttttttggtactatcttaactttcttggatatttgtcctgcttattttatatttattcttcttgcttttctttgagatgtatcaaggattttttttaatttttaaaatttttcttcttaacccacagaacaaagcattttttttattctaatttttctcctcagtttgttatttttttactctccttttgtggttatccttgtaatttcaacacgcacttttgatttataagattgtaagaaaagggccaggcacggtggttcaagcctgtaatcccaggattttgggaggctgaggcaggtggatcacctgaggtcaggagttcaagaccagcctgaccaacatggtaaagccccgtctctactaaaaatacaaaaattagccgggtgtggtggcgggcacctgtaatcccagctactcgggaggctgaggcaggagaatcgcttgaacccaggaggcggaggttgcagtgagccgagatcacgacactgcgctccagcctgagtgacagagcgagactccgttctcttccccatccccccttcaaaaaaaaaagattctaggaaaaatttgtatttgtttaccccttgaagggctttatttaggacactaattccatttacccatttccaccacttgctatgtttgtcttgcattctaattctatgcacaccatctaacctaactttattagtaatcctgagtagtcaatattcactcagatttactgatatatttactttccattgctcatcactccttcaatccagtgtttgattgcttctgcctgagatcattctccttcagcctgaagaactcccttatttctttttaagcctgtgtcagcgatacattctctcagttttatttgattggaaatgcctttatttggtcttcttgaagggcattttcactgggaatagaatcctaggttggaaattactttctttcattttcattccatggccttctgcctttcactgtttatgttcataagtcagctatcagtcttattgctgttaatttgaagatatgtgtggtttgggtttttttgtttttttgtttttttttttttcctgactgctttgaagatgcttctctttggtttccatcagttttattaggatggagttttgttttttttttttaatccttcacttcataaatcagacttggaaacttctcaggtgttattgctttaaatattgcttctgacccatttttttttttgccctcttctaagactccaatttcatgtatcttagacttccaccatgtctcaaatattcctttcactcttttttgtatttcctattctttttgatccccttacctcagtctggatagcttttactgaatgaatcttttcagttctatctaatcttgccagattaaataaaggacatctcattaaagttgaattttagataaattgtgaatagttttttagtgcatgtccaaaattttgaatgaacatacttatatgaaaaattatttgttgttaatctaaaattctaatttaactggacatctgcttttatttgccagttctgtccatcttagctaagtctaatctgctattaaacccacctaattgtattcttaattttggttatggtgttttcaattctagaatttgcattagctcttcagagactctaggtctctggttaaattcttcatttgattgtctattttcttaaacatattagttattttaaaggttggatctgataacactagtatctagtcacatgtggacttctttctattgtctggttttttttgttttgttctacttcttgttgtgctttttgattaatgctaggcagtgtgtaggaaaaaatgtgtaggctctggctgatgatatttgcctccagagagaattcatcctgttttctggtcggcagctagggactgagtggactcaaagttggattgtagttgttctaagactctgctgccttcaggtcatcttacataagaatgagcattaatttaatcgttcaacacatatttgtggatcacctgctatgccaagcactggcctgggcatgggttacatcagcataccagacaggaaaaaaaaaacccttcgtcatgtggagtttatcttctagttcacctgtccagaaattaataataattaataataataattgaccttagctgggaccagcttccagaaggaacagaaatgtggaggtaagttggtattaaagcaatgtggagatacacaccaaaacatgattctctgctctcttcctacaccccagccttcctgtgttggtaaatgacatcaacatccagtccagctgctcagtccagaaactaaggatccatccttgatgctgcttttcccctcaactccctccttacatcgaacccattcaaaagccctgtccagtcctacctccacaattatgttctcaatgtgcctcacttctctttctctccactgataacatcaagtccaagtcacatgatccctacccagactgggctcctgtatcagcctcttaaatttgtccacttctccaattccatctttagtctgttcctgctgccattacaaaataccttagattgggtaatatataaacaataaaaatgtattgctcacagttctggaggctgggaagtccacgatcaagccgccagcagattcagtgtctggggagggcctgttcctcatagatggcaccttccagctgtgtcctcatatggtggaaggggcaaacaagctccctcgaaccttgcc

SEQ ID NO: 12493 - DNA, 68445 bp, Homo sapiens
gaagacagagatcttaattgcttcttactgaaagctaatgggaattcttcctttagaaacccaggctgagaacttcctcaggctttttctcacctcctgtgtctctaggaaagtccccaactcttctaaacataagaaggtagcaaataatattcctaaataaaatccggccacagctgttaacttccccattttttaatttgacattggtcaaatgtagatctccacttgccctttatttcatggcaatttgcctgtcaagttaagcacctcaatgttttccttccaccacacatgctgacttatacacatgctgaatcccaggctcagtgcaatcagctatccatcttttccacctgggagctgctcagatggtaaaaatgtctctactgtttttctcttacgttttctgaaatgagtagctctctttgaggttccagctttgacaatcctgagtgtgcattacagagagtgggatacccatttctttctttcttttttttttttttttttgagacgaagtctcacactgtggcccgggatgctatgcagtggcgtgatctcggcttgctgcagccttcgcttcccaggttcaagcaattctcctgtctcagcctcccaggtagctgggattacaggcatgcactaccacacccggctaattttttgtatttttagtagagacggggtttcactattttggtcaggctggtctgaaactcctgaccttgtgatctgcccacctccgcctcccaaagtgttgggattacaggcgtgagccatcgtgttcggctgttacccatttcttaaagaaatctggcattatctcccacgaagcttatttctgcctggactaacctcaccatctgagcctccctactccccgcccaaacacataccagtcaacctcacgctgaacctgaacaataagtgattaggtctgcattttagcaaaatgatgccaccgagggcatccatgactcaatgcttttgaagacatgctgaaatcatttgtctctcttctttaacattctccaagctacaggtggttccaattttcttttgtatgttttgttgttgttgtttgtttgtttgttttttgatggagtttcactcttcttgcccaggctggagtgcaatggtgcaatcctggctcggtgcaatcctggctcactgcagcctccacctcctgggttcaagtgattctcctgcttcagcctcccaaatagctgagattacaggcgcgttccaccacgcctggctaattttttgtatttttagtagagatggggtttcaccatctctactaaagacctttggccaggctggtcttgaactccagacctcaggtgatctgcctgccttggcctcccaaagtgctgggattacaggcatgagccaccgtgcccagccccaattttcaacttgtggcagaaaccgtaagtcaaggaagcaagtaagtatttccataaactgtagaaaagaaacactctccagctatgtaactgaaaagctcagcttgggacatccattaacctttgactttctttcttagaaaaagtttctaagttggctactgaagactggaataatttttaggagtaccactattaggatcaaatttcttcaacatatcagactggattggctttcagattcctccccagtatgttacagaggcacatacgagttgatttctaaggatctgattcaggttatttgttctactacttgggtttcccatcatcatcaagatggttcaaaccattatccagatggtccaaaagagagaccaaagctatcagttctgttacttcactctggaaacctgtgttttagctgaagaagcaaaatgttccaacactgtccaaattaatatgagcattctctctttagcacaaggaatacgtttctggaaatagcagtgttaactgtatagtctcttttgaagtgctgcaccagtgttgtaatgtaaggtggcagagtttccttgaaatcttctgaaggtataaaatgtctttgctcatcatttcctttttttttttttttctttgagatggagtctcactctgtcacccaggctggagtgatgtggtgtgatctcggctcactgcaacctccacctcccgggttcaagcgattctcctgcctcagcctcctgagtagctaggactacaggcatgtgccaccacgcctggctaatttttgtatttttagtagagatggggtttcaccatgttggccaggctggtctcaaactcctgatcttgtaatccacccacctcggcctcccaaagtgctgggattacaggcatgagccaccacacctggccaggataccttttacaacgtcaaaagacactccattccctaattgcctgttgatctttaccctctgtttcctcacccatttcctcaaaggtgcctccagatcctgcaaaactcccacttttacatttagcatgatagactttctgtattcttggtggcaggcatagcaccatcactcattttattgggcattatgggtcaaaactgtctcccagggcacaaactaaatgacagaaaaatagagaggagtaagtaacacaccacagaactcaatcacctgaagcagcagcttcacaactcccatcctggtccaagctaccatcaactctcacctggattattgcaatagccttctatctggtctccctgcatctgcccttgcctctattagttattcttcacaagcagccacagtgatcctttaaaaacgtgagtcaggccgtgtcactacttgctttatgatcctccagcagcttcattttcactacaggtaaaacctaaactttgcttcactttcttcaggtctttgcccaaatgtcaccttaacaaggacttctccaatcaccccacataaaatagcaaattctccacccccatgtctgcaccacactcctaattcccctatcctgccctttacccttcatagcacctatcaccatttcatataatccatatttatttacataatgtatatcagattgcattttccaagatggccacaagatttccctttccgcacactttcttacaatgtgacatttccactattcccgttgagagatggggatctatgctctccatcctgtaactgtaatggaagtaacactatatgacctctgagactaggtcacgatctctgtctggtccttttggggcactcagtcttggaactcagccactatgatatgaggaagcccaggctacatggagaagccacttgtaaatggtctgccaacaaccccagctgcggtccaagccaacagtcaacctcaacttccagacatgtaaggaagcttttgagattacttcagccctagccactgcatacgagactcccaagtgagaactgtttagctgagcctaattacctcccagaaccatgagaggtaatgaaattgttgttttaagccactaagttcggggtcatttgttatttaacaatagacaatagaacaatttgtttatgtgtatattttatgtctctttccttctagagtataaatcccacagattcaggtatttgttgttgttgttgctgctgtattcccagcacctaaaacagtgcctagtacatgtgctcaataattttttttttttttttgagacaggatcttgctctgtccctcccaggctagagtgcaagtagtgtcatcatagctcactgcagtctcaaactcctggcctcaagtgatcctcccaagtcttccaagtatctaggaataccacaaccagctaatgaaaaaaattttttggggccaggcacggtggctcacgcctgtaatcccagcgctttgggaggcggaggcgggcagatcacgaggtcaggagttcgagaccagcctgcttggtgaaaccccgtctctactaaaaacagaaaaaattagccaggcatcgtggcgcacgcctgtagtcccagctactcaggaggctgaggcaggagaattgcacccagcaggcggaggttgcagtgagccgagatcgcgccacttcactccagcctgggggagagagcgagactctgtttaaaaaaaaaaattttttttttgtagagatgggatgttgctaagttgcccaggctgccctcagactgctgtgatcctcctcccttggccttccaaagtgttgggattacaggtgttagccaccatgcccagcccccaataaatattcattgaatgaatgaatggatgcatgatccattttcaataaagcatgctaacagttactggtcaacggtatatggcatagtctgcgctagatctcattggctgggagaataaattgacagggcatggggaaatatgttggaatttttcaaaggttaataacgtaatatacataatgtaaatataacatatataatgaattatactaattacacgacagtataaaataggatttgagtttcatgtagtcttttggtgattgatcccataatcctaatatgggcttctccagatcaggtctggaaagtcttcagaagtattttcagaaggatttagtgattcttctcattcaaataatgaagtccttcctaagcatcctacactagtggaaatcactcacatggttttggtatgaaatggaatgaaactgggtggtggcagtgtgtgtatgtgtatgcacatgtgcacactcacacgggcaggtgcatacaatttggaatgcctacttccactgcctattttcagtctggtggtttgaatggagtgtgtatataaagagcacaaataaacatagttctggatttcccctttctgcaccaagtaccttgatttcacatttggtttgaagcaaatatttgtgtattgcttaaatagcaaacattttcaaatattcaaggaaaatattacatttttataatctcagaaggcaataaaggacaaaatttcttagctacctgaaaagaggtagtttttgtctggggaagaataaacaggtggatggtcgtttgagtggactaaccaatttctttgagccaacccatctcagccttgattggagcaaaaagcataaggatgtggagtgtgtgtggtttcttggaactggggatctctgctgaatctactcacaatgggagcaaagcagtttccatcacaataatcgctttaacaatcgtgtgccacttctttccaggatccagaagggcttgaggatcaaaatggcttttaaaagttcttcacttaaacaaggccgcagccacaaggttacttggccgagtgtctcttgagaaagagtgagtgccattttgttctttgttccaatgacagttgttggtgccactgggcctcaccacctggcctgtgtcatgaagtctccctcttgactgggtctaagccttgagtggaaagtgggggagcctcccaacacttccttggaaactcttggcaagtaaattggggaatattttctttggaagtctcatttttctcaccaaaatttagatatagcttctgaagctaattattcttttttcattacaaaaaatgttttcctttatttatttatttgcaggcccagccaaacttgactagaaaagaagcccgggcaggggtttggatgagcccatgacgtgcagcgcgctccgaccaattgggaggccgtgaaaaaggggagggcggaagtgacgagccgtatccctccgcggggcgagagggtcggtggggggagtcggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggtccctttaaggcgacggcgccttcctcgggtcagactaccggcggcgacgaccacaggaggtgagtgagcgagcgagccttctctctccccaccccctgctcccgggggttccgttatcttttcgctcggcgaggcgttcagaggcgagacaatgagagggggatggggccggtacgcgcgggggtgggggcggggggccggcggtgcgcgcccccgcccaccgcgagtggcggcgcggcccgcggcaggggcggccgcggggtgcggcgcgcgagcgcgagtgtgtgtgcgtgcgccccgggccgcgggagccgcgcgaagggccggcggcggaggtccctgcctgccggctggccggccgcccccgccccccggcgcccgccgcggcgcgcgcgcgcgcactcgcgccccacggccccgcacacagcccgacgtccacacgcacgctcggcgcgaggcgtctcggaggagtgggcggcgcgggcgcgggcggtggcccgctggggaaggggcgggggcgggggcgcgggcggtggcgagacggcggggcgcggcgggaggggccggcgagggggcgaggccgtgcggcggaggggcgggcggcggcggagcggcccctgggggtgggggtgcgcggccctccccgccccattcccgctccgagaaggagtggggcgctcgttttgagcgggaggaggaaaatgagtgattgctgagccgatcccttgtgttatgtaatctctgcttggtctaatagtacatcctaagccttagtgcactgcagctagtttacgaagtctcctccctcggtccccaaatttcttttgggatggcgccgtgatttataaaatggaatgaggcggggaatctttattttctggtgattatgtcctgccgcggtgggcgccatgtttatcccggggactattttgtttagattcttggcaccttttgcaaaggagtactgtcattgatctatttgttttccgtctttctgcgtgttgttcttatttccttcctctccagatgtgggattctctcaaactgctagtagcacttgtcttagacattcttagttcagaaaaaggtagtgctgatgagtccttagagtcatttagtggccagtctcattttcgaaatggaaactaagatgcagttggactatctcacagcagccgccgtcttgatgcaagcggtgtagcccgtccttccaagcccgtagacacctcttaccgccgctcaaaactccacagaaatggggttttactttttttttttttttgagacgaagtttcactcttgtcgcccaggctggtgtgcagtggcacgatctctgctcactgcaacctccgcctgccgggttccagtgattctcctgcctcagccttcctagtagctgggattacaggcatgtgctaccacgcccggctaatttttgtatttttagtagggacgaggtttcaccatgttggccaggctggtcttgaacgcctgacctcaggtgatccgcccgccttggcctcccaaagtgctgggattacaggcgtcagccaccgcgcccggccgggttttacttctgtaggcatttacccaactagaggaaagggaaacggagggggcagggagggctgctcsttggcaaacgattaattttgagacactattgctcagggtctgagagcttgaactctgaattcgaactgttagcacaatcgttctcaacttcggggtgcataaaaagtaacttgaaggtggttaaacgtacaatttggggggcctcatcccccaaatttatttgaatggagcagaggggggttgtcatctttacattttcaaatgagcagtcctggggctgagactgattaatgtaaccactacattgagaattactggtctaacataaaagtgttcaagatgttgaaacaagtgacaccttgtgccgttgatttccttcccttttccagagctgtgttggtggtgtatctcaaactaaaggaggtaacagaatggactcttgggacgaacctgatttagttagagtttccactcccatcttgaactagtggtrtaatgtaggaaagcagttctcaaagtgtggacagatgacccatggggatctcctcttaccctttcagggtagcctcaaggtcataactattttcaaaataatagtaagatgctatttattgttttcactgatacactgatggttcaaaagcaaggctgggtaaaactactggcggtaccttagcacaaagcaagtcaggggcaccaaactacttgagaatgcccttgaagcagtaaaatttattattctatttttatttttttgaggcggagttttgctctgtcgcccagggtggagtgcagtggcactatctsggctcactgcaatctcttcctccctggttgtatttttagtagagacagtgtttcgccatgttggccaggctggtctcgaactccggacctcaggcgatccacctgcctcggcgtcycaaagtgctgggattacaggcatgagccaccgtgcccggcctattattattaagtcttagcttttgactacatgtctttttaatttttaagaatttgtgattaartaaacatggataaagcatttatgctgcctagggaggtgtgattgttgtcatgaaggaaaagcatttgtgagattgggttgtgaatgaatggcttatttcatggagtagcatttttacttgaaagaacgactagcagactatggtttttcacacttagtatytggcagatatttcttgaaaatgaagtgagcttgtcacttttaggaaaacaactgacagtatttattaccagtgataaaatttgggtgaaaattagaatttttaaraagttgacagctggagtttgacagcttcctagtacttaaaagactttccttatgatatcagtggttaaggactgcaatattttaaaatgttgtttaatgaaatatgttatttggaagatgggcataactcagtaaatctaggctttgcaaatgaccaatgcatgatgttgcaaaatcaagcaaaggcaaaagatcytttgaaaattccagacatagcaatggattttaacagtaaaaaagtggattgatgtggtttcagattccaaaatgttaactgtcctttaagaaactactatttggcctagcgtggtggctcrctcctgtrrtcccrgcactttgggaggccrrggtggaaggattgtgtgagcccaggagttggagttgagcctggtcagcatagtgagaccctgtctctatttattaaaaaaaaaaaaaaaaaaaraaaagaaagaaactaccgtttgttgagttttagtatttaccaaacacagttatctgaaaaggttattaaaatacttctcccttttccgactagattttcattatatacttaaccaaagctacatatagcaacagactgaatgcagaagtaactgtgagaatccaaccatcttttatcaagttagacataaaagagatttgcaaaatgcaaaacaacgttacttttctcactttttggagggaaagtattttttgttgaaatgttatttatgttaacttataatgggcttgtcttaaaatacattgataaatactacattttaaaaatttgtggtaaatgtggaaagataaaattcacataaacaaaagatctttggcgtcttcaataattttaagagtcaaaaaaatgagaatcattcagtcagtcctatgtttctgctctttacatcattcaaatctaactcccttggggaacttgggagaatttataaatagttgaagttgatggaagaggcagtgacctggggaagaattctaaagcaaaaaaagcttgctttgaatcctaactgggatatttactaactgtaaccttgaggaagttacttcgtctctctaaaccactgttttgaccttatctgtaaaataaaaactttagagctggttgattacaaatcctagagctggttaatgcctttgccataatatcaatrtggtaacattttgatagattctttggtattcttgtttgtgatattaagccatattcacaaaaacttgtcttttttttttttttgagatggagtctcgctctattgcccaggctggagcgtaatggcgcaatctcggctcactgcaccctccgcctcctgggttcaagcgattctcctccttcagcttcctcagtagctgggattacaggcacgcgccaccacacctgggtaatttttgtatttttctagagatggggtttcaccatattgatcaggctggtctcaaactcctgacctcttgatcgacccgccttggcctcccaaagtgctgggattacaggcgtgagccaccacgcccaactgaaaaacgtatttttatatgtaaccaaggggaggagagcagaaaagagacactaacctattgctaggtgttagcagagttaaaagaaattgaaagcatagaaatggaatttaggcaacacacagctgtcattgaagaaaagttttccatcatagtatagatatttttcttgggaaagggactcctgaatattgaacccctttaaagaagagaacttgttgcttacttgttttagtaaagagcacagaactaaatatttgggtgtttcttgatacaggattggctaccagacaagaggaaagtattttgagtttggaaattttaggttattaagactacttaaaacccttatgattcttacatatgaggtactataacagatgttgtgagggacaaaatgggctgtgcaaaagactggataaataaaagcttattacatgtttaactatagttttatacacagattaagtattcagccctataggttttctggtattagtcctttttagagccaaaaattgaggtaacttgaaaacataattaccagttatgttgaggattatcattgtttatttttcaccctggaacaagaaagtggtattcttaaaatgtttgttttctgtaaaatatttttcctgttccaaatgttctttttatgttgatttttgggcaggtatgtactggcagtaagttgaaaacgttagataccaaattcttcatttctgaattcttcattcttcatttctggactttacagctatgaaagaacaagacaaaggaattcagagctttcaagaaccaagtatgtcaggatagttgtggaaaacagatctttttctcattttctttgagatgaagataggcaacatttgctgcccattaaataccttaaaagtatacaggtgtatctgcaggattctttttgctgcttttaaatagtatattgttttaaaaggtctgtttttatcttgcctttacaattatatagacttttattgactagctgatcatatagggccttagtatagactaccatattcgccagcatttaagaaatagtccccttccctccaggagagtatttatctggtactcccatattatggattgaaggatgagacaagagactgagtattgctaatagttctgtgtgagcctgcagtgttaagtaaaacctattgagtgcacaaaaaaatcatgttacaattactacaaaatagagaaaccacctaggttaccaagatgtcaaataatggattaatggaagaaagtaatgtacctccttggtagcctacataatccaccttaatttgttatttcttatttaactattttgctatgtcttaagaaatgtatattaagtgaaaatggatgcataaaaataaaaaaagagaaatgtatatatacaagctacatgaaaattggtcctgggaataaatcaagaaattcaaccaacaaggctaccagttatttagtaaataccaaagagataggtggaatgtagcagtacagaatatcacagctaagatatgagtaggtagttccactccctcctaccccacctcagtttttattaagaaaatttcacgcatgcgaaaagggagaaagaggctgggcgcagtggctcacacctgtaaccgaagcactttgggaggccaagatgggcggatcacaaggtcaggagttcaagaccagcctgaccaacatggtgaaacctgtctctactaaaaatacaaaaattagctgggcgttgtggcgcatgcatgtaatcccagctactcaggaggctgaggcaggaaaatcacttgaacctgggaggtggaggttgcagtgagccaagatcactccagcctgggcaactgagcgagactccatcacaaaaagaagaaaaaagaaaagggtgaaagaattctacaaggaacacttaaactatccaccacctagacagagtgactttttttttttaagacagagtctcgctctgttgcctagactagagtgcagtggcacaatcttggctcactgcaacctctgcctcccgaattcaagcgattatcctgcctcagccttccgagtagctgggactgcaggcaccagccaccacgcatggctaatttttgtatttttagtagagacggggtttcactgtgttggccaggctggtctcgaactcctgtccttgtgatccgcctgcattggcctcccaaagtgctgggattacaggcgtgagccactgcgcctggtgacaggatgatttttaatgttttggcccatgccaaatattttttgaaagttggcatactagtatctataagaaaatatcaaaatagcccacctgtagtgacaactacttgggaggctgaggcaggaggatcacctgagcccaggaggttgaggctgcaataagccgtgattgtgccactgcactccagcctgggggatagaatgacaccctgtctcaaaaaaaaaagccaaatatctatgtatttgcttaaccccttgaaagtcactttcaagatatttctattaaatattttgtgcatttcctaggaataaatacattctcctacatgaatataatatgattatcctttctgtttaaaaattttttagagggatcggttctgtttcccagattggtcttgaactcctgaccttaagcaatcctaccaccttggcctgccaccatgcccggccaacattgactttttttttttttttttttttttttgagacggagtcttgctcttgttgcccaggctggagtgcaattgcaccatctcggctcactgcaacctccacctcccgggttcaagcaattctcctgtctcagcctcctgagtagctgggattacaggtgcccaccaccacgcccggctaatttttgtatttttagtagagactgggtttcatcatattggtcaggctggtctcgaactcctgatctgaggtgatccacctgccttggcctcccaaagtgctgggattacaggcgtgagccaccgcgtccagccgaacattgacatttttaaagagacttctattagttttatagaatgttccatattctgcatttgattatttccttctagaatgtcccaccttctggatttatctcattatttctttgtggtgatacttaatttgttcttttattgctgtatttcttgtaaacgcaaagttacatttaaataatggatttgggccaggcgcggtgcctcacacctgtaatcccagcactttgggagactgaggcgggtggatcacctgaggtcaggagttgaagaccagcctgaccaacatgatgaaaccccatctctactaaaagtacaaaatgagccaggcatggtaacgcatgcctgtaattacagctccttgagaggctgaagcaagagaatcgcttgcacccaggaggtgaaggttgcagtgagctgagatcgcgccattgggctccagcctgggcaacaagagtgaaactccatctcaaaaaattwaaaaawaaataaaataaataaataattgatttgattcaggttaaatattattgtcagtaatacttcatacattgtttttggcttttcttgtgtatttgtttgcaaaaaaatgccatagacaaaacagctgataactaatgtgaattattagtcagtagtttattggttaatgtttttcttttttctttccctttgaggcagtctcctgtctcagcctcctgaatagctgggattacaggcgtgggccaccacacctggctaatttttgtattttttttttttagtagagacggggtttcaccacatctctggtcatggtcatggccaggctggttttgaactcctgacctcaagtgatccacccacctcggcctcccaaagtgctgggattacaggcgtgagccactgcaccggtcctggctaaggtttttctatttaaacatattacaatcataacctttggcttttgagatacagagctactgtaacttttaagttcaaccataaataagatttttgaggaagaacatagaaataggtttccattttgtcactttgaggcattgccctctgcaaaaatgatttgaaagttgaagaagctagaagagtttatatgtagcaaaagtaacctgtagaggaattgtaaaggggccacaacaagaaaaaatttagaactggggaggctgggcacgactgctcatgcctgtaaaacccagcactttgggagaccaaggcaagcagatcacttgagtcctgaagttcaagaccagcckgggcaatatggcaaaactctagctttatagaaaatacaaaaattaaccaggcgtggtagcacatgcctgtagtcccagctacttgggaggctgagacgggaggattgcttgagcccaagaggtcgaggctgcagtgagttgagatcgcgccactgcactacagcccaggcgacaaagaccctgtgacctaaaagttgtcagatgaatatgaagataaaatcaagttcctggctgggtgctgtggctcatacttgtaatcccagcactttggggaggccaaggcaggtggatcacctgaggtcaggagttcaagaccagcctggccaatatggtgaaaacccatctctactaaaaatacaaaaactagccagccgtggtggtgggcacctgtagtcccagctacttgggagactgaaacaggagaattacttgtacccggtaggcggaggttgcagtgagccgagatcgtgcctctgcgctgcagcctgggtgacagagcaagactccgtctcaaaaaaaaaaaaaaaaaaaaaaaaaatcaagtttcacaggtaggtgattataggatgaaacagactagatatatatggattttataaaaaaatttttaacatacaagatataaccatttgaataattcataagaaccttgttctgctctcttgcagagtttttgagacggagtctcgcactgtctcccaggctggagtgcagtggtgcagtctgcaagctgcatctcccaggttcatgccattctcctgccccagcctcccgagtagctgggattacaggcggccgccaccacgcctggctaattttttgtatttttaatagagacggggtttcaccgtgttagccaggatggtcttgatctcctgacctcgtgatccgcccacctcggcctcccaaagtgctgggattacaggcgtgagccactgtgcctggcctgagaggacaaatatttttaaaaagaaatgatagttctttatgtatagaatgtgggatgatttttttttaattgccctcgttttcagaacatgtattcagtttgatcagtgattttcagtcttggcactattgacatttagggtcggataatctccaggctatcctatgcattgtaggatgttctgtagcactcctggccactacccactagataggtcagtaacacctctcctcacccccaccctgattgtgactaccaaaaatgtctctagacattgccaaatgccctctggggggcaaacgtgacctctgataaaattcactgtcacttatgaagattccttaattatttatttatgccttttatgaactagggttcccttgatgtaagctaggtacaggtgttgaatgaatcccttctgcagatgtagtgtatagcttgggcggtgcctgatatatgttggagaacactggaatatgatgaaatattttagcactattgggaatttaattgaaggttcgaaatgagctcttgttttgaaagtaaaggtgtaggctttctgctgtatctaaatctctgttttccacctctgccaccaccccctcatgcatttgcttgaaaaagatccttactagcttaggaatagttgagaatttcgtttgaaatgtttgacatgatctgtctatatcttgtgttcaaggaaagatagttttgtttgtttgcgtgtttgtttgtttgtttgtttttgagaacagggtcttgctctgttgcccaggttggagtgcagtggctcgatcacagctcacttcagcctccacctcctggacttaagagattctcccacctcagcctgttgagtagctgggactacagatgtgcatgccaccaacactctgctaatttttctactttttatagagatgagatttcaccaagttgcccaggctggtctcgaacctctgggctcaaagaattagggctcaagcagttctcccacctcagcctcctgaagtggtgggattacaggcaaagaaaagatagtctggaaaagttacttgctaaaaggcttgattaaactaaatgtgtcctctttgttaacctttgattgtttgattatatttttcttaaaatttatctttttaaaataattttttaaaaattttaatagatatgaggtctctctctgttgcacaagctggtctcgaactcctgaactcaggtaatcctctcacctcagcctcccgaagtgctaggattgcagatgtgagccaccacacccagccaaaatttcttaactacatataaattatcttaatgatctaggtattttgttaggggaatacatacagtcaggataggataagaggggaagtaatgagtggtttactaaatatataagacaaacatttcaagtaaaaatttcaggagaaaatttttttttaggtttctaagaaatatatttgtggatgtggaatttttctgtcagatgacgtaagagcaaagttgaagatagctaatacttggggattcatatggaggtaattttttatttaaaatgagcaagaaggaccctagccttttattgtggtcttggaaactcattccccaccagtatcattccttgaagaaatggttggttctaggtctggggcaggaaatatatgagataagctgaaacatcttgactatcagcaaagattttatcaaacgatgctagggttgtgtcagaaggactcagcagccaactgaagacgttcccactggccaaaatagggcacattgagtatctgtaaagataactgcatggatcaaaacacatcaaaagctgggcacagtggctcatacctrtaatcccagcactttgggartctgaggcaggtgtgttgcttgagtccaggagtttgagaccagcctgggaarcatggtaagaccccctctctaccaaaaaaaaaaaaaaaaaaaaaaaaaaattagccagacatggtggctcttggttatcccaagagttagttagctctttgtcccaagagttactcaagaggttgaggtgggaggatttcttgagcctgggaggtggaggttgcagtgagctgagattgtgccactgtactccagcctggatgagaccacatctcacaaaaaaagaagagaaaaaagaaattgggataatgactagatatttgatattaagggattatcagttttttaggcatgtaatggtaatacaatttttttgtttttaagatggagtcttgctctgttgtccaagctggagtgcagtggcacaatctcggttcactgcaacctccgcctcctgggttcaagcaattctcctgtttcagcctcctgagtagctggaattacacacctggctaatttttgtatttttagtagagacagggtttcaccgtgttggccaggctggtctcaaactcctcacctcatgtgatccgcccgccttagcctcccgaagtgctaggattacaggcttgagccaccgcgcccagccatacaatttttttaaactatagtcttttaaagtccttatcttttagacctacataccaaaatatttatgaatatgatgttttagagatttgtttcaatataatacagggaagtgggggcataaatgaaggaatccattttgagttgataatttttgaaactgagtgacgaatacatgtctaacttttttattcaattaaaatttgtatcattaaaattagcagaaaaggaaccactacaattttgattcagagactcgtatgaaaatttgcctgttcacttgttgcagtatgattcccaaatttactgcccatccaagttttccttttttttttttttttttttttttgagatggagtcttgctctatcgcccaggctagagtgcagtggcacgatctcagctcactgcgacctccacctctcaggttcaagcgattctcctgcctcagcttcctgagtagctgggattacaggcgtgtgccaccacacctggctaatttttgtatttttagtagagatggggtttcactatgttagccaggctagtctcgaactctcaacctcaggtgatccccccgcctcggcctcccaaagtgttgggattacaggcgtgagcaaccgcgcccggccgttttcctcttgatgtagcactgtattcactatgggctggctttaaatatctgaaattcgcatttctgtttggcagttttgaaataaaaaatgagaaattaaaatgccccttaaggattacatttcagcataatttttttagtgtgataagtatccaatccttcatagcaagaaattagggaagagggaataaaattcgttttttttttttttttttttccttatgagaaagatttggtatggaaggaggttaaatgtgtggaatgatagtttgggaagatctttttttttttttgagggcacattttcagaatctggatatacatgttaacactgcatatttagtaattactgtcttctttgttcaaaaacagttgaaaggctgcccttgcccatgatcggggctaaaaaaaaaaaaaaaaaaaagttgaaagacggtatgccatggatcacttgaaagaccacagagaatggtggtgtttcttgagaatcttggtagaaatattaaatactgcattttattatgttagtataagatttccttttgataactagaaaactacaagaaggatctaaatttgaattttctatttttggtttgctgaatatttatattaggttgatatatctctgttgtatcttttagaccctgagttatagatgctgaaagtgaaaggaattgatcacatcctgagatagcagagtgtaggtcaaaatcaaggacagttttgaaaaatttggcttcagtgtctttcagagatgctttgtgtataagtctgtgaaatatgttcagtcagcagacctaatattttctgagttgacaaaccttattagctaactccatcttctatgttgtttaaaaaaaaatgaaaaatatttccccataagttggattttcttttttttctttcttttttgtctctttctttttttcttttttttttttttttgagacagagtctggcttctgttgcccaggctggagtgcagtggcgtgatcttggctcactgcaacctctgcctcctgggttcaagcgattctcctgcctcagcttcctgagtaactgggattacaggcgtgtgccaccatgtccggctaatttttgtatttttagtagaggtggggtttcaccatgttggccaggctggtctggaactcctgacctcaaatgatccacccttctcagcatcccaaagtgttgagattacagatgtgagccactgtgtccagccaagttggattttcttttcattttgagtcttttaatttacattggatatcttggcagtactcatacctaaggagaagagatatttttctcacttgattaaaaagtagttaggacataaacatctttctttgccatcttttcagatctaccctttttggttatttccatttgttttttattttattttgtagggatggagtattgctctccagctctccagctcaggctggagtgcagtggcaccactgcagttactgtaacctcgagctcactgtaacctcgaactcctgggctcaggcgatcctcaatcctcctacctcatcctccctggtagctgggaccactggtgtgtgctgcacgcctggctaatttttaaaaaaaaatttgtagagatggagtcttgctgtgctacccaagctggagttctttccatttctctcagaaggtcaaatggaagaaatttcaatattcttattaaaattcattgctttataaaataaagaactgaaactcttaaggtattgtaaatacttaagataaaagaacacccttttgggtatgctattaaaataaccacaggcatgacattgaaaaccacaatttgtattctgatagctcttcatattccaaatcaaagttttcatatgtgtggagagtttgcttgtaagtggtcaggacaaaagtaggtccttgaaaaccatcggcagaggttattgtccacagtttatattcattctgctgggtgttggatatttgcgcattaattatctgttgactaagctctcagaaagttatacagcaaagaacaatggaataaaattaagtatttaaggaaaaagtttttgaaaatatattttgtagtggaattagactggaaaacaaaggcatgtgttgtctttgtctcaaagaatacctgtgatatggatttgatttctttttaattcagtttctggctagtattgtcttcatataattaagcctgaaaataagagaatttaagtaagttgatcccttagatctttttctttcctcaccccctttgtggctttggtttagaaagacagaaataattaaaatagaagattaaagaccagttagaatccagttaagcactttacccattaaaacccagagtgcccctggctatagctgactcactggggcactgcaagattgttttcaattttcaagcgaaacaatgccatctgttgggcttcttgcaaactgctactgtcaggatgtatagccctaactaaatactcaataaacagaatggttaggttggttgtttggttttggttttcgcttatggatgtagcagcagaattactaagacactaaggacacttagagccttacagtaaaggctttgtttgaacattgagcagtaatagtactcccgttccaacacagagaaactgacccttagtaaactgttattggagggcagaatagcattaactctttgtttgcaatgcagagatacagactttatttatttgtttttatttatttttattttttttgagatggactttcgctgttgttgcccaggctggagtgcagtggcgtgaattgtggctcattgcaacctccactcccatgttcaagcgattctccagcctcagcctcccgagtagccgggattacaggcatgcaccaccacgcccggctaattttatgtttttagtagagatgggttttctccatgttggtcaggctgatctcaaactcccgatctcaggtgatccgacctcaggtgatccgcccacctcggcctcccaaagtgctgggattacaggcgtgagccactgcacccggctcagactttaattttttaaagggacatgtaatttaggcagtgttttcaaattaagggttgactccgaaatcacagtggaatggcctccaggatttcctagactagacgtacaaggtagtagtaggactgggactagagtatgacaagtaaggttctcatcttagatgcaaaatttaaaggagtacagagaggttcagtaatcataataaatgcattttaatgcatcattttaaaagatcaatattaatgcagaacaatccataatgaacagaatatctattttaaataaagactgaatccgatcctgcacttgcttgactcacctcactgtcctcatcctaaccctggccctgggtattacacattaaactttttgttgttgttgttgtttttgagacggagtctctattgcccaggctggagtgcagtggtgcgatcttggctcactgcaacctctgctgcccggggttcaagcaattctcctgcctcagcctcccaagtagctgggattacaggcgcctgccagcgtgcccggctaattgttgtgtttttagtagagatggggtttcaccatgttggccaggctggtcttgaactcgtgacctcgtgatccacccacttcagcctaccaaaatgccgggattacaagcataagccactgtgcctggcctaaacttttataatcctaatttttttttttttttttttgagacagagtctcactctgtcccccaggctggagtgcagtgttgtgatcttgaccccctgcaacctctgcctcctggattcaaacgattctcgtgcctcagcctcccaagtagctggaattacaggggtgcaccgccacgcctggctaatttttgtattttgagtaaagacagggttttgccatgttggccagtctggttctctaactcccaacctcaggtgatccacctccctcggcttcccaaaatgttgggattacaggcgggagccaccatgcccggcctgtaaccctaattattaaataatttgctgtggaatggattctaatattcaataatagaagttgtaattctgaacccttggaaatggaggaaggctagaggatatgataaaggagtccaaggaggtaggttaccaatggagtcaaagttctgatttcatrtttggtataaagcaatatctcctattcttaggcccatatcttatttgaatgtttttcttayagcatggcggacaccgacctgttcatggaatgtgaggaggaggagttggagccatggcagaaaatcagtgatgtcattgaggactctgtagttgaagattataattcagtggataaaactaccacaggtaacaaaagctcttctgatcttagatggtttaaattaattaaattgaatggtattttggttaacaaagtgtgagatggaaaaggacttgaagaatccagggagacctcgttgtggcactcactggtgctgccttttttcccatgctctagtctgtgaaaacctcagtttcctcatccatatagctagaaactatatatttaattcatcgaaaacattggaaggttggattaaccagtgtttatcaaatatctagcagtcttcttactaaaagatgtatgaacaagaattcaaagtggtggtgtgtgtgtgtcagtgctcatttatgtacccagtcaaaaataggttcccatagtcttgttttttttgttttattttgttttacttgaacttggtttcctttgtgagtggagtagaaattgccttgtgtctgccttcatggacagtttacaaatttaggcttgttagcttttctttcataaaggtgatactgctgggtcaaattctagattgccctgaattcagaaaatgggtggtagttcttttgctcccctaaattgtaccagttgctctatatttttatctttcctgtcttgagacctgaagatggcattggtttgggctgaaatagggcacagttcagggtcttttggatggcttaatatgcatgattatgaataccactagtggtaataataaacctttgagtcctagaggtttgctagtgctatgtaagcaaagattaaaatcccagttcagtgggctccrtgatgtaacttaattaaccaggagatgtgagacgaagaagggattgtgtttaaatggtggactaagggttaagtrggaggagaaatcacatgaacagttggatttatgaaacaggaaactttttggctatagagacccacaataagatggaaagggaagattagagcagtatccttyagtgtcatctgtccctgtctccaagtgactatgcctccccttccccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatggtaagtgggattattgggaaataataatcctgggctagaggggtgaaagaataaaaaaggtctcagggacagccctacctgtttagttaggtacagatgtggttctactagttggaaaatgaatttagtaatgattctctgatacggaagtgatttctgtagatggtgctattccttctaagttagtgctgactcggtactggtgtttcaagtgagagagcagyagattcttgctattgataatttcttggagagaaaatgtcaacccaaaattcctgttaagatttttttgtttggttggttggttgtttttgtttctttaatgagaaaaattccattagtttggtaagaattttcccagggcagttctgtattttctctggcagattcatttgtttattggttcctgagtatggaagataggatagggttgttgtctacatgaaagaaatggtgaaagactagtgtttttagtgtattttattttattttttttaatagaaaggctatatagtattggtttctatttaatttctaatgtctatttctacactcctaagatgagttgttgaccagttatgtctcaagattcataactgaagtaggcactttcatagagtcattgcatcgctgcgagggactttattttttaattattttatttcctttaaaactaaaacagctttagtactacaaaaataatatatgcattgtagaaaaactataaagtgaaaaaaaaaaggaacaaaaaaatgtttaaccataatcccaccacctgaagataactgatggttacttttattctgtacatatatttattttttatttttatatacatctatatgttatatgtggtgattttcatttgacaaaaaaagattatacaagttgtacattactctgcctgccttttccccttaatagtgaatatcttattttaatagtcatctataacatttttgatgactgactgtatttcccattatttgattaacttattaacaatgggttgtaagagggtatattgctatttttaagagcttcagtgaacattcctatctctgtatcttttctcgcattgttaattagttctgcaaatatatttctgaaacaaattgttggctcaaaggtcatcacagtttttaagaattgtgatcagtattgttcctggattggccatctagaaatgttgtgtcagtttatattgctgatagaagagagtatggtttttagtttgggaatataaccatttatatatgcattccccattgttgaacatttattagggtccccatcctttgtgattacaaatgatgctgtggtgaatgttttcaggcatgtgtccttgcctactgtgtaaaacgtatttgcaatataaagtcttagaggtgagatttgctggatcaggtgtttataatttgatagacgttgtcaagttgtcctaataggttgctctaaataagtgcccgccagtagctctttccccgcattgttgccaactttaggtattatcaaactttaaaacctccatgatttccaaaggttttcagtatttgggtactgaaaatatgatgattttatggggaatctttagacttctaaaaaacttataaatgggatcccttgtatgtataaagatggggaaccatttatgtaaagatttctattattttacagatgtggaaactgaggcctagagagtctaaataatttgcttttgttataagtaataatagttgctaagtgactaaactgtatttgcattttcgggacttcaaagctttcgggatttccactgtattatattgctttcctgtgtatttcttttttttttaagccagtcaaatttagcagtgggggagttgtataccaactttagtgacactaatgtttataagttctgataacccactaccacaggactagtcctatgtgtctctcaaactgttaaagttctgttagcaaccagcttacctaaccttttctttgatcccagggttccaaggcccatactgagatggctgtgcatcttcttttttttttttctccctgagacgggatctcactttgtcacccacgctggagtgcagtggcgtgaacacagctcactgcagcctcaacctctgtggctcagcaatcctgccatctcagccccgcaagtagctaggactacaggcacatgccaccatgcctggctaacttttataatgtttgtagagacagggtttcaccatgttgcccaggctggtctcaaactcccaagctcaagcgatcctccctccttggcctcccaaagtgctgggattacaggcgtgagtgagccaccatgccaggccagctgagcatcttgtgacatgctgagatgacctagtctccttgactccttgaatgtacccttgattcttgagcctgcctatggccagtgtactaattttttctaaaaaatataaattgactttatttacttcaaaagcctctaatatttaaattaaaatgttaacccataacccatgttcatgaaaaaaaagaagacagtgggtatagactggtaagtaaccacagtcttgtgtattccaaaaaaaaattcatccatagataagcataaattaattgcagttgtctaatttattttactttatatatctatataaaaaatacatacagttctgtaacttttttcatcagatactcttgttttttcttttttgtttttttttgagatggagtctccctctgtcactcaggctggagtgcagtgatgtgatcttggcccactgcaacctccacttcccgggttcaagtaattctcttgcctcagcctcctgagtagctgggattacaggcatgcaccaccatgcctggctgtgttttttgtgattttagtagagatggagtttcacagtgttgaccaggctggtctcgaactcctgacctcaggtgatttgcccacctcggcctcccaaagtgctgggattacaggcgtgagctactgcgcccagcctaggaactcttgaaatgctagtccaactttaaggatatggcttcagaataaagtgaatgagaaatactgcctcatacaacccagtttccctttaagccttcagtttaattgtattgatatattatctgcttactacattagtaacatagcaaatgagaataacgtttgtttttttgagacagagtcttactccatcacccaggctggagtgcagtggcgcagtctcggctcactgcaacctctgtctccctggttcaagcgattctcatgcctcacccaccccagtagctgggattacaggcatgcgctgccatgctcggctaatttctgtatttttagtagagatggggtttcaccatgttggccaggctggtctcaatttcctgacctcaagtgatccacccaccacggcttctcaacgttctgggattacaggcatgagccactgctccccaccagcaaatgagaataatttttaaacaattcagtattgtttcacttagtgtactttaaaaagtttagaaatttaaaattaaaaaaaaatttgtggtctcagaagagggaaagatttcttaaaccaaatacaaaaacagagctaaccataaagggtaaaattgataaatagaactacattaaagatgtgattaaaaaaaaacacacacggagaagacaaaccacaaactggaaggtgtttgtggcatgtattactttttttttttttttgagacggagtctgcactccagcctgctttgttgcccaggctggagtacagtggcgcaatctcggctcactgcagcctctgcctcccaagttcaaatgattctcgtacctcagtctcccaagtagctgggactgcaggtgcctgccaccacacccggctaacttttgtatttttagcagagacagtgtgtcaccatgttggctaggctggtctcaaactcctgacctcaagtaatctgcctgtcttggcctaccaaagtgctgagattacagacatgagccgcctcacctggccctcgaaaagttaaacatagagttaccatataacccagcagttctactcctagctgtatacccaagagaatggaaaacgtatgttcacataaaaacttgtgcactaatgttcatagcagtatcatttgttatagctaaaagtaaaaacaacctgtgtccataaattgatggataaacaaaatgtaatatatgtacacaatggaatattatttgcccataaaaaggaatgaaatactgatacattctataacatagatgaaccttgaaaacataatgctgagaaagaagccagacatacaaaattagccaggtgtggtggtgcatgcctgcaatcccagctattagggaggctgaggcaggagaatcgtttgcactcgggaggcggaggttgctgtgagctgagatcgcaccactgcactccagcctgggcaacaagaggaaaactctgtctcaaaaaaaagaaagaaaaaagaagccagacacaaaaggtcacatattatatgattccatctatatgaaatgtcttgaataggcaagtccacagagagagaaattagattcgtggttgccaggggctgggaagagaaaagaatggggaataattgctaggggaaatgaggtttcttttgagggcgatgaatatgttctggatctaggccaggcgcggtggctcacgcccgtaatcctagcactttgggaagccaaggcaggcggatcacctgaggtcaggagttcgagaccagcctggctaacatagtgaaaccctgtttctactaaaaatataaaaaactagccgggcatrgtggcatgtgcctgtaatcccagctactcgggaggctgaagcaggagaattgcttgaacctgggaggcggaggttacagtgagccgagatcacgccactgcactccagcctgggcaacaagagcgaaactccatctcaaaaaaaaaaaaaaagaaaagaaaatgttctggaactaaataatgatgatgatggttgcacagccttgggaatataaaaaaaaatcactgaattgtgtattttaaatgggcagtatgtggattatatctcaaagctgggtttggttttttgtgtgtgttttgtttttaagaaagtatcaaggccaggtgtgtggcttacacctgtaatcccagcactttgggaggccgaggtgagcagaacatttgaggtcaggagttcaagaccagcctgaccaacatggtgaaaccccatctctactaaaaatacaaaaaaattargcgagtgtggtgrcatttacctgtagtcccagctacttgggaggctgaggcaggagaatcgcttgaacctgagaggtggaggttgcagtgagctgagatcacgttactgcactccaacttgggctacagagcaagactccatctcaaaaaaaaaaaaggaaagtatcaggaataaaattttggaatatttttactattctgtttgatgttctttagaatttactactcagtattttaaaattattcctgtagttctgactcatcttatgtttgcacaggaaagaaacattatgaggtgaaataaactattgcttaattctgagctgtgaatgatgtgaatttaatgttataaatttcttacagtataactaattatggttttcagttcctattgtatttagccctctatttctgggctttaagggtatggaagtaaacytaaaagaatgaaggaaggctgggcgcagtggctcacgcctataatcctagcactttgggaggcttgaggcgggcagatcgcctgaggtcagaagtttgagactagcatggccaaatagtgaaaccctgtctctgttaaaaactacaaaaattagctgggcatggtggtgggcatctgtattcctagctacttgggaggctgagcagaagaaccacttgaacctaggaggcagaggttgcagtgagctgaggtcatgccattccagcctgggtgacagagcaaaactccttgtgaaaaaaaaaaagaaagaatgaaggaaaaaaatcaagagagagcaaacttagagggagaaagttagttgcataattctttgatttatgtgcaaggtgggcagatcacaaggtcaggagatcaagaccatcctggccaacatggtaaaaccccgtctctactaaaatacaaaaaaatgagctgggcatggtggcatgtgcctgtagtcccagctacttgggaggctgaggcaggggaatcacttgaacccaggaggcagaggttgcagtgagccaagattgcaccattgcactccaccctggtgacagagcaagactctgtctcaaaaaataatgtgcttgataccatgtgatgtctgaagtatagaagaaaactcatggaattaattgtcactgaggtggattgttttatttcatttgtttcttaggttttctttgttttgttcaagatggggtctcactttgtcacccaggctggagtgcagtagtggcacgaacacagctggctcactgcaccctccacctcccaggctcaaacgatcctcccacctcggccccccaagtagctgggactacaggcacacaccaccatgcctagctatttttcattttttatttttgagactgagactcacactgttgcccagactggagtgcagtggcacaatcttggctcactgaagaccccacctgggttcaagcaattgtcatgcctcagtcactcaggtagctgggattacaggtatatgccaccatgcccagctaacttttgtatttttagtagagatgggggtttcaccatgatggccaggctggtctcaaactcttgacctcaagtgatctgcctgcctcggcctcccaaagtgctgacattataggcgtaagccaccacgcctggccttgttttgtttttgagatgggggtctcactgtgttgtccaggctggactcgaactcctaggctcaagtgatccacctgcttcagcctctcaaatagctgggactacgggtgcataccactgccctagkttggataatccttttaaaggctttttttttaaagcaccagaattgtgattgcctgtttcatcctctggaaatagaaccttgtaagacacttgaattgtcagaattcctttgagcaaagattgcagaaatcattaaaatgcttctaaataagtaagtataatttacctagtatgactttccatagtctggcttttgctttccattgcattgtgaatctaatctggtcttagaaaaccactttttgattgtaccatatttttgggaaaattcttttttttttttttttttttttgagacggaatttcgcttattgctcagactggagtgcagtggcgcgatctcggctcaatgcaacctctgcctcctgggttcaagcaatactcttgcctcagcctcccgagtagctgggattacaggcatgcgccactacgcctggctagttttgttatttttagtagagacgggatttctccgtgttggtcaggctggtctcaaactcctgacttcaggtgatccacccacctcagcctcccaaaatgctgggattacaggcatgagccaccttgcccagcctttttggaaaaattctaacaatccaccaaaatttaaacttgaccctgatataagagaaaatatttgcagaaaatgctgttaaaattctttataatggtatttacgggtttcatggaaacctggtctgtctttaagagacttgctaatgctgactgatttcccataaatgcaaaaagcctccatctttcccttcttgtatttaattgggatgttgagctagtaattatcttaagaatttttagaattaggataaataagagataatttattttcttttgtcctagcagttaaaataatgactaaaaaatatagacttttgcttagtcaatatttttcaaccataaatttcaaaaggatagaaagagatggttggggaacctatagattaaaagagttagttcatcagttgcactttgcaaacattttgtaactggattcagacaaattacttaaaaaatacaagtaaatttgaattttgactgggtatttgatattgaataattattataatgttcaggagttatgttggtatgattcttttatctttttttgaagttcttatgtagaaggtatattttgaaatacttatagatgatatgatctagaacttgctttaaagtgatatgggaactagtaagtatgtagaaggtatagatgaaataagacttgccatacattgataattattgaagcagggtggtggttgcataggggttcactatagcgttccctttttatgtatgttttaacttctccataataaaacatttaaaaatttaaaaaacccaccatagataaattgccagtatagtttaacatggatagaacttgctggaattttctgttttatttatctatctgcctctacaatcactggtcttctggctcagtaactgagggtctagtctactgatgagctctcagtttctgagagagtataagataagccactgttggcccattagtagccacctacatacctattcctttggtggtctagctttgtagttaactgtggtgatataacctgccaagtggaacatacatttcagaggggcccatcccattctggtgattttgggtaaaaagttgaggccatattttgcttgactctttggttttttgtttcttgttgttgttgctgttgttgttgttttgagacagagccttgctctgtcgcccaggctggagtgcagtggcacaatgttggctcactgcaacctccgcctccctggttcaagcaattctcctgcctcagcttcccaagtagctggaattacagggatgcgccaccatgcctggctaattgttgtatttttagtggagacagcgttttgctgtgttggccaggctggtcttgagctcctggcctcaagtgatgtgcctgccttggcctcccaaagtactgggattagaggtgtgagccaccatgcctggcctgcttgactctttggcttaggtatattggctctctgaaattttctatctggttttgagtatactttgtaaatcaggaaacttagtattggttttttcaccaaatgtcatgaaataggggacttaaaaatatttataaaatttttcacaaatgaaaagaatttaagatatttcaataatagcccagtttattaatatttattcatgaatgaatcattatcttctgaaatcatgtcatttttacttggtgtgggttagtttttgtccaggtcttctgattatcacccctgatgacataaagagagggctacggtaggtagcctgtcagtctctgggttcccagtggttgcttaaagaatcttgcatttctcagatttaactcactaggaagagaaaccattccttagattctgtgtrcttgctgaattaatgtttgttgatgaatattmtttttaaaaaattaagggggattagctaacaaattatcttctaataaaataggttttacctagttaaaatatggaaaaagacttaacatattttgttctgctgatttggtgggggagattatgtgtggtcacttaaatcatgagagtcagggtgctagccacatagaattctaatgtgtctttcatccccagtgaagacatatgggtgaagtgttagtgaacctcccctacccatctgtttttctgttagttgtagatttgggtgaaacttaaatttttggtgagtttggtcacattaaacctgagatgagtggcagtcttggatattttggcatataggacaccatttctgtttctaataaaatgtggatttgtacttgggaggctgaggtggaagaatcacctgagcccaggaacttgaggctgcagtgagccgtgactgtgccactgtgctccagcctgggtgacagagtgtgagaccctgtatcaaataaaataaaataaaataaaataaaataaagtaaaatgtgggtttaacattgtttctaacattcctttttttttttcttcctttaccctttagctggcaatcctttggtccagcaaggtggacagccactcatcctgacccagaatccagccccaggtctgggcacaatggttactcaaccagtattgaggcctgttcaggtcatgcagaatgccaatcatgtgactagttcccctgtggcctcacaaccaatatttatcactacgcaggtgagtaggaytctgaattccaaggttgctagaggagagaaagactataaacctctgaaaactctgacttagggtctttggcgtcattagaagtggttctaagtcttgtcttttgacctggctttctcttttactgttctgtaatttgatgccaactgtggaaagcccagcatagtatggctgggtaatatcttctttaaaccccttagaagtttattaagtgatttgattaaagtctaggcagaaatagtgggaaaacttgaattaggaagccttaacgcttggctcttgaggcttttcaccctttgcgtggactgctcctcttcacatgggatgaattagttaacttttggagatgtatgtatgtaattggtggagttcatggagacctttgggagacaaggaagatgacttatttgatatataatgtgttgaattgaagttgaaagcctaattctgaatatggattctaaaggcaaatgcttctctttgcctgtggcttcctgagttgtaaattcttatgaatttgccaaaggtttatggcctttgaagtagactttgggaacaattttttaggattgtttgtatgttgaatcactccagtgaacattgctcttccccctgccccccacccccacttctgttcatttagcactttagggagccagtctgttgatgaggtttttttaagccgatgctctcttaagtcaggaaataggttttcatttttgctcatgtgtaccaaagcttgttctctaattttgatattttgtctctcaaaagtttgccagaatttcctaaatttttccctctcagtcatttgaaacctctaattctagagaaagaaccattaagtaagagtatgggaatttttttttggatgtaggtcatactgcaatctttgtcagtgttaattggtctccatgttaaagatcattttgctttttaatacagggatttcctgtaaggaatgtccggcctgtacaaaatgcaatgaatcaggttgggattgtgctgaacgtacagcaaggccaaacggttagaccaattacactagttccaggtaaggaaaaatgtctatccatttggaataaacyggcatccagaagatttgtttttattgttctaaatatcctaagtcatttagtaagtacatttaaagaaaatctaaaaatataaaaatattaatgatttaagcccaattttaaaaaatctgcttctaacctttggccagggtggtggttttatttatttctgtttagcttttcaccacccttcatcaagtagtaaaacagagtttacagtcatttttctgtaactggtatttagtcagctattaagactatgttattaatgcaaactcataaattctacactccttacacatctcctcatttgcacggtgggattataaactttgttttaattttatagcatagattttagatataaacaaatgacattccttttatggataaatactgtcaatgactagatagtttttttttttaagattctgctagatagttttttttttttttaagattctgagaaggataatttttttaaaatcttagaattttccattgctctatttagcatgtataagtttactacaattcagaccaaaaaagagtatcttaatttagctatttgtaagggtacctctgtagcttgtcttcctaaggttttgttttttgttctcgtagcccataggggtttaagtctgaccagcttaccctggcatttctttatttttctcagtggaattgtctacagttgagccaggagacattcctctttgggacatcctagtagaatggcatagtctgtcttctgagttgatagaagaggatggaagactcctttagtactctgagaaagactgatttcttttttcaggaccaggtttgccatttggcctatatacacccatattgcttcccactcttttcttccagtaccgaggtcaagccactgattgtattcttagaattaaaaaggcagtgtgataaggtgttttaggaggagttgatgggagtcttatttaacttaatgtttttaggctgcccaggttattttgtcaacatggacaccttgtgctttcttagtctttagaatctatactcctcttggaaacctctgatgatcatccatcagtttggggaaataatctttccagtaaaggcagggagaatgkgttataggtgagctcactgaccaagatctggtactttgtctctcttttaaagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctaggtaaggcttcggaagaggagatggcagagccaggttgggatggtgggtggagaacagatgattatcacttggtcaccgtagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaaggtacaataacctgaaagactctgagcagccagtcattcaaaaacattaataaagtgtttgttgtatcagagctttatactcagaaatagaaaaataaaataaaatmcagctgctgtagtttgttcttacagaaactttagtaaggagaaagccacttacaaaaagtgtaactgaatcagctccaagaaattatgtgtgtaattgtgctttggagattagtgaaattgattgattaaagatgggtgagataatgaaagataacttcatggaagagatggatttctgagcaaggttttaaagttaggatttggtagagagatcttcaggttgagaatgatgagcatgagggttttcagtggtctagagcaggggtcggcaaatgttttctgtaaagggcctagtagtaaagttgtaggctttgtgcacaatatatagcctctgttgcagctattaactgtgctgttgtggtggggaagcagccacagatacataaacgaatgagcatggctgtgctccactaaaaactatttatggactctgaaatttaagtttcataaaattttcatgtgtcgaaaagttttattcttttatttcaaccatttaaaaataaaaaccgcaaggtatagtggctcacacctcatcccagcattatgggaggccaagacgggaggatcacttgagcctaggagtttgagaccagcctgggcaacatggtgagatcccatctctacaaaaaaaaaaaaaaaaaagattagccaggcgtggtggtgtatgtctgcagtcctcgctactcagaagtctgaggtgagaggatggcttgggcttgaacccagaaggttgagcctgcagtgagccatgagcatgccactgcaacagaacgacaccctgtctcaaaaaaagtaaaaacctttaaaacatggtgttgggaaaactagatatccatgtccaaaagaagttggatcttaccttacaataaatacaaaaattaactcaaaatggatcaaagacctaaatgaactaaaactataagactcttagaaaaattataggacaaaaagcttcatgatactggatttgacagtgattactatttcttggatatgacaccaaaagcatacgcaagaaaagaaaaaatgagtaaattaaattatatcaaaatttaaaacttttgtgcaggacgttgtcaacacagtgaaaagggaagccacagaatgggagaaaatatttgcaaattatgtatctaataaggggttaatatccagaatatataaagaatttgtgcagttcaacaacaaaaaaactcccaaacaacctttttaaaaaatagacaaaggactcgctggkcgtggtggttcatgcctgtaatcccagcactttgagaggccaaggcaggtggatcacgaggtcaggagtccaagaccagcctgaccaataatggtgaaaccccgtctatactaaaaatacaaaaattagccaggcgtggtggtgtgtgcctgtattcccagctgctcgggaggctgagacacaagaattgcttgaacctggaaggcagaggttgtggtgagtcgagatcgtgccactgcactccagtctgggcaacagagaaagaccccatctcaaaaaaaaaaaaaaaagtaggaaagtaggcaaaggactgaatagacctttctccaaagaaagttattgccaataagctcatgaaaaggtgctcagtgttattaatcattatggaaatgcaaatcaaaaccacaatgaggtaccgtctcactcccattaggatggctactatcaaagaaccataaaataacaaatattgttgaggatgtggagaaagcagaacccttacgcactgttggtggaaatgtaaaattatgcagccactttggaaacagtatggtggttcctcaaaaagttaaaaatgatagaattgttgtatgctccaggaattccattctatacccaaaagaattgaaagcagggactagaacaggtatttgtacacctatgttcattgcaacattattcacaatagctgaaaggtgaaagcaacacagaggtccatcaactgataaagggataaataaaatgtggtattcacatacaatggtatattgttcaggcttaagaaaggaaattctgctacaacatgtgctgcaacatggttgaaccttgaggacattatgttaaagtgaaataggctagtcacaaaaggacaagtaccatatgattccacttacttgaggtacctagagtagtcaaattcatagagacaaagttgaattgtggttgccggggtggaggcgaggggagaatggtgaggaggtttttattggatatagcttcagttctgcaagattaaaaaaaacaaaaaccttaacaaaaaaatcacatacaaattattcttagcttatgggccaaacagaaactggtagctgggctggatttgatctgtgtgctrtggtttgctgacccctggcctagagttagaacagtaaaaggaagcctcaaacatagtgatcttgagcccagggaggtcaaggctgcagtgagctgtggtcgtgccactgcactccagcctgggcaacagactgagagaccgtgtctcaaaaaaaacaaaaacaaacaaaaaccatagtgatctctcatgcttgcttacccttttatatacttctcagggagtgtttgactttttcccaaaaggtcagtaatctttttccagtgtcattgtattaatcttatcaattcttctcacttctttcagtgacctcttccatcccagtatttgacctccaggatggtggacggaaaatatgtccacgatgtaatgctcaatttcgtgttactgaagctttgagaggtcacatgtgtgtaagtgatatcacctgtgatccagcttaagtggcttctgccatttaccttcattaatattggaagcttgtaagcaggggctctaaaatgactgaagctttttaaagggttactgtttctcttggtctgtttttagaagagctgtgtactttggaatgtgatgggatacatttaaagaccctcaaatagatcagaacatatgtgatcttactttcttagtgtggtagattttgaaaccacacaggagaacaggtttatagataataaggactcaaaccatattggcctcagttcatttttgttaattgtgtcattggatgaatcgggagctcttacttccattttttagcttttcattttttggtattagtccagataaaaaggttggaacttcttctttgccagggagctcagagccaagttatactaatgattaagggacctaagacaggcaggagggagaaatacaaagtatagcgcttgggtggcatatgtggatatactctagaaaaggagtaaaacttggaaacgctaaaaaaaactgaagggtgaaagctgaatgagaatacctgaaaccaaaccgttaacaaggaatggtagtgaagttaaggagttagcacattctagcccccaggataaccagaatgatcagatgtctttctttatagtactgttgcccagaaatggttgaataccagaagaaaggaaagtccctggattcagaacccagtgtcccatcagcagcaaagcccccatcccctgagaaaacagctcctgttgcttccacaccctcttctacacctattcctgctctgtcaccgcctaccaaagtaccagaaccaaatgagaacgtgggcgatgccgtccagaccaaactcattatgcttgtagatgacttctactatggacgggatggtggcaaagtagcccagctcacaaatttccctaaggtcgccacatctttccgatgcccacattgtaccaaaaggctaaaaaacaatattcggtaagtgtttaagagccttggaagttaccttgaacaagagaagacttacattttcttatatattttaagtctttctctttggagaatggacctaactactatgcagtcttgctggggttatcattaaatcaataactaggactatagaaggagatattgtggtaataaacaaaaggtaactggatcgagtaagggaaagcagtatgtctcctttcccagaactctcttagtttcaagaactcattatctttctgggctcagaaaaggatatcccaaacaggaagtctggggaatggaggggagcagataatgtttgttctgtgattttaccattatatttctaaaaggctaccaattttttatgttttctgtactttctctttgtgckttattacagattcatgaaccatatgaaacaccacgtagaactcgatcagcagaacggtgaggtagatggtcacactatctgccagcactgttaccgccagttttccactcccttccagcttcagtgccacttggaaaatgttcatagtccctatgaatctactagtaagtttggaaactcttaaactcaaggggaatataccttgctgttcactcattgaatggcgctggggggagcccattatatttatttacrtgtgggtaacagtgtagaggaagtacttttcatatttgtagccagttctttacttcattcaccttgtttttttttacaagcctgacttttattttgttcaagcatggattgagttcagtgttagatcctgaattgttaggggcgttgattcagaaccactgtagaaaaacaaatgtaattaatttatttcttaggtctctttatagaaggaacagtcatctatttgctcttccactttagttaaaccctgataggttttatgtaggctaaaagataatattgtgaagtactttatcattaagacattgctttcaatgaaatataagatgagctggagtgttttctacactgtatattttatacatgtaggctggacataagctcaaagaaattaagtaggataaaagataatatggccgggcacggtggctcacgcctgtaatcccaacactttgggaggccgaagcaggcagatcacctgaagtcaggaattcgagaccagcccggccaacatggcgaagccccatctctactaaaaatgcaaaaattagctgggtgtggtggygggcacctgtaatcccagctactcgggaggctgagacaggagaatcgcttgaacccgggaggcggaggttgcagtgagctgagatcatgccattgcactccagtctgggcaacaagagcaaaactccatctccaaaaaaaaaaagataatattatgaagtactttatcattaagacagtgctttcagtgaaatataaggtaagctggaatgtttttctacactgtacattttatagatagatgtaggctgaacataagctcaaagaaattgagtcatttgcttatgagcgtacacctctaaatacacctctactggggatacatagtgaggatttaagcccagtattgagaatacttctcatgtcctttacgggatttccagttttgttgtaaagacaaaaattatgtaaatataggaaaatgtgagaacaagatagtatattataaacatagacattttaagatatcattgataggtgaaatacttcagagaagggaaaaaatccttgtggctaggtttccaagaaagtcgtgcttaaatttaagaaaggtttagatggatggagagtagtaagaaaagcttttaggtgattgaaaacagcatgatcaaaagcatagaagacatatgcatattatctggatgcatttgctacaagtaaaaatccttaactaaaaatgaattaaacaataaggactgggtgtggtggctcacacctgtaatcccagcactttgggaggcttaggtgggtggatcagttgaggccaggggagaccagtctggccaacatggcaaaaccacatctctactaaaaatacaaaaattcgctggctgtggtggtgtgcgcaggtaatcccaactactcaggaagccaaggcatgagaatcacttgatcccaggaggtagaggttgcagtgagctgagatcgcaccactgcactccagcctggatgacagagcgagtctctgtctcaaaacaaaagaaaacaataagaatatctgttatatcatttaactgagagatacagaaatggatgcttcagcctagaatttgactgccctgctggttttcaacaattctcttgtctctggctcatagcagggtggctgtataagtgtcaggcactatgtccagataaaaaattgttagacaaagaagagatcttatcttcccatctttctttcttgaatctgttttcttatgagtgagaattgctttccttttatatctctttgaccatttattggcaagggaagtgggattgacattaatggcttacagtaacactaggcagtagaaatacgcaagcttcatgagtaattttaatttttttcactttaaatacagtagcgctcccttatcctcaatttttctttcttgaatctgttttcttatgagtgagaattgctttccttttatatctctgaccatttattggcaagggaagtgggattgacattaatggcttacagtaacactaggcagtagaaatatgcaagcttcatgagtaattttaatttttttcactttaaatacagtagcgctcccttatcctcaattttagtctcaatcacagtccaaaactaggtgagtgcagtacaataagattattgagagagacaccacattcacataacttttattacagtatattgttataattatccttttatatattatatatttttaattgttaatctctttgcctaatttataaattaaactttatcataggtatatatatatatatatatatatgaaaaaacacggtatgtatagggttcaatactatctsaggtttcatgtatgcactgggggtcttggaacgtatatttcccattggcaaagggcgtctactgtaaagtttaaaaaaacaggcaaaattaattttaacagcatattttattcagtatattaaaaatatttcaacatgaactcaaaatttaaaattaatgagatattcgtcattcttttttcctccattaaaaaacagatcttttgaaatacaaatctaaattgggtttgagcttaccacattttaagtgttcactagatacatgttgctggtgccaccatattagacagtgaaactttggactaatcatttgggagtagaatgtatattagaatcaaccgggccaggtgcagtggttcacacctgtaatctcagcactttgagaggccgaggcaggcagattgagcttaggagttcaagaccagcctgggcagcatggagaaaccccgtctctacaaaaaaaatacaaaaattgggtgtggtggcgcacgcctatagtcgtagctactcaggaggtagaggtgggaggattgcttgaacccagtaggtcaaggctagagtgaaccatgatcacgccactgcactccagcttggataacagagcaagactctgtctcaaaaaacaaagaatcaatggtaacactgcagtgtagtgccagggtagccagcttggtctagaataggactcacgattcttcactgtcagtaatgtgaagccagagtaactcatccatacctcttagtgaaaacaccagttttttgagacaacagggtcttgctctgccacccaggctggggtgcagtgacgcaatcttagctcactgcagcctcgaacccctgggctcaagcagtcctcccacctcagcctcctgagtagctgggactgtaggcatatgccaccacacccagctaatttattccttttcttgggggtagagacagggtcttgctgtgttgcccagtctgggcacctaactcatttttacgcgtaatatggggggtgggttttgttattccgaagttccacaaataataaaattacacagagggaagataagtttttccttatggaaaagaaacaatgtagaccctcattgatcttttttctcttggtttccctgacttaatttttgagtctcttatgacaagattttatgcttaccaaaatcacctttccttagcatatatcaattttattcttgcagtctttcgtaatttccttttttgcacccttgacagatctggcatgaaagtagtttttttttttttttttttttttttttgagacagggtctcactctgttagccaagctggagtgcagtggcacaatcttggcttactgcaatctccacttcccaggctaagatgatcctcccaactcagcctcctgaatagctggtactacagacacatgccactatgcccagctaattttggggggttttttgttttggggggtgttttttgtagagatagggttttgccatgctgcccaggctggtctcaaattattgagctcgagcaatccacccacctcagcctcaaagtgctgtgattactggtgtgagccaccgtgctcagctttttttttgggagacaatcgctctgtcacctaggctggagtgcagtggcgcagtcttggctctctgcaacctctacctcctaggttcaagcaattattgtgcctcagtctcccaagttcctgggattacatgcatgtgccaccatgcccagttaatttttttgtttgtttatttttagtagagatggggtttcgccgtgtcgttcaggctggtctcaaactcctggccttaaatgatatacctgcatcggcctcccaaagtgctgggattataggcatgagccagcatgcccggtcgaaagtaactttttttctttttttcttttttttttttttttttttttgagacagagcttcattctttcacccatgctggagtacggtggcacaatctcagctcactacaacctccaccttctggtttcaagcgattctcctgcctcagcttcccaagtagctgggattacaggcgcccaccaccatgcccggctaattttttgtatttttagtagagacggggtttcagcatgttagccaggctggtctcaaactcctgacctcgtgatccacccaccttagcttcccaaagtgctaggattacaggcatgagccaccgtgcccagcccaaaagtagctttttcaaaaaaaagaattgatgcataataggtgtacatggtttagggatgcatgtgataatctaatatacatttatataatctgtaaatattaaatcagtgtacttggaatattcatcactctatgtgtttatgctagaaacattcaaattattctcttctagctattttaaaatttacaacaggttattgtaaactatagtcaccctactgatctactaggtcttatttcttctttcaaaccatatatttgtacctgttgatcagcttctcttcaactctctactcccctactcttcccagcctctggtaaccaccattctactctctctycatgagatctacttttttttttagctcccacatatgagtgggaacatgtgatatttgtctttttgtgcttggcttacttcacttagggacttccagttctaaccatgtgctgcatgacagaatttcattcttttttgtggctataatattccactgggtatatataccacatcttttttttttttgagaaggagtcttgctatgtcgctcaggctgaggtgcggtagtgcaatcttggctcaccacaacctccacctcctgggttaaagtgattctcctgccttagcctcctgagtagctgggattacaggcacacgccaccacgcccggctaatttttttgtattttttagtggagacggggttttaccatgttggtcaggctggtctcaaactcctgacctcatgagccactgtgcccagccaccacatcttctttattcattcatctgttggtgggcacttaggttgattctatattttgcctattgtgaactgtgcagcaataaacatgggagtgcagataccttttcaaaaagtagcttatttttacatgctaatattttgggggatttttttccttttattttctgaattgtttgttaattgtagacatcatgatatttttctcctaaatattttaatatgtagctctaaaaaataaggccttttgtgtgtgtgtgtgtgtgtgtgtgtgtgtgtgtgtgtgtgtggccacagtacctttgttaagatctaataggccggcgcagtggctcacgcctgtactcccagcactttgggaggctgaggcggacggatcacctaaggtcagaagttcaagaccagcctggccaacgtggtgaaaccctgtctgtactaaaaatacaaaaaattagttgggcatggtggtgcacacttgtaatcccagctgcttgggaagctgaggcaggagaattgcttgaacccgggaggcggaggttgcagtaagctgagatcacaccattgcactacagcttgggcagcaagagtgaaacgctgtctcaaaaaaaaaaaaagagggccgggcgyggagcctcatgcatgtaatcccagcactttgggaggccgaggcgggtggatcacgaggtcaggatatcgagaccatcccagacaacatggtgaaactccatctctactaaaatacaaaaagttagccgtgtgtggtggcacrcgcctctaatcccagctattcgggaggcttaggcaggagaattacttgaacccgggaggcgaaggktgcagtgagctgagatcgcaccattgcactccaccctggcgacagagcaagactccgtctcaaaaaaaaaaaaaagatstaacagaattaatcagaaatccttaataacattcaatacctactttatttaaaaattttctgagttgtccccagaatatcagtggatcattatatttaattgtgataacagtatcatcttaataacattacaggccaaggcatggtgactcatgcctctaatcctagcactttgggaggccaaggcgtgaggattgcttgagcccaggagtttgagaacagcctggcgaatatagtgagaccttatctctctctgtttttgtatttttttttaattagccaggtgtggtggcttgtgcctgtagccccagctgctcaagaggctgaggtgggaggattgtttgagcccagcaagtcgagccagcagtgagatatgatcacaccactgctctccagcctgggtgacagagtaaggccctatctcaaaaaaaaaaaaaaaacccaaaaagtagtattacatttttattcacacttgtttaagagcagtgcagtgacttgaaggagcttgtatggccctagggttcttttcataagtttgtctaatgctgattcttagtcttttttgagacagaatctcaccctgtcacacaggctggaatgcagtgacgcartcacagctcagtgcaacttaagcctcctgggttcaggcagttctcctgcctcatccttccaagtagctgggactacaggcatgttggccaggctggtctctaactcctagcctcaagtgagccacccgctttggcctcccagagtgctgggattacaggcgtgagccaccgcactctgtctgattcatagtcttttttttttttcttttctttctttttctttttttttttttttttttttttttgagatggagtttcactcttgtcacccaggctggtgtgtgcagtggcacagtctcagctcactgcaacctccgcgtcacaggttcaagcaattcttctgcctcagcctcccgagtagctgggattacaggcgtgcaccaccacacccggctaatttttgtattagaggcggggtttcgccatgttggccaggctggtcttgaactcctgacttcagatgatccgcctgcctctgcctcccaaagctctgagattacaggcgtgagccagtgcacccggccctgattcatagtcttttaatatttatgtctaatacagaaatcttaacctgcttggtggtgaggtgtcctgtgagccccttgaaattacatataaactttgcctgtgtgtgtgcatttttcaagggagaggttgcatagcttttgttagtgtgagatttgggactaaaaaatggttaagactgttagttattattcctgttttccatagtggctatcttaaggtacatttcttcaaatattcttttttttttttttttttttgagacggagtctcgctcttttgcccaggctggagtgcagtggtgcgatctcggctcactgcaagctctgtctcctgggttcacgccattcttctgcctcagcctcccgagtagctgggactacaggcacccaccaccacgcccggctaatttttttgcatttttagtagagacggggtttcatcgtgttagccaggatagaatggtctcgatctcctgaactcgtgatccaccggcctcggcctcccaaagtgctgggattacaggcgtgagccaccacacccggcccatttcttcaaatattataacatttttcttcctggcattgttacctccacttcctgagcatctcattaaaggtaacagatgtaggttattctaatctttcaaaaaatcttgtgttagtggaaaggagaaagtttgaggaagaaataggattgagagaaggatgctttaaggagcttaaccatgtttaggagtcggagcctgtcggggktggggaagattgaagacagggaaaacaaattgacaaaatcttggaatacatggcatgatgaggttggatgagccttaggaaggtacaagagatctatccttccataatttggaaaacaagcagcagaagttacagttgttcatrcctatttcctcaaagtaggagattgtgttaggtgttaaggagggtgatggtgctcagagggacagttaggacagccaccatggagaatcaattcattttccctcttgaatctttttctgtattagctccttcccctgtagaactgatgtgtcaaaggttaccagagatctcttaaatccccttatatttgagttcctacctcactagttttcttgagataacacaatgtaaatcttttttttcttttttttgagggagtttcgctcttgttgcccaggctggagtgtagtggcgccatcttggctcaccgcagcctctgcctcccagcttcaagcgattctcttgcctcagcctcccaagtagctgggactacagacatgcattactgtgcccggctgattttgtatttttagtagagacagggtttctccatgttggtcaggcttgtcttgaactcccaacctcaggtgatccgcctgccttggcctcccaaagtgttgggattacaggcatgagccaccgtgcccagccaacacatgtaaatcttaacctgatgcttgtacattagaaattgcttaataagtgtttttattattgatgttgcatgacagctgtgaaaatagagctgataaataggttataggagaaagagtgaatgagattgcccagggaaaacatagactaagaaaggcctggacaaaatattgcttaaaggtgttctagaagagaaaaatgagagaggtaaacaaatcggggggtgagtggaaaagagataatatcgttatgttgctagttaactgtttcccaaacatgtggttaactttcatacctacttgcctttcctcctgcttttctcttggtcctctctctggctggctgagccccattctttgacaattcagcttttatatgttgttatagcttttcctcattcctttatgcagaatttcttatttatccatgtcctcatagcacctaatgtacctgtagacagtgtttctaaatggagttgcagacctctttgagaataaatatgaaatgtktgaatcctcttcctagaaaaatctacattttactcttttgcaaataatttcagagaaagcctggattcctagaggcctgttccatagaccccagattaagaacccctggcttttgtttgtttgttttactttaaaaaattacttggctaggcacagtggctcatacctgtaattctggtactttgggaggctgagatgggaggattgcttgagcttgggaggtcagggttgcagtgagccatgattgagccactgcgctctagcgtgcgagacagaacgagactctgtctcaaaacaaaaatccagggttctcggtagttaaaaaaagaaaaaagaattatttcaactttattcatatttctttggctggggtgtagggggctgggggcggggggaggttagacattgtccagtaaatgcccaaggctttaagcttccagttttcatatttgcaaaaacttgaaactaattccattaaagtgacaaaaatgtaaataatctctctctttttgccatactgtataattaaaaatatgtagcagttaaaagtcttaccaaaattggccggtgcactggctcacacctgtaattctagcactttgggaractgaagtggattgacaaaaggattgcttgaggccaggagtttccgaccagcctgggcaacatggcgagaccctgtccctacaaaaaaaaattttttttaattacttgggcatggtggtgcaccactgtagtcctagctacttgggaggctgaaacaggaggctcgcttgagctcaaaggatagtcctagctactcaggaggctgcggtgagctatgatcatgctccagcctgagcaacagtgagattctgtctcttaaaaaaaaaaaaaaaaaaaaaagcccaggcacggtggctcacacctataatcccagcactttgggaggctgggacaggtagatcacctgaggtcaggagttcgagaccaacctggccaacatgaaattaccaaaaattgtctcagaagtttgacaaaattgttmatttgtgtcataaaattttgtcaaaattttttctcataagcttgacaaaatggacaatttcaaagagagtaggaggtattggaggccagctgattagcagtgggaaatcatatgggctagtaccaagtttttgccttattataagtatagagaagtgacagttcctacatgcagtttgaaataatggtgacagaatgcagggtttggaatccgagatagtgcctaaattttgagctcaggaagaaatggggaaaggaaaaagggaaacagtggtaagacaggaggatgctgaattaggttagagttgacgatagaataaccaatttaaaatgtcttatagataaaatctagaatgaagctttggtaagaagtctgagctaygtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatctgtgaatgggcgtttgaaagtgagccactatttctccagcatatgaaggatactcataagcctggagagatgccwtatgtttgccaggtattgcctttttctccagggagttttagcagttttgcyctcaggaagaatacaaagaatytactaatgaatattgttgaccacctactgcatacactcagtttaggaactctgagtaggtacagaagaaatagtaaacacagtttatcttcagggtttccatgcaggagaaaaacataaaagaacatgtccacaagtagactrgccgggaacatgtgcatattctaagggagtgtctgtctcctgaacgtgccctttggaaattgacagaaaaggctttatttttcttagttagagaacatggattattcttagactttctgtcccttcctatttttaaagtaatagctaaacctatcacaaacatagcccagcattacaaagtcaggaaaataatttgatttctatgcatttgagaaaactttttttttttaatttaaaaatttttgttgctacctttttttttaaggcctctcagttgttcacttcattcttagccttattttccctcctatgtgactcaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccaggtactaggcaccaagcaattcccatattctcttgttttttttttttttaaacatggatgctggggccagggctgagctaggcaaataatttgggcagagattataatatgcatatgtttgcagaaatttattgaattcacttaatgtgccatgtactagtctagatgctagagatttagtagtaaacaaggcaaacaatacaataaaacatgaagagtactgtgttggggaaattataggatatagaaaatcacatagctattctgggtgcctagtaaggcttccagaaagaagtgttgttcaatacctgagggatgaataagaatgagccagatgaaataagacgaagaacagtgtgcccaaggcacaaagcaaaattgtggaggttcaagaaattgagagagattcagtgtagggtgtaagagacagaggggttggaagttaggcagggacagatcatggaggatcttttaagccatgaaaagaattcactgggaagccactaaaggggttttaagccctggagtgatgtgttcagctttagttaaggctttatactgcctgcactgcagagaatggattaarggagattgagactacagttagggaaactagctagaaggcctttttcagtagtttaggtgagagatgatagtggctattggcttttgaaataaaaagagggtagagttgagagatattcagaagatttgtgatatttatgatgtagagatggattaggtgaaggtagcaatgcagtagttaagaatagtgcctaarattctgtcttgggcagttgggtgaatgagggaactatttgctgaaatagaaacaatagagaaagtatatttgtgaggggggagatcatgagcttggatattgtaagttagcagtatctgtggatgtcaagtgtagctgttggataatagatctcaagcctgtgagagaactctgggttgtagaaaagatttaggaatcagcgttatataaatcctatagattttaaacttaaataccatgggccccccaaccctgttgagaataagagaaggcttaggatatttgaagtcccttatctataaagcaaccaccatagtactaggaggaaaaccagaagagtcttaaccttaaggaaactggggagaagaaagtgttttaaagaaaagggtgtgatcaaaatgtcatatgttacaggaaggtgtcaagcaacatagagacttagaaacaggcctttaatttagcaacattgatgagagccattttgttggttggtagggtggaagtcacatttcagcagaacaaatgaatgagaggtaaggaaatgaagacgatgtatttaaagaagtttatttataaaaagggaggacccagggtaggtaaatccagaggaagaagtggcaaagaagagttttttattgcttttattttccttataagatgaaaagctatgacttcgttttaaaatactacaagaagagagccactagaggagagtgaaaggtatatagtatataagagaggattcaaaatggagaataagatgagtgcatgtgtgcttaatagtcacatacatatgcacacaaacatatgtaccctattacactcatagtctcctttgcacagtrgtgactgctgattgtctaccacaactgtatttccaaataggggcatggaaattgtctcttagcctaagcttacagagctttgttatcctactaaagaaaatcatagacatgggttctatttttgaaggacttcaatactaggcagactgaatcctcaaagtggtctcaccaggagacatatctgtatatactgatgtgttaagtgagaaaacagcaaggtatagacaagtgctatcatttgtgttaaaaggagaaaaagaagagggctgaggtgggaggatcacttgagcccaggaggtggagtccagcctgggcaacatggtgagacaacatctctacaaaaaggaaagggaaaaaagtaagggccaggcacagtgatgcacgcctgtaatcccaacactttgggaggccaaggcaggtagatcacttgaacccaggagttgaagaccagcctgggcaacatggtgacaccccgtctctacaaaaaaatacaaaaagtagccgggcgtggtggcacgtgcctgtagtcccagctacttgggacgtgcagtgagctatgaacatgccactgcactccagcctgggctacagagagagaccctgtctcaaaaaaagggggcgaggcaggtaatgattggatatgaatgtatttgtgatacagttatatgtgtagactgcccacgaaagcatactcaggaaactggtaataagttgtttgtatggaaggggactgagtgttggagttgaaagcaaagttggaagagtatagaaaaaaaagtatgactttagtttactatgtacattgtccttttttaaaaaaagaagaatgaagaatgtccagaagaatgtccagttgtcagcagtgtaaagatataatacaaataaaggttacatcactcattcaaattgttaaaacaagtcaggaaaggatgatttgagaacttagtcatcctggactagaatccatctttctttgatatcatgggaggtgatgattctcaatggtaggttttgtggtcatgttgcatatttctttcttactctcttaaattatcaacagaaaggtgggaagaatgatatggttgacattgatctgctttctcctcaaaaaagaaaatttattaggaacctttaagggattttgtctctttttttccctcccccacttcagaagagaaatgtttatcactgcaacaaatgccggctgcagtttctctttgccaaggacaaaattgaacacaagcttcaacaccataaaaccttccgtaaacccaagcagctggagggcttgaaaccaggcaccaaggtaaagagtttgccagtgtcttttataggcccagggagggaggaatagagattttcagtattctgaaatttagtgtgggtgatgtctcattgttacttcccttggttctcaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgtcagcgccttcttctaagtgctgggcgggtggggactgggtggccaggattattcctgatacacagtgcaatctggtagctttttagcagggtttgttgtctgaaaatcctacattttggggacccatgaggcagtaatgagaattctttttttttytcccccacaggagtgtcatgggccggcagacatgcctggagtgcagcttcgagatcccagacttccctaatcatttccctacttacgtacactgctctctgtgtcgctatagcacctgctgttctcgagcttatgccaaccacatgatcaagtaagttggtttttaaccagtgttttagcttgagagttcagattctttttttcttcttcttcttcttytttttttttttttttgaagacagggtctcactctgtcccctaggctggagtgcaatagcatgatcttggctcactgcaacctctgcctcctgggttcaagtgattctcctgtctcagcctcccaagtagctgggattataggtgtgcaccaccatgcctggctgatttttttgtatttttagtagagacggggtttcaccttgttggccaggctggtctcaaactcctgagctcaggtgatccacctgcctcggcctccctaaagtgctgggattacagacatgagccactgcgcccggccccagccagattcttgagcactcatttcattttctcccctgcttctaatatgtttcctccttcaactcttagagctatttgttcttctctcctagcagagtgagaggctctgttttttcggttttgatggtctgtgctctaatttcatagggccttgctattcaagtaccagtagtattaggtgggagcttgttagaaatgctgactctcagccccgccctaggcctactgaaccagaatgtgaattttaatagatcctcagtgacttgtatgcatattaaagtttaagaagcatggtgacaggaaaactggcttaggttgagattagggtgcactgaagaagtgtctcttttgttgggggcattgtcactggctggtgatctctagcttagccagcagaactccgtaactcataccacttctttgtctttctcagcaatcatgttccacggaagagccccaagtatttggctttgtttaaaaattctgtgaggtaagaaaaaacttattggcagcatcttaatttttcaggtttttacattaattttcaggtttttcattatttggagaggtggttatgtgaattaatttcagaaaaaggagaaagtgggagggcattccttttctttcttaagcctcaaagcttaatggtctcaagtgtcactgctgtgtttgtcttacatagtctcaattctcttttttagtggaatcaagctggcctgcacttcatgtacctttgttacctctgtgggcgatgctatggccaagcatttggtattcaacccctctcacagatccagcagcatcctgccacggggtaagtaggagagaaggggattagttgagcaaggggaggaaaaaagatacaggttcgtactgtatgcatcaggagcatacctacttggcctcactcattcactgttgagatgtgctggacctaattagaaaccttcygacctgaagtttatataaaactgggaaagctggtcactgcgaacagcgtatttgtatgtagtaagttgaatcccagggcactgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagactccatattgctagaggcaaaggagagtggctacagtgatgacgagatcatggagctgtggtcaactcgagtgtggcagaagcacacagcttgccagcgcagcaaaggcatgcttgtgatggactgtcatcgcactcacttgtcagaagaggtactggctatgcttagtgcctctagcactttgcctgcagtggtcccagcaggctgtagctccaaaattcagccattagatgtatgcatcaaaagaactgtcaagaacttcctgcataaaaaatggaaggaacaggctcgggaaatggcagatactgcatgtgattctgatgtcctgcttcagctggtgcttgtctggctgggtgaagtgctaggtgtcattggggactgtccagagctagttcagcgctccttcctggtggctagtgttctgcctggccccgatggcaacattaactcacctacaagaaatgctgacatgcaggaggagctaattgcctccctagaggagcaactgaagctgagtggggaacattctgaktcttccackccacgacccagatcatctcctgaagagacaattgagcctgaaagtcttcaccagctctttgagggtgaaagtgagaccgagtctttctatggctttgaagaagctgacctagatctgatggagatttgagtgttggggtcatgagggggtgtggagtgrgggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggraagaaaaytttttytacaatttgcatgagggatttttttaattgtatgtactcatggttgtaaaccaaaacgtactgtaccgtacagagaaaaggagcaaaaaaccaagtcttctgtttatcctgaggctttccacaatgttcccctcctgtgagccaaggaggcaaactgcacaagcttgtaaatggttcgtctttaaaatgtacataagtggaacatttaataaaatgaggggaaatggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccraggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactgaatgtgtggaggtttcagattgaaagctcattgtttggctttacaagtttgttgttaacggacaatgcaaatggagggatggttttattttttccttcagttctcactgaatttctgtactttgaatttgctgcctatattttctttctcaagaagtttggagaggatatgtgtcagaatcgcctacagtgttcattttaaaaattcaagctgggcatgatggctcatgccagtaatcccagcacttgggaggctgaggcaggaggttgcttgagctcagaaattcaaggctgtagtaggctatgatcatgccactgcacgccagcctgggcaacagaatgagacttttgtctctaaaatattcaggtttagaaccattccagggatggctgatgccccagctgacttgagggcaacctgatgcagaatagttctactagattatttttaaagtggtattttaatgaaaatcacagccaacattaagaaatctgtatttgataatccagtgcagtggaggaagatttgggaggggaatttgaacacaaaagccagttagcacacaaaaattaagtctggcttctacaggaagctctgcttctaatacagctccaaatgacgctagtgtgtctttctgtgttgtgcagagagaatttctgtgtgtgctgcaagaccacaagggttctccgaccagggagggagatggcacatggcagtactcagcagttttgcacttggtgtgacccagtcagacaaaaaccactcagcaagcattttgaagaatttatttactttacaaaagaagagtctatctttgaactagccaagttcaaagttaaaagtagggcaacttcagttctggataatgcatctgtatttcattcaaagccactaaaaaaggaagacagaataataaaattgtgaagcataaagggatcaattcctaaaaatagctgtactgtccaaccaaaactttccacccagaaaattttcctgggtgagcctcccagaaaagcccagcttagtgtaagccaaagacctcccaagtctgtcaccaattttttccctattactcacctgatcatgtgggcaatatcccagttggtctctgtagacaatggtccctctatttcaacacctttttcggtgacagtggcggtttgaaactggaagaaagcagagcattcaataatgcccacgccttaagtccttaaatgaaaggtcaggtggaggtcttccccaatgtgaaaataggagtcacacaagtaaggcaatctgttcttcaaagcatagagacccagggattgcaagtagccagagcccgccaattaggttcccagcacatccctcacccggttgtaagaacgggcatctcggtagtacagcactcgcatgcagcgttctactaagtcgcgggcctcggtctggcttagcactggctgcttctccagaacttctcgcagcagaggctagggagattgggggaaaaccatggggggatattgggctgaataacaggctagttgtctcaaatctatggtataaaaagcattagagtgaaagatgacattctacttcttgcctcaccagaatgaactctgcttagaaaataagctaagagccacttcaggaagaagttctagggtgtcctctctttgcatgtctactgactcccagtcatgtcatcttgtcactggaatcagtgtcaacacctacagcccccagactacaaagaaaaccatctgcccagtaatagcgatcccagcccatccctcatatcagaatttcaggagaaaagcagacaaccactaatccatttccttttgtcttccctttcccccacctctagacttactacttacctgagccaagtatgcaccataaccagtggccagcgaaggggcttcataggctacaccaagcatgtccacataaccgaggaagctaacaggacacaatgggtcaaaactcatttcaccttaggttcatcttagctgaagaaggggaccatggggtctgagttaaagtgggattcacttggggagaagagacagaagagatactacacaggtactaggttgggtggtaaaggaaataagttatttgtattcatatgaacctctctccatcagcatagcctccgatgaccatggtgttccacaaagggttcatcttcgagcgccggctgtacatggccctggtcagccatgaatgaatagctctaggactatagctgtgtccatctcccagaagctcctcatcaatccttaaaaggaattggttgtgagaaaagggagagaattaagtcggggtctccacccatccccaaaagaagttaccacaccttcccccattttacacctaatgccaaaaactttattgcaaacacagatcgcccacctccaacaactctcccagtcccccgctgcaacaagtccccccatcccatcgaagggaataaaaaacaggggactcccctctctacttgggaaccactctcctgttctctggatgacttacaccatctggccgagaacttgcttcaaatactggaaatcagcgtagtcgccagaggcacccagcatggtactgttgttgactcgcataatgcgagagatgttgcggaaacgagccaaggagccgtaggatcccagcatgtctgcggcaatcaccactccgccctcgaacttaacgccgaggactgaggtcccggtcaccatggggttcctaaagagtgagaacggtgggagctgagaggggggatggactgcgccctctttccgcgcactgagctgcgcttctgattttctataattccttccaattattctgcattctccaggactccgcgccctgagctcccctgccgttcgcgcgcccccggggtccccgcctcaccttcccgggctctcaaaaccagccggcagcaccaggccccacggtccctcccgctacgcaaacgaaagcgccgagaacttactgggtccgcgtgattggacctctgtaaagtgcagacgccggatccatgaaggaatcgggagtggacggaatgcggtaaaactgtcctggggccggaccccccgcccaaagtccggaccgcgaccccaaaaacgcttccatcttagtcacggtagcagaaaaaatgaaagcgcttgcgccaacggaagcggaagtgatccttcagtgtcatttctttctttttcctgtagacgacttccagcagccatgttgatgaggtcgtagctgaacatgcagtaatcctaggtggcgaccgagacagggagttgaaattgcccaacatcgcttcgcatcgcatcgcatctccgtggagtttggaccagatcacagcgttctaacacacgattcaaggaggagggaggcatgaaggtggggtggggaggtggccacttaaagacgctgatcctgagtgagacgtcacaattttttattttattttttttttttttgagacggagtctcgctctggcccccaggctggaatgcagtggcgcgatctcggctcactgcaacctccgcctcccagattcaagcgattctcgtgccttagcctcccgagtagctgggattacaggcgcctgccaccacgcctggctaattttttgtatttttgctagagatggggtttcaccatgttggccaggctggtctcgaactccggatctcaggtgatccgcctgcctcggactcccaaagtgctgggattacaggagtaagccgcctcgcccggcctagaagtcacagttctcatgttccttttgtatcattatcaaaaagcccacatgaaaatatcagtgaacacaggatctcttacatctgtactcctcagagcagccccatgtggcaggcattattcgacccatttggtaaataggaaaccgaggcttgcggtgtagtgatttacccagtcacacagccgataacggtagaactgaatcttgaagctagaataaaaaaaggaatcagggccgggtgcggtggctcatgcctgtaatcccagaactttgggaggccaagacgggaggatcacttgaacccaggaattcaagaccagccttggcaacatggtgagacctcacctctacaaaacaaaacaaaacaaaaaattagccaggcctgtaattccagctacttgggagggtgaggtgggagaatcgcctgaacccgagggaggttgcagtgagccaaggtggcgccactgcactccagcctgggcaacagagcgagaccctgtcacaaaaaaaaaaaaaaaaaaaaagaatacacttgtgtataccctgtggggtgtgatagctcaggtggatcaagcactctctgtgggaccttagacaagtctgaaagtttccttattgtcaagggcccttgcccacctctaaagaaacagaaaaattccattggaagtgtaggggtgaaactaaattccaggggtttccttctcagtgtaactccatagcaggggctggaaactgtcttgaatcaaactggtgaattttgtcaaagataaacaaagccggacactaaagtggaaaggacagatttcaatcagtaataactactacaataaggaaaaacagttcagcatgaactgaactcaactgcaatttgtatgcaagtaatgggtattttatagggaaaatgaggttaggggacagtgagacagagggtcagtagagtcagggaagtgaacatttacagaattagtcaatgtaaatgtgcttaggtcaatgatgtctgctagctggcatttatggaagttaggattccatcctcccacagagactggtgaggataccatcctcaacactgtccttaggtgtcttttgtttgtttgttttttgagacaaggtctggctctgtcacccaggctggagtgcagtggcatgatctcggctcactgcgacccttgcctccccggctccagcgatcctccagctgcaacctctcgagtagctggggactacagatgccacacccggctaatttttgtttttgttttttttctttttttcttattttgagagggagtcttgctctgttgcacaggctggagtgcagtggcacgatctcaactcaaagcagcctccgcctccctggttcaagcgattctccagcctcagcctcctcagtagctgggattacaggggtgcacaaccatgcccagctaatttttttttgttgttgttgttgtatttttagtagagatggggtttcatcacactggccaggttggtctcaaactcctgacctcaggtaatcctctcaccccagcctcccaaagtgatggaattacaggcgtgagacaccacgaccggcctaatttttgtatttttttgtagagaccaggagagatctcaccatgttgcccaggctagtttcaaactcctgagctcaagaaatctgcccacctcaggccgggcgcggtggctcatgcctgtaatcccaggactttgggagacttagatgggcggatcacctgaggtcaggaattcaagaccagcatggccaacgtgatgaaaccccatctctacaaaaaatacaaaaattagccgggtgtggtggcacacgcctgtaatcccaggtacttgggaggttgaggcaggagatttgtttgaacccaggagacagaggttgcagtgagccaagattgcaccactgcactccagcctgagtgacagaactaacgaaacgctgtctcaaaaaaaggaaagaaaagaaaggaaagaaggaaaggaaaggaaggaaggaaagaaagaaaggaaagagagacagacagaaagaaaaagaaaggaagaaagaaaggaagggaaaggaaaggaaggaaaaggaaaggaaggaagagaagagagagagggagggagggaaaggaaaggaaggaaaggaagaacgaaagagagagaaagctgcccacccaaagtgctgggattacaggcgtgagccactgcccctggcctattctcaggtattggctgga

SEQ ID NO: 12494 - DNA, 14863 bp, Homo sapiens
ttacacaaaagtaaagataatagaataataaattcctatatatttgttacttagattcaatacttattgatattttcatgttttattcctttttatcttgtatacatagtatatcaacaaagctagtttacttaaacaaaactacactgtgttcatatactgtatatacaagatttattttccagatgtaataggaaaaaaaaaaaaaactaaattatttgcccaagaaatgcccacctattcaatatagttcatatgtatatatatctaggcttaatttacaaatgaaaacttgtttgctactataaatcagagtgttaaaattagacttatttatatacctcactgaatctcaattaactaagttcacaggtcagtttcaaaatcatcatttgtttaagatacattcattcattcccccattatgaagttgggactgtgcacagaataggtaaggcatattttatatacacatataaattaaatgtcattaagtggaaaaatctaaaatcaaattttaagacaataattttatgaacatcatagagataaattctttagctgttaaactgcaattcacaaaatttgcataacaatacccttcccagccttaactgatccctttattgtatattcactcaggagattctaggaaattcagtggaaagcaaccgctggaaactgaacaaggtgagaagagttttcaggtgctaccaaccataaagtaaagagaattcagactttaagttaactacattagaaatgtttgatgaatacctggagttttccactaatctgtcctaacaaagtatgaaagtaaactttcatgacttcatggtgatcactcagcaagtttattactaattagaaccaattcaaactcttcagaggaacataacagaaaccagtgtctgcattgtattctccgaaatgtcctgtagagatgataaattacagtagtcctcacctcatctgtagttttgctgtctgaggtttcagttatcatggttaaccacagttcgaaaatattaaatggaaaactccagaaataaataattgaaaagttttaatttgcatgtcattttgaatagtgtggtgaaatctcgggccatcttgctctgtcgcaccagggatatgaatcatccccttgtccagcatatctatgctgtatagacactaccctcctgttagtcacttagtcccatcacaggtatcagatagaaaaaacatagtatatataggtttggtactatctgtgatttcaggtatcaactggggttcctggaacatatcctctgtgaataaaggaggactactgtattagatatacaggaaagaaacaggaaaatgttgaccttattaaaaaaagaagttgataaaagcagatcctgaggtgacccagatattgaaattagcatacaaggaagtcaacgtaagttctgtaaatatgtccgagaatataaaggaaacaatgtttataatgagtgaaggtatggagtatttcagagaaatggaagctgtaaggaacataagaactccagaaagctgaaaagtaaaatacctcaatttaataattcactggatatgcttaacatcaggtagagatgataggaggaagagtagtcaacctaatgactacttttgtagtcatctggccataggccaggatttggtctacaggccaaagttttctcaaacatgatactattgttaaaagtaaatataatgagaatttatttatttatttatttgtatttatttttgagatagggtctcgctctcttgcccaggctgaagtgcactggtgcaagcttgacccactgcaacctcacttcctgggttcaagctattctcctgcctcagtctcctgagtaggtgatattacaggtgcctgccaccatgcctggctaaattttgtatttttaatagagacagggtttcaccatgttggccaggttggtcttaaactcctgaccgcaagcgacttgcctgcttcggccttccaaagtactgggattcctggggtgaaccactgtgcccggcctaatgagaatattttaaaatcagctagtaaattaaagatacattatatgtagaccaaagtataatgacagatgaatggaaatgatccaatctaaagaacggagaaagaaaaaaaattacttagcactgcctcagatacaatgaacgccctagcacacatgcagctggagtcctagaaagagaaggaaaaacactggtcaaaaaacaggttttaaacaaaagcctaaaaaaaataagtaaaaataaaaaaaatagcctaaaatttcctaaatgtggaataaaatctcaatttatagttcctagaagctttgtgaatcaagcaaggtaagcttgaaagccaaacatagacacatcatagtttatttaactctgaggttggaaaacttttctgtaaagggccagatagtaaaataagccatataaagactctcttcattcttcctcctcttcttcccccccctcctagttctcttcattctccccttcttctacttctccttttaacaaacctttacaaatgtaaaaacatcctttgcttacagatcatacaaatataggccatgagtcagatttggtctacgggccaaagttttatcatacatggtataagtgtcaaaaggcagatataaaaaaatttttgaaatcatctagtgaattaaagatatatatatatagaacaaagaaacaaataatggctatgttgtcataaggatgaatgaaatccagaaaataatggtgccacatctttaaagtgctaaacaaagaagaaaacacacacctctgtaactatgtggaaaatatccttcaataatgaaagtagattaaagacattttcagataaagggaagttgagaaaatttgtcaccagcagctctgcactaccaaaaaaaaaatgttaaaggaaatttttcaagcaggagggcaatatatataagctagaaccacagagtatggaaaatgggaaaggtatggttaatgtaaatttttttccttcttttcatttctttaagattgttttcatagttttgtgacttcaaacaaaaatgacaacattgtattgctggcttacaaattatgtgcaatatatgaaaacaatagtccaaaagataggactatatcactatatcatgagcttaaaatactaccatctcacactggtcagaacggctattactgaaagtcaaaaataacagatactggtgaggttgcagagaaagggaacacttatacactgctggtgggaaagtaaattagttcagacactgtgggaagccgttgggagatttctcaaaaaacttaaaacagaactagcactcaactcagcaatcccattactgcgtatatgcccaaaggaatatatatcattctatcataaagccacatgcatgcctatgttcattgcagccctattcacaataacaaagacatggaatcaacctaggtaccatcattggtggactgaataaagaaaatgtagtacatatacaccatggaatactacacagccataaaaaagaataaaatcatgtcctttgaagcaacatggatggagcagaaggccattatcctaagtgaattaatgcaagaatagaaaaccagatactgcatgttctctcttatgagtggagctaaacattgagtacacatggacacaaagaaggcaacaatagacaccagggcctgcttgaaaagggtgggaggggggtgaagattgaaaattttattatgcttattatctgggtgacaaaataatctgtacaccaaatcccatgacacataatttacccatgtactacctgaacctaaaataaaagttggaatggaaaattatacaaagaggtactgctaaaaagataataaaggaaataaaatggaatactgaaaaatatttgtttaacataaaagtagacagaaaaggaagaatgggaacaaaaattttgtgacacaaatgggaaacaaatagcaaaacccaatcatattattaactatattaaatttagggactaaacacacagtaattgtcaggataaaaaatccatctattttactctttataagaaatcttttaaatgaaaataaagataggttgaaagttaaacaaaatcagaaaaaacataccatacagagtaagcatatgaaaactgctgtggcaatgttaataaaaaataaagtagactttaggacaaaaagtgatatctgagattaagtggagatcttcacagttatcaaaatattaatttataagatataaaaatctaaagattcaaaatattctaaatatgtatgtgcctcataacagtgcttcaaagaacaggaagaaatactgaaaaaaatgaaagaaaggtaggaatccataatcgcagattggaaaaatccacatttatttgtttgccaagagagaccatgcactgagccataagttaaatttcaataaacttctaaagtttgacatcttagagagtatgttctcagatcataaacatccagtgtagaaatcaaaaatataatatttaataaagctcaaatatttggaaattaacaaaaaataaatcacaagagaaattagaaattatgttaaataaatgacaatgaacataaagcattcctgaattcatgagaaacagctaaagaactgctagaaggaaatctatatttaaaagtttatatgataaaagaagaaaggtgtaaaatcataatttaactttccaaattgataggtagaaaaagaaaatgaaatttaaaaccaaaacaggtcaaatgaataatataataaatagaacagaatcaataaaaacacaaaaaataaaaaggcagaagtttttttggaaaagattaggaaaattgataaacccctaacataagtgatcaataaaaggagaaaagcacaacttaatcattttaaaaattacacaggggatatctatatagatgctatagacttcaagaagataataaggcaatttttaaaactgccaattgccaatgatttgacaatttagatgaattgaacaaattacttgaaaaatacaatatatcaaaaattgaccctccctaaagatattaatacaaaacctatctaaccctatgtctaataaaaaatagccaatacaatgcacgaagaaaactagagactcagatagtttcactaggaaattttatcaagcattttaaagagaattaattttaatctgaagttactttagaaaacagaagaggaagtgcatttccccgatcatttgttgatgccagtataccccaataaaaaacctgacaaaaacattataagaaaataaaattatagaccaatatattttatgagaggatgtcaaaattcttaaccaaacattagtcaattgaatcatccaatatataaaaatgataatatatcataaccaaatggagattaattcacaaatgcaaagctgccttcatattttaaaattcaatttgcataaattgtccccgttaacagaataaaggagaaaatccttatgttcatttcagtaggtttcgaaaagcatatgacaaaatgcaaaaccattttgttataaaaactctctgcaacttaggaatagtaggggacctactgaatctgataaagggtgtccataaaaaaatatgcagttcacatcatactccatagtgaaatattaggtttccctttaaaattcagaacaaagtgaagatgtcagctctcgccatttttagttaaccttggcataaagattgcaaaggaagaagtaagcctgaatgtacttgcaggtaaaatgattgtttatgtgtacgtttctaaagcatgtagtttaaaactactagaattaataaagaaattaagcatggtgggtgctcccgaatcgatgaggaaagccgctctccccggcagatcctcccggccggggcgcctccatcaccctgcctgcgcctcggcacgctggcaaggagcccgggaagagacgccgggagcgacttatgaaaatatgcatcagtttaatactgtcttggaattcatgagatggaagcataggtcaaagctgtttggagaaaatcggaagtacagttttatctagccacatcttggaggagtcgtaagaaagcagtgggagttgaagtcattgtcaagtgcttgcgatcttttacaagaaaatctcactgaatgacagtcatttaaattggtgaagtagcaagaccaattactaaaggtgacagtacacaggaaacattacaattgaacaatgactcagctatacatttacatcagattattgggagcctatttgttcatcatttctcgtgttcaaggacagaatctggatagtatgctccacggcactgggatgaaatcagactccgaccagaaaaagtcagaaaatggagtaaccttagcaccagaggataccttgccttttttcaagtgctattgctgagggcactgcccagatgatgctattaataacacatgcataactaatggacgttgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacatgccccctgttgtcataggtccrttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggaaaatcactaaaagaccttattgaccagtcacaaagttctggtagtgggtctggactacctttattggttcagcgaactattgccaaacagattcagatggtccggcaagttggtaaaggccgatatggagaagtacggatgggcaaatggcatggcgaaagagtggcggtgaaagtattctttaccactgaagaagccagctggtttcgagaaacagaaatctaccaaactgtgctaatgcgccatgaaaacatacttggtttcatagcggcagatattaaaggtacaggttcctggactcagctctatttgattactgattaccatgaaaatggatctctctatgacttcctgaaatgtgctacgctggacaccagagccctgcttaaattggcttattcagctgcctgtggtctgtgccacctgcacacagaaayktatggcacccaaggaaagcccgcaattgctcatcgagacctaaagagcaaaaacatcctcatcaagaaaaatgggagttgctgcattgctgayctgggccttgctgttaaattcaacagtgacacaaatgaagttgatgtgcccttgaataccagggtgggcaccaaacgctacctggctccagaagtgctggacgaaagcctgaacaaaaaccacttccagccctacatcatggctgatatctacagcttcggcctaatcatttgggagatggctcgtcgttgtatcacaggagggatcgtggaagactaccaattgccatattataacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcccccagactcacagcgttgagaattaagaagacgcttgccaagatggttgaatcccaagatgtaaaaatctgacggttaaaccatcggaggagaaactctagactgcaagaactgtttttacccatggcatgggtggaattagagtggaataaggatgttaacttggttctcagactctctcttcactacgtgttcacaggctgctaatattaaacctttcagtactcttattaggatacaagctgggaacttctaaacacttcattctttatatatggacaactttattttaaatgtggtttttgatgcctttttttaaatgggtttttatgaactgcatcaagacttcaatcctgattagtgtctccagtcaagctctgggtactgaattgcctgttcataaaacggtgctttctgtgaaagccttaagaagataaatgagtgcagcagagttggagaaatagactttgccttttacctgagacattcagttcgtttgtattccacctttgtaaaacagcctatagatgatgatgtgtttgggatactgcttagtttatgatagtttgtcctgtctccttagtgatgtgtgtgtgtctccatgcacatgcacgccaggattcctctgttgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgttgttattatttttgtcacggaaaacatcctctcctaagttggagcttctattgccatgaaccatgcttacagagaaagcacttcttattgaagtgaattcctgcatttgatagcaatgtaagtgcctataaccatgttctgtattctttattctcagtaacttttaaaagggaagttatttaaaaaaaaaaaaagaaattaaggatggctatagggcataaagtcaatattcaaaattctttaacaattacattaaataattggaaaattatttaaaaattttttttacagtcatgcaaagcaaaattctaaagattaatttaacaaaagacatgcaagatctctgtactggaacactgacatgaataaagaagatagaaataaatggagagatatgctatgttcattggttaaatgattcaatattattatgatgttattttcctcaatacttgtttgcttttaaagtttaatttcctttttgacaaaattgtatatatttatcatgtgtgacatgatattttgaatatcattgtatatatatattatatatatacaaattgtgaaatggttatatcaagctaattaacatattacctaacataattatcaatttttttggtgagaacacttaaaatctactctcagcattttttaagagtaaatacattgttattaactacagtcaccatgctgtacaataaatatcttcaatgtattcctactatctaactgaaattttatattctttgaccaacatctcctcaagctccattttccatatttgtatatagagtctaagcaataatcctaatattttctgtaattgacaagttgattctaaaattgtatagaaacacacacaaaaaagcccctactatagacaatcttgaaaataaaaaataaagttggtacattatattacctaaattctagacttactaaagcaatgaagatagtatggtattagcacgcagagggaaaaatagatgctaggaaaaatagataactgaggttctagaaattgatccatgtaatatgatcaattgatttttcaacaaatggtgctagaacttcaggttaaccatataaatctggttacttattcacaccacacacaaacatttacttgatatgggtaatagctctataagttaaaattttggtttttaggataaaaaaatatttagactttgaacatctacttcataagagaagatacaggaatggtcaataagcccttacgattaaaattaaatccataatcagatgccatttcacacccactagatgactaaaatccaaaaagatagtcaacatcaaatattagagatgatatagaatgactgaaactcatataactttttggtgaacattttatacattattactaatttggcaaaatgttgacggtttcttataaagttaagcatctacctatcctatgaaaaaagctttctattcctaagtatttacacaaggtaaataaaaatatgactataaaataactagtataaaattatttgtaggagctaagctaaaactggaaatgatcctaatttctatcaacaggagaatggatttaaaattttgatatgttcgtgcagagaaatactactcagcaatttctttcaaaagaaaaagaactactgatgcacaaacaacatggataaatcttaacatattatgtcgagtgaaaaaagactcactagtatgtactgtatgatttcatttttatgaaattctctaagaggcacaactaatttacgttctaaaaatcagaacagagtttgcctaggggtccactccttgactggaaggagccatgataaaactttctggagtgatggaaaagttttatcttacatcctcaaagatttaggtcagtttcaactacgaaatgttcctacttaccttttaatttgaagttcaactgtttacagaagctttcaaaattattatttttttgtataaaacatttttgtatgaaaaagcaaaaaaataactctttatgaaagaaaaagcatactttacccctttgggtctgaagaagccatcagtacatgtctcgcagtttataccagcagtgttttgggtacaattaatgcagacaccccctccaatgtactttccacgtatattcaaactcagatttcttctggcaacattttcatcataatagcattcttcagcttttccatgacaattgcatgctgcattaaggaaaaataaattaataaacatcaatttgatttcagatacatttaaaaatcatttctgttatacataatagattttttttttgagacagagtctcactctgtcgcccaggctggagtgcagagtggcacgatctcggctcactgcaacctctgccttccaggttcaagcaatcctcctgtctcagcctcccgagtagctggggacaacaggcatgcaccaccacacccagctaatttctgtatttttagtagagatggggcttcaccatgttggccaggctggtcttgaactcttgacccatgatccacccgcctcagcctctcaaagtgctggaattacaggcgtgagccactgcccccggcctagacttttataccatacgggaaattacatttagcgtacacacacacaaacatatccagaaagtatctggatgtattggaggtattaataaattcacacattttaatagaatttgaaatgattaaaacatataaattaagctcaatcatatgcaattgccaatatttggttttgactaacgtgcaattttatatggttcaacttacaatttcctattataacaaataataaattattcaatgatggcactgaatgattaacagctaggtaatctgtaatgaattactaccatatggaaatttctgtattagagcctgtgggtaaagaaaagtatgtataatataattcctttcttttaatactaataacaactaaaacataggttttctcaatgccagacactgttctaaatgctccatatttgttgctactgattttaatcctcaaaaatgcttttaggaattaggtattattattattaacctatttttgtatactagaaacctgagtccagagaagtgaaataacgtgtaaaagatattctaatcagtattggaaaccaacctctgaagccagactccagagtctgcactgctaaagactgccagaatctcttcacatcctacccggtgaatgaaataagatacatggcaggtgccaaggaattaagacaaaccgagagctagtttactggtggctaagatcatgctattttgcaaccaactgtcttggatgtgggtgtgctctcctctacttagcagtcatatgacattggaaacttcttaatttcacgaaggctcagtttccatataatacatggagtggtcaatagtaattactagattgggatatttaaaagcacaagtgagataatgcatgtgaaatcattagcgtaatgtcttataaagaagttagcaattgatttttcttcttttcttcctccttgtctttttcatgttacattagaagaattccaagaagtgaaaaatcactttctccagaaaggattgggtaagactcttctaaatatgaagaatttatattaggatagaaccagggaaatatatcgatgcagtctccttcctacctgacatgttgagtttcttaggagtacttacatttatttccacgtgtgtgtgtgtgtgtgtaggtgtgcttgtatgcatacagctcaatctttttatttattctacaaaagggaaggggcatttgtatactgtttagaaccggttctttttactaacagtaaatcatggagccctttccatattagcatgtgtatcccctaagggtacacagggtactacttgaatgaaggtatttatcaggtccctattaatgaacagttacacagtttccatgtttctccctttacaaataacaccacacacatactgggaggacaaggatgccgggtggagggaggcgctctaatgttagaaaagtttcctatttgccagttgagtgactttgaggcaaaaactcgagtcctagcatcactttagtacttgtctcatacatgttttgagaatgcttagcagaatgcctgaaacatactaaatactgagctcaataaatgttagtagcagtagtggtagcacttgtataataatgacgaggatcatgataatatgcctgtacatctatatgaatatatctatagggtaaattcctggaagcataatttctagtcaaaggatatgtaaaatttaaattttaatcgcttaaaaaattcccctccaggaacgctatgacaaatgacttttcctctagtagatatgataaaacactttctccatagccaccaaccttgtgtgttatcaacccttgaatacaattcctggacataataagcattcaaatatttgttgagtagaagaataaacactttgataggtgaaaaataatatgtcattgttttaattgatacttccttcattatgagtgtcattatctttttacaaagttatatgtcatttctgaggaatacctgttttgatctttctaacaggttaacttttttcttattgatatgtaagatctcttaatatagaaaggttattatccccttgtcatgtttgttgtaaatacctttcccaacctgctgacatttgatttagaatatagtagttttgctatgttaatggagagtttcaaactttagggaacacatagtaatcaatacaaatcactaggcattgtaagcagttttatatctttagggcaacatacaagaattccttttttttcttcagaaagacagtgatatggtttggctctgtgtccccacccaaatctcatttgaaattgtaatctccacgtatggagggagggaggagactggatcaagggggcagctcccccatgctgtcctcatgatagtgagtgagttcgtacaagatctgatggttttataaggggctcttccccattcactttctcctctctctcctgtaccatgtaagatgtgcctgctccctcttcccctttgatcataagtttcctgaggcctcctagccatgcagaagggtgagtcaactaaacctctttcctttataaattacccagtctcgggtagtatctttacagcagtgtgaaaacggagtgatacagacagggtctcactatgtggcccaggctggcctcaaactcctgggctcaagagatcctcccaccatagcttctttccagtagctgggattataggagcatgccactggacctggctatgaattcttaaaagctttgttgtaatagtgtatttcaaaaaacagtcaaaacttctgctgccagtataagcagaggaaaacataaagtaacatagacttattctcacactatttagaattcgtgttgtcaagagtgtttagaactatgagctactatatgtaaaaccctgatgccaaataaacggtccatcacacactctgtgcagccaggaccctacacctacagccccactttctgtctgtaggctgcagcctaccccgctctgtctgtaaccttcaagaatatggctagtaactgatcacaaagccatgttttttctctatcatcagcaacttactatttcacagaatgtccaagatatatcatatgaaactgttgtttagtaaaggctcagcaactgaatgaatattctatgctttttagagatattatcttgccttatgtaagctagattgatgaaaatccaaattaaactcaaatgaattagaatgtgattattcattttatggagggatttgtcatgtcatggaaggatttttctaaatattaaggtgattggaatatgattcaacttggaaaagaaaatttttacttaagctttcaggaatgtactcattgctgaaagtgtgatttttatgtatggctttatggctaagatccccatcttgaatttctgcgtttttaaaatgtttgtttttcagtttggaaatacgacctcccctcttccctacagggaaagaaaaaaagtgtttcacaattccactattttaaaaatgtgtacagtagcagtttgaaatgtcttgccttgcttagtctacctctattgctaacaagttgctcgattgtttttgttttgtatttaaacgtag

SEQ ID NO: 12495 - DNA, 62954 bp, Homo sapiens
ataaagaccttactggcctggcgcggtggctcatgcctgtaatcccagcactttgggaggctgaggtgggtggatcacctgaggtcgggagtttgaaaccagcctgaccaacatggagaaacctcgtctctactaaaaatgcaaaattagccgggcctggtggtgcgcacctgtaatctcagctattcgggaggctgaggcaggagaatcacttgaactgggaggtggaggttacagtgagccaagattgcgccattgcactccagcctgaataacaagagtgaaacttcgtctaaaacaaacaaaaacaaacaaacaaaaaaaacctagctgataaaatagcctgcagtaaagaagccagccaaaaccaagatggagacaagagtggcctctggttgtcctcactgctgtactcctaccggtgccatgacagtttacaaatgccatggcaacatcaggaagttaccctatatggtctaaaaaggggaggcataaataatccaccccttgattagcgtatcatcaagaaataactggccaggcgcggtggctcatgcctgtaatcccaatactttgggaggctttggtggatagatcatttgaggtcaggagtttgagaccagcctggccaacatgataagacccccgtctctaatactaaaaatacaaaaattagccaggcgtggtggcacgcacctgtaatcccagctacttgggaggctgaggtaggagaatcgcttgaacctggaaggcagaggttgcagtgagctgcaatcgcgccactgcactctagcctgggcgacagagtaagacttcgtctcaaaaggaaataaccattaaaatgggcggccaggcgctgtggctcacacctgtaatcccagcattttgggaggccaaggtgggcggatcacgaggtcaggagatcaagaccatcctggctaacatggtgaaaccccatctctactaaaaatacaaaaaaaattagccaggtgtggtggcaggcgcctgtagtcccagctactcgggaggctgaggcaggagaatggcatgaacctgggaggcggagcttgcagtgagccacgatggcgccactgcactccagcctgggcgacagaacgagactctgtctaaaaaaaagggcaaccagcagccctgggggctgctctgtctatggagtagccattctttagtcctttactttcctaataaacttactttcagtttactgtatggactggccctgaattctttcttgcgtgagatccaagaaccctctcttggggtctggattgggacccctttcccgtaacagtgtcagaggtgtttgaaccagaggaaccccgacttgaataggggctgggtaaaataagactaagacctactgcactgcattcccagatggttaaagcattcttagtcacaggatgagataggaggtcagcacaacatacgggtcataaagaccttgctgataaaacaggttgcagtaaagaagccggccaaaatctacccaaatcaaaatgacctctggtggtcctcactgctacactcccaccagcgccaagacagtttagaaatgccatggcaacgtcaggaagttaccctctatggtctaaaaagaggaggcatgaataatccaccccttgtttagcatatcatcaagaaataaatcataaaaatggggaataagcggccctcggggctgctctgtctgtggagtagccattctttgttcctttattttccttataaacttgctttcactttacagactctccctgaattctttcttgcgtgaaatccaaaaaccctctctggggggtctggatcgggacccatttcctgtaacactgggaggctttggtaagaaacggactgtccagacatctggtggccacagagtgttcagtctgccttcgctgctcttcctggctgggagccacaaatcttccatgctttactttctaaataccactcccttccacccaccgctctctacttccactgctcccatcctggtctaagccaccatcgtcctttgcctaaatgatgaaacagcctccctccaccctccctggctccgctccaatcactttcctgcagagcagccagagtgatcactttcaaatgcaaacctgaacttgcagctcctccgctcaaagcccttggatggtttccaccagcgtgaatgctaaagcctgaactcagtgcataaggtgctgtgtgttccgctcctctggctgctccgggattatcttgtactctctttcttcccctccctctctgcagcctgggaaactcgtcttaaaaaaaaaaaaactcttgaaatgtaccatgctgtctcccacctcaaaaatcacagctgttcgtgatttttctcatgatgaatgcctacgcattcttcagatctcagctagaatgccacctcctctgggaagcctccctcatctcctgcaagactgggttaagtttccctaggtaacaggtggtattttccaaaaatagccacaacatatttcctgtcccacatgatactcttggccatttgccctcctcttgaatttaggaaaaactttgtaacagcctgtatggaaagaatgcaatggaaatgattctgcgtgacttccgagtctgggtgagaaaaggtaatatgggagctgggtgcagtgatgcatgcctgtagtcccagctactcaacagattgacgtgggaggatcctttgagtccaggagtttgaggccagcctgggccagcctgagaccctgagtcccaccccaacccctgccatctccggaagaagaagaaggagaaggagaagaggaagaagaagaggaagaggaagaagaaaaagaaaagatgatatgattcccacctggctcacacgctcacttgttcttagaacggtagttgtgaagaagctcaggctgcaaggagaccacatgtaggtattccaagcaacggccccagcgagggtctcggcctgtagcctgtagcaactgacatacatatgtgtgagcaaacattcaggtgattccagcccccagactttgagccacccagctgatgccaaggttgagttattcctcccaagcctgcccaaattgcagattgaagagtaaaatgaatgtctcttttctttctttttttttttttttcaagacagggtcttgctcttgctctgttccccaggctggagtgcagtggcgcaatctcagctcattgcaacctccaccttctgggttcaagcgatactcatgcctcaacctcccaagtagctgggattacaggtgtgtgccaccacacctggctaattattgtatttttagtagagatgggatttcaccatcttgtccaggctggtcttgaactcctggcctcatgtgatccacccacctctgcctcccaaagtgctgggattacagccatgagccacttgccccgtgaatgttgttgtcatttgaagcttctaagtcttgagctgctttttattttcttttacagaaagcccagaccttacaatgtttttattttttctctccatttttctttctttttaatgtttttgtacagatgggatcttgctatgttgcctgggctggtctcaaactcctggcctcaatgcatgcccccaccttggcctcccaaagtgctgggattgtcaagggctcatttgttacacagtcatagcaacagaaatttaggaactgttacatgtataccttctctttaaagtatttgttacatgtgaaactttacatttgtgtgattactagattcctgtctatcctgagagactaaaagctcttaacggccaaatttgcgttcctttttaccattctattcctgacacttagcaaggtgcctggtaaatgatgcactcgatgccaatttactctcaactttcctgcacctcttcacttataaaaagagaaagcacttggtcattaattgaacgttcacttatttgatgaatgctgactgagagactgtgtcagggatttgtattagagacggacacaaaacaaatatgaaatacaagggactgaggggagacatagaaggggactgggaacacttcctgagggaaagggatatttgggctgcgtttagaaggatgtataggtgttttctgaataacaaagaggcatgacagtacttctggcaaaggaaatggtgagtgccaatgcttgggaccaggaagcagccaggttggtcaggcaattgtgtgaagttctgcacagaggcaggcagtttgcttggaaaatcctgcaggaaaaggttcctaaggaccaattctgacagcctgcaatgtaggtgcttagatttcatctcattagaaataggaagaccttggaggtttggaaggagtggtggaaaaagtggagttttttgtttttctgtttttttttttttaagagatgagatgctctttaaaaaaaaaaaaaaaaaaaagcactgctatgcttcccaggctggggtgtgcagtggcaagatcatggctcactgcagccttgaactcttgggcatgagcaatcctgcctcagcctcccgagtagctgggactaaacgtgtgcaccaccacgcccagctaattttttcattttattttattatttaattaattaattaattaattttttgagacagagtttttgctcttgttgcccaggctggagtgcaatggcgtgatcttggctcactgcaacctccgcctcccgggttcaagcaattctcttgcctcagcctcccgagtagctgggattacaggcatgcgccacaaagcccggctaattttgtatttttagtagagacggggtttctccatgttggtcaggctaatctccaactccagacctcaggtgatctgcccgcctcggcgtcccaaagtgctgggattacaggcgtgagccacggcgcccagccaattttttcattttctttttctttttttcaaggcccggctaattttttgtatttttagtagagacggggttgcaccgtgttagccaggatggtctctatctcctgacctcgtgatccgtccgcctcggcctcccaaagtgctgggattacaggcgtgagccaccatccccagcctagagttcttgatagtatcagggctgagaaagtaccagagttagagccaggtggggtggcactaaaagtacaaaaaattagcagggcgcagtggcgggcgcctgtagtcccagctactcaggaggctgaggcaggagaatggtgtgaactcgggaggcggagcttgcagtgagcggagatcgcgccactgcactccagcctgggcgacagagcgagactctgtctcaaaaaaaaaaaaaaaaaaaaaaaaaaaaagaaagtaccagagttaggaggctcctaaactggtccagatgggaagtgacggggccaaggatagggaagtgaagatgggaggagtaggactaacttaaaggccatttagcaaaaattcaccacgcaaggccctatattagggcgctgggggctcatacctcatcgtcccgtcaactctataaagcaggggccaacaaactttttccataaaaggccagatcgtaaatacttcagggtctgcagatctgtaggatctttagcaactacctactctgttgtaaggcgaaagcaggcagagaagccaggtaaacgcgtgggcgtgtctgtgtgctaataaaactttattcagggaccctcaaatgtgaatttcacaaacttttcacaggtcatagactattcttctttggatttttcccccggctatgtaaacatgtaaaaataattctgagcttgcggggccggacaaagtaggcggcgggtcttggctcgcctacccctgctatataaatcattaattatgataccaatcttaaggagaaggtcttcagaagagtccctcaaagagcaccgcccctcaacgtcatcaaaccccgcctccaaaggcggaggctgcgcatgcgcggcaggacctcgggcgggggcggggcggggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtgagtggcgtccccgccctccctcggggaacccatcttctggaccccgcgggcgggcgcccctcacccaggccccgcccggccccagccccacctcggcctcccctctgcactgccccggacccctcacccctcacctctcacctcggccctccgaaagcccagcccatccccttcccctcagggaccccggcccctcgtcccctcgttccgcggccagggcccaccgggaccctccccctctctgcaggtagaagacgccctcacctatctggaccaggtgaagatccgctttggcagcgaccctgccacctacaacggcttcctggagatcatgaaggagttcaaaagccagaggtaccagcggggcccctctccacctcaggggacccccctgggccggaatcgggcctagcggggtgagacctcccctctccagcctgcccccttagccgggtgaccttgcgcaggttgtccaatctctcagagccctagctccttctcgtaacaaaaatggaaatgggtagtacccaccttgtggagctttgtggggattcctggaagcaggacagggatctggggggaggcagggagggcgaggccgtgcacactcatagagtcaaatcctgccttgatttaatatgttgatttttatattagttttgttcatgaaagatttggtgggacccattttgatttttattttcaagcgctgtaaaatgttattgtcttgatgattgaaatttttggcaccctcttcccctttaatcttgtcctcaagatgcttctctgggctcactgtggtcccaggcctgcttggaagtaagacgcataaaatgcttagtaagggagctggcacacagaaaacgtttaaaacacatgagatgattttgcaggcccagaatcaaggaagattacagatagatgggaaaccctgggatcatgcccttgtttttataggagactcactgagrtttggagtgggtaagggacccacctaagtggcagaggtgtcactagaactcagaccctctgactcagattcttggaagtcacatscttaccatactgctgccccctcttaggaaacatggtggggctggcctggtttccttccgggagcccagtgctaagggctgggctgcaatgcagccagaagggagaccccatctctcccctcctatttttcttacacctttcccattcttggcagtaccattggtatttatgcattgcaattgtttgctcagatggaaacctgtgtcatagtcatctctatctgatacaaaatgagggaagttttcacattgcttagaggactttggcctcctgccatttcttggagtccaggccttgcggttggctctcctgacattttcagaaccgagtacccattcttggagtgttttaggggagctgagcgatgtcagtattctctggttctcaccaggagggaacagggagctcaggcctagccagtcaggagataggtcatggtgtacagatgctatcacatgggggcacttttttttttttttttgagatggattctcgtgctgtcgcccaggctggagtgcagtggtgtgatctgggctcactgcagcctccgcctcccgggtgcaagtgattcttgtgcctctgcctcctgagtagctgggactgcaggcaygcaccaccactccaagttcgtttttgtatttttagtacagacagggtttcaccatgttgaccagtctggtctcgaactcttgacctcaggtgatctgcctgcctcggcctcctaaagtgctgggattacaggcatgagccactgcgcctggtgggtcacattttaggttcctttgttgtctgttgagaaggtttttatgtggcagtatcaagggagtggggaatagattatatttttcatttatttcccaagacccttttgcccacttccgttgtttcttctagcatcgatactcctggagtcatcagacgtgtctcgcagctcttccacgagcaccctgacctcattgttggattcaacgcttttcttcccctcggatatagaatagacattcccaagaatggcaagttaaacatacagtygcctctgacaagccaggtatgccactacagtggttcgggtgatctcagccttcaccgagtatgtcttgctactcaggttgggccacgtgtctctcctgtatcattgctagaaagccacttaagatctgttctttttctagacgtgctcattgcttctagcacaaatcaaaatagatatggaaacacctacacaagcagcctctgcctcccaaattgatctgtttggaagatttaaatcaagagtggatgtcagggaggtatcctcctaaygcagaattttgtgtgaagtctaaataaccacctcagcagttgctgaggtcttggcttgaggctttcccagcgagcataccaggcaggcttgcccttgtatttaagcatgtcctcgtctgcctctgatcactctcagtaccacctacaaaataaagtggtcgagatggtgtgtgagtagccacgtttatgttggctgtgtttcatttaattgttgataggatcattagctcagctgggactcctggctttgctttggtcccttttttcttgggtgataggtgctggccctctttttttttttttttttttttttggagacggagtctggctctgtcacccaggctggagtgcagtggcgcaatctcagctcagtgcaacctccgcctcccaggttcaagcaattctcctgcctcagcctcccgagtagctgggattacaggtgtgcaccaccatgcttagctaatttttgtatttttagtagagatggggtttcttcatgttggccaggctgttcttgagctcctgacctcaagtgatctgcctgcttcagcttcccaaagtgctaggattacaggcgtgagccaccgtgcccagcctccttttttttttttttttttaagacaggttctcactctgttgcccaggctggagtgcagtggtgccatcatatctcactgcagcctcaacctcctgggctcaagtgatcctcccgtctcagcctcctaagtagctaggactacaggcgtgcaccaccacggccagctaatttatttattttttttgtagcgacagggtctcactatgttgcccagggttggtctcgatctcctggcctcaagcgatgtgcccaccttggcctcccacagtgctgggattacaggagtgagccactgtgcctggctcactgccccttctatctctgcagtctcttcatgcttgagcttactagcgcctctgagaaaaagaaagcctacttaagatttccttttataagatgaccattgtcattttttccacctcaacactatttcccatttaaggcataattctttgctgttgggggcttcccagtgcattgtggggtgtttagcaggatctgtagcgtgtacctaccagaccttcactcagttctgacagccagaaatgtctccagacattgccaggtgtctccctggggggcaaaagtgcccctgttgagaaccaccggtgtaagtggaccagctctcccaacctcctccagtccttgcctcgagagttttagcagggagtgtcagaatctactgctggaagcacttggtaggtcttctttgatggaagagatgatagagcgtccaatcaattagggatctgacactccgcagtcagttggaaagagaacagcgaagggtaatgtggcagtgcttttgtattaattccatgtgcaaggtgtgtgtcaattctgctgcttctcggccaggcgcagtggctcacgcctgtaatcccagcactttggggggccgagatgggtagattacaaggtcaggagttcaagaccagcctggccatcatggtgaaaccctgtctctactaaaagtacaaaaatcagccaggcgcagtggagcatgcctgtaatcccagctacttgggaggctgaggcatgagaattgcttgaacctgggaggcggaggttgcagtgagcagagattgtgccactgcactgtagcctgggtgacagagcaagactccgtctcaaaaaaaaaaaaaattctgctgcttctctgtgcaagaccctctctgccatcagcctgttgtctcctgaaagccaaggagcgagtctcagggttttttttttkccttttttgagaaggagtctcgctctgtcacccaggctggagttcagtggcgcaatctcggctccctgcaacctccacctcctgggttcaagagattctcctgcctcagcgtgctgagtagctgggattacaggcacgcttcatcatgcccggctaatttttttgtatttttagtggagatgggggtttcgccatgttggtcaggctggtctcgaactcctgaccccgtgattcgcccacctctgcctcccaaagtgctgggattacaggtgtgagccaccgcacccagctgaatctcagctttaaaggggaacttggaagcgtgtggccactgaactctgaagagccttccatttcctgtttgcaaatgaagccccaggatccagatgtactgcttgtgtcttagaccatgaaagccttagcaagactgatctccagaacagtcacgactgcgggagaaagccaagctcatttgcaatagcagcgtccaccagagcactttgcagagcctgaatgctgtggaaactctgggtctcgttcctgtcactcactcagaaagagccagagtgaaaagatgtgaactgtgcgtcctgcatgtggaaattgcctttcagcagagtccctgcccgtggagtaactcggctttcagggctagatcttgacaggcgccacactggttgtatttggagttggctcttcctttaagtagctgcgggtccccaaccgtggagggctggcagtcttgtctccccgtaggtggcttaggtgacaatgatgacggtgcagacccatcgacttggggaaaggcttgaaaagaactttcacttagtagctactcagcagggccttggtcatcgtgctgcagcctgggaacagtcatttccaggcttaggtgtagaagtttgttctcttcgggggcccctgggagcccactggcttccagttgatattgacacaggtgctgtcaggtttccagccctgtttcccagcagtctgggctgttgtttgtgtggcttcaggacagaaacatgagagatatcccaggtccaggccatgactcgcgtggcttcaggagtcctttgagctttcggctccctggagtcctttgagaggccatcgtctgaaagcctcacagggtttcccacacacagaggccctggtgatattctttctttctttcttttctttctttttttttttttttgtgacagagtttcagagtttcgctctttacccacgctggagtgcaatgacacaatctcgactcaccgcatcctctgcctccccagttcaagcgattctcctccctcagcctcctgagtaactgggattacaggcatgcaccagcgcgcccgactaattttgtatttttagtagagacggggtttctccatattggtcaggctggtcttgaactcccgacctcacgtgatctgcctgcctcggcctcccaaagtactgggattacaggcatgagccactgcacctggccatcttttttttttttttttttgagacagagtctcgctgtgttgcccaggctggagtgcaatggcacgatcttggctcgctgcatcctctgcctcccgggttcaagtgattctcctgcctcagcctcctgagtagctgggattacaggtgcctgccaccactatcagctaatttttgtatttttagtagagatgggatttcaccatgttggtcaggctggtttcgaaatcccctgacctcatgatctgcccacctcggcctcccaaagttcttttttttttttttttactttaattgaattattttttaattttgagacaccatttcactgtcacccaggctagagtacaatggcgtgatctcagctcactgcagcctccgcctctgaggttcaagtcattctcctgcctcagcctcccaagtagctgctattacaggcatgtgccaccacacccagctaatttttgtatttttagtagagacaggttttcaccatgttggccaggctggtctcgaacccctgacctcaagtgatcccccacctcagcctcccaaagtgttgagattacaggcgttagccactgtgcctggccttttttacatttttaaaayagagacagggtttcaccatgttgtccaggctggactcaagtgatcctcctgccttggcctcccaaagttttgggattacaggtgtgacccaccacgcctggccagtattctctgtygcttagtttttctagtttgactgttttgaagtatctttttccccccccaattttatcacaaagcctgccagctactgacaagtagggagtggcccataggtggtaaggaaggtgaataagagagtcccagcctcgggcagcctttggcgcagggtgtcttcagctttgggggccagactgttctttatggcgaggtgccgtcctgcacactgaagggtatttgagcagcctccctggcctccacccaccagatgcttctagatgtgataacctaaagtgtctcccgtgttgccgagtgtcccctgggtggcagagttgctcaggttgagaacacgagtctaaaggggaagacagacacaggccgtggtgtgtggccagtgacgacctggggaatttggaggaaggaacagcttcttactggagccttgccttggcctcctgagtcagcatcatttactgtctggtaattcaggccttggttgtaatgtcagctccacagagagccccctagtccctaccctgtgtcattcttacaccaccctgggttatgtatttcaaaacggctaggaaaagaagttcagaatgcattgtttcttattggttttccttccttggttgacggtgagtccttaagatgaggtgggccctgcactgtcttgttcatgactgtatccaccttctggaacgtcgccagggagcagtgcatggtgcaggaatgagaaactggatgctggtgggaacatggccgctctcagctagcgggtcctcttcagggcagaccctgcctcgtggaagatgacagctggcttggacagagacagagataaccccttaacgtgcagctcctaacttaagcagcccctcgacattcaaagggagccccctggctgttctctgggggaagtcccgctagttgtcaacaagtcrattcttgtgtttgtatcttcttggctcatggagcaggcggtgaccccttctccgagccaggccctggggtttattcagaggccctgctytcagggttcctgcacagtcaaggtggggggtccgatgagaaacagatgggcagatgcgggtggcgcatgggagagggcagagagaggatggagcaggccagggaagggtgggaggaggttgctgtgggcaggacctgtttcatgagggactgttcctggtggggagtgatggcctgaggtgagagtgagtgggtgtgcttgaggaacagccaaggagaacggcagggtcaggagctgaaggagagaagggggagagggagccaggagcrtgagaaccactggatggttctgggaggcggttctgctgctgtgctgagaatgaggggtcaggaggcccctgggagaccagggaggggccccaagtgatggaggcggggtagacagtgatggaaacagagtggatggtgacaaggaccagagagggtcccaagtgatgggaacagagaggatggtgacaaggaccagagacaattcccaagtgatgaggacagaatggatggtaacaaggagtagggaaggcctcccgagtgatggggacagaggtggacagcaatggcgacagagtggatggtgacaaggaccagagacagtccccaagtgatggggactgagtagacagtgatgaggacagagtggatggtaacaaggactggagagggatcccccgagtgatggggacggagtggacagtgataaggaccagagaagtgccctgagtgatggggacagagtgactggtgacaaggaccagagggggttcccatgtgatgggggcagagtggatgatgatgtagatcaggagcgggggtgtcagtgagagtgagaagtctgggctgatctcaggatgcctgattctctgggtaaaagtgtgggcccctgctgaggtgcataaggccagggcagttggggggctgctatgtgtctgtgcggtgcctgccatttgaggctctgttaatcagtacccaggcggggctgtgtgtggatgctcagatggacgtgtcggccacgcaggatggttgtcatggtgtgggaggcagttcgaactctgcctgatgaggccacccagggcacggggagagaggaggtgccggaagaaaaagaaaactgggcttgtgctgggtggtttagagcagcacagtcggcaaatggtagcttggagaccaaagccagcctggctcggtgtgattggttgtgatttttacattttcaaaggattaaatttttaaaaatgtttcatattgtgatactgttcacataacataaaatcatcatcattttaaagtgttagtatattcacaatactgtacaaccatcaccactaattccagaacattaacatcaccccaggatcaaaccctgaacctcctaattctcctctccccaagcccctggcaaccatgagtctgcttcctgtctttatggatttgcccgtatggacatttcatatcagtggggtcatacaccgtgtggctgttggtgtctggcttctcactcagcatcgtgttttccggggtcattcacatcggagccggtatcagtgcttccttccttaagactgaatcattctccactgtatggcaggaccacatttcgcatgcccactcttctgttgatggatgtttggcctgtttccaccttttggctgttgtgcatagtgctgcaacgaacattcatgtgtgaggatgtgttggaacacgtgttttctttttctttttttttcgagacagagtctcgctctgtcgcccaggctggagtgcagtggcggggtctcagctcactaaaacttctgcttctcaggttcaagcaattctcctgcttcagccttccaagtagccgggattacaagttcccaccaccacgcctggctaatttttttgcatttttagtagagatagggtttcaccatgttggccaggctagtcttgaactcctgacctcgtgatccgccatccttggcctcccaaagtgctgggattacaggttccagccaccgcgcctggcttttttttttttttttttttgagatggggttttgcttttgtttcccaggctggagtgcggtggtgcattgtcggctcaccacaaccccctgggttcaagcaattcttcctcctcagcctcccaagtagctgggtctataggtgcacaccaccacacctggctaatttttgtatttttagtggasacggggttttgcaatgttggccaggctcgtctcaaactcctgacttcaagggatctgtccacctcaacctcccaaagtgctagaattacaggtgtgagccactgcgcctggcctgagccactgtccctggcctgagcaccttttttcagttctcttggttatagacctgggagtgggattaccaggtcatatggtagcaataattccatggtcaacctgttgaggtaactgccacactgtccctcgtggtggctgtaccgtcccatctggctctttttgccaagccctggtctagagcgtggttccccattttgtcgcagtggcacactttaggggatcagagggtgcatgcggagcttggaaatgcctccttggaatggtggggggctcgcagtgagcctacagctgcctctgaaacagaccttggctccatgmtgcttccctacatacccacaccctgctcgttccgaccccttctgccatcaaacctgtgcaccatggagaaacagacgcagccccctgtgagcctgagcagagaatcattccggacatccccagagaatcttacaacaaaccccgccactgactgggcgcagtggtttacgcctgtaatctcagcactttgggaggccaaggtgggcagatcacttgaggtcaagcgagaccagcctggccaatatggtgaaaccccatctctactaaaaatagaaaaattagccagcgtggtcgcacggcacctgtgatcccagctactcaggagaatcacttgaacccgggaggcaaaggttgcagtgagcygggatcataccactgcactccagcctgggagacagagcaagactccatctcaaaacaraaagaacaaatcccgccaccaaggagaaattgttttagaatcgtggctgctctgcgtcttgtatttctgcttttctcagctgagactttctagaattgtctctgtacccattgttctgggcagaattgtgtcatccccccaccccacattccaccccaaattcatgtattttagccctagccccagcgcctcagaacgtgactgtatttggagatggagcctttgaagaggtgatttaactgaggccgttagggtrggccctaatccagtctgattggtgtccttataagagaggagattgggacacacatcagggacatgcgtgcacagagagaagaccacatgaggacamagacagtggccacccacaagccaaggagagagtccttagagaaaaccaaacctcctggcaccttgaccttggcctcctggcctccaggcctccagaactgagaactactaacttctgttgtttcagccagtctggggtacctcgttgtggcagcctgagctgatggatgcactcaccccactgacggtgcctgtgcccagcagaggtacctgtttcagtacaagacggtagtggtgtgcctggccttgcctgttgcagtagattttcagggtcagcgtttgggtcacctgcagtgttgggcactgcagggcagcggaaacagtgaagtctgtgtgtcccttcatccgttcacctgatcatccccaacagtgggtgaagctcactctgtttctcacactgttctgggcactggggatacagccctgatcaaaacccccaccctcgtggagttcgccatctagtcagggactggcagacagtgcaatgagtaaaatacatgatccataaggtggtgacgggccgcggagaaaaatgcaggagtgctaggaggtggcgtcattttactttggtgaaagagcgttctctaggactcaccaagcagggcttatccaagcaaaaacctcagccaggctggaggaatcctgactggctggagacccagcccttgtgtgctggggatggtgcagcataattctggtttagaaacaacagctcctcctctgggggagtggtcctgtcccaccacaacatgggagggaggcaagcttctttctatttttgctcatatcggctgaaaagtacacgcatagagggcattcttggtgggtgttcagggcctgtcttttctcccaagcgaccgatgcaccttattgcgattggcctgggtcttagcaccaaaaatgtcatgtcccttgaagtccccaacaacctggacagtgggtcgcctctaacctccagggtccccatcttatatatcctaccttggcatcactgctggcagcagttgcctttccacgtgaaagcaatcttgctgaaacagattgcaggaggcgtgggagacttctctattatatgcagcccagcacttggcaccacagaggcttaaacatccactttgtacatttctcctgaatgtgaagttttccaaatgcaaggtgctcgttgaacttgttgtgttccttgagtagattggtaaggatcgggtggaggtgagctgggaagactcacctgtgcaccccgccctgcttgcctccaggctctcagaagtaacctttccctgtctctaatacagcttggctccgtgctgagttttttctgttcctgtgcagacagtggctgggcctggtgtttttcayaatctgtttccagtgtcgggcctggcagtaactcattgtcgccttgtcaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccaggtaagaactcagattacaattccttgtgggttttggatttcatccagtttggggccctgcagatattcagattttcttgtcggaattcataaaatcctgtaaaattctaattagttgtggggttttttgtttgttttttcttagagtctggctctgttacccaggctggagtgcagtggcacggactyggctcattgcaacctccacctcctgggctcaagccatcctccaacttcagcctcccaagtagcggaggctacttggggctagaacatgggcgcacatcaccacacctagctaatttttgtaatttttgtagagacagggttttgccatgttgctcaggctggtcttgaactcctgaactcaaacgacccatccacctcagcctcccaaagtgctgggattacaggtgtgagccaccgtgcccagccacctttttttttttttttttttgagacagggtcttgctctgtcacctaggctggagtgcagtggtgtaataatagctcactgcagccttgacctcctgggctcaagcgatcctcctgcctcagccctccaagtagctgggagtacaggtgtgtgtcaccacacctggccaagacagtctttttatcagatgactttgttattgcttaggcaatacggccatcctttactttgctgattacaactgggcccagcaccaggagctggggctacagagacaaatggctgctcctgcttagctgttcattgcagtggtgggaagaaactcagaggtggattggggtggaaaagaaaggatgtgggcaggagaggtgagtcagggttaatatgattcccagcccggttcccaacccgtccggggccagggaggggacagtcaggttgaatcttgacatatcagtcggaaccagtaggcaggttagcctggaggaagggtggacattcttggtgccaggaatggcctgtgcaaaggtccagagaccagagcagacagcggcatcagggcgtctgcaggggacttgggcaatgcaggtgggctggtggcgagggacatctgtgtcgtgagtggggcttagacgtcctcttcacccagacgtggagtctctaacrcttggaattttttttagcagcagaacccattttttttcttttttttgaaacagaatcttgcgctgtcacccaggctggagtgcagtggctcaatctcagctcactgcaacctcagcctcccggcttcaaacaattctcctgcctcagcctcctgagcagctgggactacaggcatgggccaccacgcccagctaattagcagaacccattttttaaaatgaaatccctgcagccttgacatgtcgagtcaagaagcgggattcttttcagcataagcgtttcagatcaaatggatagaatttgtgttctgggaactccacagcatttgttgtccaccgtgctggcatcatcatgggccttagcatctgtgagaggctggtacagccctaagaacgcttgtttgtcatggatgagtggttgccagtggctgctgtgagcatctggtctgtgtggagggatgtgcttgtgatcgtagaatctgtgggcccctcccaggctttgtggggtcatcacatttaggaaggcgcatcagagcagtctgtgcagtggctctgttctgtggcaaaggaaggggcaggttaaagacactagagatgaatttagacaaggtcacaatgaggggttgccacagactccttcagagagagtgccatgggaagggacaacgcagtatcccccaacccaaaccgggctgctgagagttggttgagaatgcagacacctggccaccatgcaggattcccattcatcagggcccgcccggcatcggcacagtttctttkytgtttttattttttgagactgggtctcactgttgcccaggctggagtgcagcggcatcatcacagctcactgcagcctctacttctctgggctcaagcaatcctcccacctcagcctcctgagtgactgggactacaggcrctcactccgacgcccagctaagggctaagaggagacggggtttcaccatgttgcccaggtgggtcttggaactcctggcctcaagtgatccacccacctcagccccccaaagtactgggattacaggcgtgggccaccatacccagctggatggcatctgcattttaaacaaggcccctggtgactccagcctcaggttgtctagttttttcaaatgtaagtttgaactgttgtgtaaattatcctggttttagaatgttggttcagatatttcagggatactgttagagccaaaccaggcagctccagggtccatctggccgtgtgttactgtttctccatctttgtggggctttccttcagactttctctctgccaccttctccctcggggttcttatccgtaaaatggccacaaaactggtggtgccaatgagcctgggttcagtgaggttaactgagcaaccagttcaggcacaagcctgcctcaggtcacccctgggtaactgtcacccattacacagccacgtatgcatgtcctgtgtgtgctgggatgaacagttagtcctgccctaacataagtgggaccctaaaaacgagctccctctgcagagttgcaaagtgtgatgggaactgcaggttcatgggaaacagactcagggtatgacattcaaaaacttcctcagggacacctagaaaaagataggcaccgactctaaacagcagcgccgttacgcgcatattaagtggccgagaattacatgaatgccacagcaaatcgggtactgaccttggaagagacctgaggctggtttgtggatctggtggcagcctgtgaattatgtgaaggccgggaggaggtcatctgaaatcagacaggtcattgtggcctcagatggggacagggctggcccctagcacaggggaaygctgagagagtgcatggacatgggagggggtgctggcgtggttttgcatactcccacggggttctggtcagccgggagcagtttctgcattcacctggtgtttctcctgcacaaaatagaagagaagcaaacagaaaattcacctcatgctcaaattattcccagtacttgtatctcatttagacagacatcttgttcaaaataagcattctagcagaactgactgtctctgcagcatgaatttccagaaactacttccctaagttgagggcgtactatgcattcatagagatcactcaatttccttctaaaaggtggtaccaatttgtctttctgccttccgtgtttgattgtttgtttgtttgttttttgagacggagtctctttcacccaggctggagtgcagtggcgcaatctcgtctcactgcagcctccgcctcctgggctcaagcaattctcctgcttcaacctcccgagtagctgggactacaggcacgcgcccccacacccgggtaatttttgtatttttagtagagatagggtttcaccatcttggctaggctggtcttgaactcctgacctcaggtgatccgcctaccttggcctcccaaagtgctgggattacaggcstgagctaccgcacctggccttgccttctgtgtttgagagcacctgctccccacaccctcatcggaaatcctagcctcttctgtctgtgtagtcagatgagcagagatggctgtggcactgttttaaattgtttctttaaacatcagtcaatttggtcattgtttcttttcttctttatttattttagataggatcttgctctgttgcctaggctggagtatgcactatcatgatggtagctcactgcagccttgagctcctgggctcaagcaatcctcttgcctcagccttccaagtaactaggaccacaggagtgtgtcaccatgcctacataatgtttaaaacaaatttttttaatcatttctcagcattttggctaagatcaagtgtaaaattttttgtagcgatagggtctcactgtattgcccaggctggtcttgaactcttggactgaagccagtctcctgcctcggcctcccaaagtgctgggattacaggcatgagccatcatgcccagcctaaattgtttctttaaacttcactcagtgtggtcgttgttctgtccgtatgcagatagatcatttctatttattatctgaactgagtggcctttgcttgtttttaagttttgctttttagtgtcttttgatgactttttggaagggtggtgttttttttcccctgcagtgtaggtgctgccggtgccaagatttaaaacttgcttcccttcccacaggctgcagcgggtgcagaggggcaggaggcgccagcacagggattcctcctgctttgcagccgtgcagtgggactctggaagccacgccatattatccgggaggctccggtgctattgcctcttgttctgtgacactcttgggtgtaaaattgatacggacgtatttctaacagccacggcggttttgctggcccgttcctgccttccaacctgggttccctttggtcctcttgttgctttaaggtctggatcaggccattttccttgggtctcagtgactccgggccagtaggtgcctcggcctggaagtcccttcccttcatggcccagcgctccccagttctacactccccatttcccttgggaaggcctggggttcgcccctgaccttgtacttccccggcccacccctgattacagccagcctgtcacctccctgccccctctgttcgtggacactgctgggtccccaccatactcctggacgggacctgcccatggccggggctcaggccatgctgggcagcaagatccacamgtgtgcagacaggaccctgcgggcaggtgctctttcctgagagtcatcctgtccccttcacggagggctgcctgagtgtcccggcccagggcacagcactccttgactaacgacttattttccctttcctgaaaactggcagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctggtgagtgccgagagcccctgcccagcctcgggggcctcagcgaggayggagggccccagccagcttgacccatgtccgggccaagcctatgtaccctccaggccacactagggtcccccagaagctacgcaggttgcagatacccaggggttcctcactgtaggctccacctgcacagcaagctcgtaaacgatttgccaaggtgcttctctgtacagacagtacctggatcttggggtggtttgggaggcagagagcatcttccagtggagactatgggcccaggggttccacctcctgtgtctgccctgcagagccccaccctgcctgggaccccagccctgtgggaaggtgcaggagggctgggtccacaatcatcgcttcccctgttggatgagactgatctggggctccagcaggttggatctggaggagccagtagcgggggtggcctgtggcctggccctgaccatggtggtagagagcagagatgggcgaggaggggccttagacagggctcagggctcaccctgcacagtcagcctttctcccctgcctgtggcctgaagctgccagggccgcctgttccgattcctcttttttcccccactatgatcataagacttttttaaaaattgaagtgaaatttatgtaacatcgaattcaccattgaaagtgaacaattccatggcatgtggtacatcctcagtgttgtacaaccttcaccactacctagttccagaacattttcatccccctgaaaggagacccagtccccatcagcagccaccccattcacctcccccagctcctggcaacgcccatgtgcttcctgtttctgtggatttgattcgcccattctggacatttcagatgggtggaatgtcaccatatgtggcctttgtgtctggctcctctcactcagcatcatgttttcaaggttyatccatgtcgtaccgtggatcagtgctcattccttttcctggctgaatcatattctgttagatggatgagccacattctgtttatccgtattctgttgatggacatttgggttgtttctgccttttggctgttgtgaacagtgccgccatcaacatttattgcacggatttgtttgaacacctgttttcagttcttttgggtagacacctaggagtggaattcctgggtcacatgttaattctgtttttgactttttgaagagcctctaaactgttttctacagtgaccgcaccattttacattcctatcagcartggactgcggtttctgtctctccacatsttggccaacatttgttcttttccaggtttttttttttttttttttgccttttgtttttagtagccatcagtgtgtgaagttttattgcattaaggtttgtttgtttttattttttgagacaggctctctgtctgtcacctaggctggagtgcagtggcgtaattgatcactgttcactgcaacctccatctcccaggctcaggtgatcctcccacctcagcctcctgagtagctgggactacagacaccaccacgatgccaggccaatttttgtattttttgtagagacagggcttcgccatgttgcccaggctggtctcgagctcctggcctcaagcgatccacctgcctcagtctcccaaagtgctgggattacaggtgtgagccactgcgcccggcctacttttattttttaattgtagagacagggtctcacaatgttgtccaggttggtctcagactcctggcctcaagcgatcctcccaccttggcctcccaaagtgttaggattacaagcatatgccattgtgcccagtccatggtttctttaagtggcatttatgcagggcacccggctagctcagtcagtagagcatgagactctcaaataacatttattaccaatttagctaagatttttagtgtgtattggtttattagagctatcttgtatatttagaaagattggatcaactttttaaaattattaaaagcactgcatctgttgtgtgaagtataatctttatgttaacttttggacatatattaaaactgtaggaaaaagaaaccaagatgaaatttggcattgctctaattaaatttgactggcctggatcagaggttgacaaaccttctctacaaagggccagatagtaagtatcacaggctttgcaggccagttgatctttgtgtaaagattcacctctgccctagtagcttgaaagcagtcatggaatatgtatgtcaatgactggacagggctgtgtgccaataacactttatttacaaaatgaatgggtgtggccgggtaccaacaaaactttatttacaaaatgaatgggcatgactgggtaccaataactttacaaaaggaatgggtgtggctaggtgctgataaaaaattttatttatgagaacaacaggccctgtgttaatttgccattccctagcctaggtggtctttgggggtccatctagctcagatgttcacataattgggagattaactgaaaagcaagaaccatgtgaactgttggggaagatctgctatacctgcttggtgagcttggctggacgcatggcgggtttcccctccaggtcccctgttcttgttcagcatttgtcatatggtcgcccagctgcatcttttgggaatcagtttacacctgttccagcatatacaaaaaatagccaagcgtggtggctcgtgcctgtaatcccagctacatagaaggctgargcaagagaatcacttgaacccaggagacggaggttgcactgagctgagatcgcaccattgcgctccagcctgggtgacagagtgagacctccgtctcaaaaaaaaaaaaaaaaagatgtaccagtggagaattgtgtagatgccaatttctccacttacagctctcgaaatagccttgaattttgggtaattattccccccaaataattccccccaaaactcaaatagccttgagttttggtaattattccccccaaattattcttctaagtcttaactgtggctaaataataagtcttttttagtagtagtagtagtattgtggctaaataatgtctttattattattatggtaaaaatagtatacactaatgaaaaaataagtattagcaagagtatcaaatttttaatgcaaacttcctctcccttgactcagttcttagtcattcttctcagaggttagcacttctaagtgtcttgtatatctttccagaaatttcctctgcatgtgtaacaaatactttttacaaagcgacacacggcatcctatttgttctgccccttgggtttttggggtttttccttgtttttttttgtttgtttgttttatttcaggtatgcctgtccctaacagcagcccagagccagcccatagtatctgatcgctgcgggctgatttgttcagatgcaccatgacttgtccatctcacccacactttaggtctttgggggtgtctttgcatccaggtcctgtggtggcaggggaaggcggagtacgatggaggtgaccgcagtggcacagaacgttgtagggcctctccagctctgcccacgtcctgcagaaaagctgcggtctgtccatcgtcccctgcctgtccagccttccagtatgttcatagtagactgttgcagaacagttctttgtaaatgtcattggcaccctgtaggcaccctgctcgggacaagcatcctcgacctgttagccgatggctggagcctgggaggcaggccccgaaccagccacgagccccactctgctcccagcaagtgacgacatcatcccccagaaacgttttgtcattcatagaaaagacttcaaaacctggccccaaggcccccaccagtgccctggcaaacatcagccacttccccttgctgcctgtttctctgtccactgcaccttgtgtttctgtggtgcyggcatgcacacggcgagatgccccaccagtggccgccacatgagcccccgcacgggaagacccaactcagctgtctccctcctgaaacccccagcccttctccctcccttatccataaaggcctcacaggagctttctcccagcctggcagtgttagtctgtgatgattcggttaccttggaatgtgagcatcttgctggagtcacctcacgcatggacggagcatctggcctggtgcccgtggccaccattgcccaccgggctgtgggctgagctggaagcagctctgcatgctcaggtgcatgggtccagccacgtctccggtgctgaccacctcccacatgtgtccttagttcacaggaaacgggccgtgcgagatgcacagcgtgcagaagaacgagcacgacaagaccccggagcacagcaggaagcgctcccggccctcgctcctccgccccgtgtctgcacccgccaaggtacctgtgagccacatgcagccatgcctgcacgcggggcccccagcaaatcgggccttcccagcatgtgaccagggaacagaggccccagcaggggttcggggctggaccgggggctgtgtgaggttcaccggcagtgggaccgttggaagtcagctctcctctaaggtggctgttcttccgttctccctgtcctgtgagattgttttgaaaaggaggaggaggaaggagtgttaaccctgccctaggtcccaagaaacagggtgtaccacccagtctccttttcaccctcaggactctctcacaggcaaggccgccatgtacgtttgttcaggttggtcactgcacagctgagggcagagaggggctgggatccagctcctgtcacgcctttcacctgcaatggtggttttccgattccattattccttgtgcagttactacttggctttctactattggtgggaactttgtcgtcctcccatttatttagttatgtatattagatatggactctgggttataatccattctagtgttgatgtccatactgttccagattgggccagcggggtccctttggctcttgtgtcctttttttctttcctttgagacagagtctcgctctgtcacccaggctggagtgcagtggcgcgatctcggctcactgcaagctccgcctcccgggttcacgccattgtcctgcctcagccttcctgtgtccttttggcatgtcctcatcattctttctcctgtggggggatggggtttcactctgccacctaggctggagtgcagtggcacagtcagccttgacctctgggctctagctgtcctctcacctcagccttccaagtagctgggaccacaggtgtgcaccaccacacctttttgtagagatgaggtttcatcrtgttgcccaggctggtctcgaactcctgggctcaaacaatcctcccgcctcagcctcccaaagtgttgggattacaggcgtgagtccctgcacccagctcatcctcattcttcaggcactttggagatagttctggatggacagtgttgtccttcttgccatgatcgtgcatccaagttcaggtccaagtccagcttagagacaaaagcctgcagagactcaacatttggcttctccagggtcttcccagtgccaccctcttcctgtccgcttcttgttgctgtcttggctctcagracaaaacagggaaaggattctgagattgtcgtagccaggggcacatcccccttgcctttctgatgctgtggcactcttgcctgttacccaaagccctaccctgctgagatggagatcccagatttggcagtggcaggtatccccagaggtgtcatctcaggggtcctgggtaactgagcggctcctgcctgtccctcactgagcatctcatggcagttcccaaaggagagcacggtcttagccttcttgagactctgtgacagcgatggacagaggccaccggtgggaggcacagtgttaactgcatagaatttctccccacagaaaaaaatgaaacttcgtggtaccaaagacctgtccatcgctgcagtggggaagtacgggactctgcaggaattttctttctttgacaaggtgagggtgggccctggcttccatcttggggatgccatgtccagctggctgggccaatgctccctgggcctgccccaggattggggcggggagcaggtagggtgggtgcagtctgaggatggatccggcggggctggcccccagctttcactgcggaagggaatgtgggcctccttggagcccaggcatatactgtgggcaggagtcccagtgggtgctgagactccaagcagagtatgaagacatacatgtctgccaccctgcagctgtgtggctttttcttatatcagggatgattgtagggttcccgcccagggtctgtgggcagagcagacaaggtggccgtgtgcatgggctgtgaattgctgcatggattgcatgcacagactgtgaattgctgcatggatcacgtgcacgggctgtgtgaattgctgcatggacacatgcatggactgtgtgaattgctgcacagatggcatgcatgggctgtgaattgctgcatggattgcgtgcatgggctgtgtgaattgctgcacggatcgcgtgcacgggctgcgtgaattgcacggatcacatgcacgaactgaattgctgcatggaygcgtgcaggggctgtgtgrattgcacggatcgcatgcacaaactgtgaattgctgcatggacgcgtgcagggactgtgtgaattgctgcacagatggcgtgcatgggctgtgaattgctgcatggatcacgtgcctgtgctgtgtgaattgctacacagattatgtgcacgggctgtgaattgctgcatggatcacctgcacaggccgtgaattggtgcatggattgcgtgcatgggctgtgtgaattgcagcacagatatcatttacttatagacacagttggttcccatatcgcacacccatgtggctgacctacaagtgagccaggcccagaggctgaggagcaggggttcacagtggtccctgactgctctctctgcaggtccgccgggtgctgaagagccaggaggtgtatgaaaacttcctccgctgcatcgcactcttcaaccaggagctggtgtctggctctgagctcctgcagctcgtcagcccatttctggggtgagcagctgacttcccagggctccctaggggggttctgttcctgtcaactccatctacttggtttttagttactgtttttgagcaatgattgtgcttttctaaaatcctgtttattaattgacgtgattgatawaattattgattcccatgcatttgtaaggagcaatacaccacctgggtaccctccagctggttcctttaccagtaacatctgtagtcagtatcctcaccagaatacagtgggtcctcgagtaatgccttttcatttaacactgttttaacaccgatgagaaaagaagacattcatttctggtctgagtggagtttgcacgttctccccatgtctgcgtggattttctcccacatcccaaagatgtgcatgttaggttaagtctaggttaagcggtgagtctccgtggtcccagcctgagtgagtgtggcggggtgagcgccctgcagtggggtggcgtcctgtccagggtgggtgccccactggtgctctgagctgctgggatagggtccggccacccaagatcctgaactggaataattgggtaaattgttattttacttgtttttactcatctttcttatctgtatgtgtggcttgcatttatttcagtgtttaatattagaagtgttttggtctctctttagaaatttggtgattgttttgtgaccaaaaatacgccgtaggaacgtcattcttgtttatgtgtcaattagcttgtggcaaaattggttttgttacacatcttttcaacttaaagacacagctttctaacacctgttgatgatgttgagtgaggacttactgtactgactctcacacaacccccgttctttccagactctccgtgttcctcatacacgtctggtgtgtgtgtttttatacagctttctcactgtggagggttgtgcgtccgccacagtgaagatactgaacggctccaggactgtcaagttctggccttgaccttttatctccatcccaaaaccctgcctyagccggagtctgttccaaacccctggcaactacttatctgttctctagacaatgttacagtaatggaactgtacaggaggaaccctctgggagaaaccttccccccccsccccccagcaaaattccctggagattcacctgataaatacttttaaaaattctaacacttgggccgggtgcggtggctcgtgtgtaatcccagcactttgggaggccgaggtgagcagattgcctgaggtcaggagttggagacaagcctggccaacatggtggaactccatctctactaaaaatacaaaaattagccgggcgtggtggcaggcgcctgtaatcccagctacttgggaggctgaggcaggagaatcgcttgaacccaggaggcggaggttgcagtgagctgagatcacgccattgtactccagcctgggtggcgacaagagcaagactttgtctcaaaaacaaaacaaaacaaaaaaataattctaacccttgggtcgggcttgggttaggtgcggtggctcacacctgtaatcccaacactttgggaggccgaggtgggtggatcacttgatgtcaggaattagagaccagtctgggcaacatggccaaaccctgtctctaccaaaaaatataaaaattcgccgggggtggtggcacacgcctgttgtcccagctacttaggaggctgagctagaaggatagcttgagccagggaggtcaaggctgcagtgagctgtgatcacgccactgtcctctagcctgggtgacagagtgagaccctgtatccaaaaaatatatgtatatatattatacctctgctgcacaaagagaagcctcattagcaggtcaggtctaagagtagcttctaacctctggtggccaggtcagcctcaggaaggggctgggactgagtggaggggcctggaaacaactgcgcacactcgtatccattctcgggctcacaggagtgtgcgcggtaggagtaggcgggcctgtgagtgctgagacctgggagccagctggggccagtgttgcttcctgcacatcagccctgtgactagggtgagtcacttgggcagtctgagcctctgtttccttgctgtaaaatggggatagtaaatgtaccgacctatgtggggttcctgagagctgcaggtgggcgctacytgcagggcccttcaaatacaatagaatctcacaaataaaaggaaaagacgattttttcggcagaaggaaatgatgtaagtcacaaacttggatctttcctaaagaatcgaagagcatggagaaaaatacacgtgaagatttttttttttttcaagacagagtcttgctctgttgcccaggctggagtgcagtggcgcgatcttggctcactgcaacctccacctcccaggttcaagtgactctcctgcctcatcctcctgagtagctgggattacagatgtgtgccaccatacttggctaatttttgtatttttagtagagatggggttttgccatgttggccaggctggtctcgaactcctgacctcaagcagtctgcctgcctcagtctcccaacgtgctgagattatgggcgtgagccaccatgcctggccatgattcttttttttaatggttcttgcacatggtgggtgcacatattaacatgatyagtccattcagtccttagcccttttcccatttaccccagggatagtagttgacagcacttgtggctgtagcgttcaccccaagataactttgccatgaagcatctcatttttattattatttttgcattgctgtcatatatcaactttggaaataaaagacatcattttatgtatagcatcctgtttttagtagtgatatttccagttacaaaatatagtaattcttgatcactgaaaatgtcaaatcttggaaaatgtagcattcctacacttgatgttaacattgttctcaaacagttgttggccaaagattcatttgatgaatctgactgttccaaaatagacgattctggtgattcagacgattctgatgttctgtttagaaataactccaagaacagtttttatattttactttcacattgaaaatcagtcagatttgcttcagcctcaaagagtgtgtttatgtaaaattaaatgagcgctggcagcaagctggacttttttttttgttctaaatgggaaaaagttgaatcaaccctggggacaggtgctgtgtgagcccttttgcattaacttaaaaaaaatatgtgtgtgtgtgtgtgtgtgtgtgtgtgtgtgtgtgtrtatatwcacataaacatttttctaatgtaaaataaagcacagatccaagaaaccacatggccaacaaatggcttgaatctttattaagcagtcacccatgtgcccaccacccacatcaaaaatagactccaggagcacccccgcataccattccagtccctgcccctcactgtgagagtgtcctgacttcaggagtgaccgccacctgcactaatgacggcacagccacccaggtgggcatcgccaaatacatgactcagtctcacccccatctgggttgggtttgctttgctttgcttcttttctcttctcttttcttttcttttcttttctttttttgagacggagtctaactctgtcacccaggctggagtgcaatggtgcgatctcagctcactgcaacctctgtctcccaggttcaagtgattatcctgcctcagcctctcgagtagctgggactacaggtgcctgtgaccacacccagctactttttgtattttgagtagagacagagtttcgccatgttggtcaggctggtctcaaactcctggcctcaagtgatccgcctgcctcagcstctcaaaatgctgggattgcaagtgtgagccacggcgcccaggccctgggttttgttttctaatacatctcgtaagtctcctttcacctctgattccctccgattctagtccttactatttttgtcctgatgcccctctgcctatccctgtccctgttatttctgtgatattagcctcccaggtttgctcattcatttggggttacacaggaggatcaccacagcatttctcaccttttataagaagtggcccaggatagctgcttgattacagccttgattcctccctagtcacggcctcagagtgatgaactgctttcatatcatcttcccaaggggaccaattaggttgtttcctttgtttttttttagcatcttaatgaattcatggacttaaaatatatttgatgcgtttcaataccgtttctagtccttttaaaggtgaggggccaggcrtggtggctcatgcctataatcccagtactttgggaggccgagggggaaggatcacttgcatccaggagtttaagaccaaggccgggcctggtggctcacgcctgtaatcctagcactatgggaggctgaggcgggtggatcacctgaggtcaggagttcaagaccagcgtaaccaatatggtgaaaccccttctctactaaaaataaaaaaattagccagacatggtgacctgtgcctgtagtcccagctacttgggaggctgagacaggagaattgattgaacccaggaagcmgaggttgcaatgagcaaagattgtaccactrcactctagcctgggcaacagagcaagctgtctcaaaamaacgaaaacaaaaaaaaatgaccagcctgggcaacatagtgagacctcgtcagaaactagccagaagtggtggcgtgtacctgtacctacttyggaggttgaggtggctggatcgcttgagttttcgaggcagaggttgcagtgagccctgatctcaccactgcactcagcctgggtaacagagtgagaacctgtctcaaaaaaaaataaggaagctgaggctcaggtcgaacccctctaacttactctaggacaagcactcataggtgagcttagcgtgctgttaggcggcagccagggtgctccagccccaaagccagccctttgcatgttctctgccttctgggcacagtggctgctgggcttcggtgtgtatttttttttttaactcagcatttcttggaagtgtttcagcatcagatgtgaacccatgtcctcatttttaagcaactgcaccgcttttccttcccttaccagggtctctaacaatggacatttgtctctagtcctccctgtaagtggtgttgacagcaaatgctcctgagtctgcgaccctcatgggtcaagctgagcccatcagaaggcctttccctggtggtctcaggcatgcacgtgttggggtgatcttttcagtgggttttctttcttgggctgctgaagktctgtaaacgccctgaagaacagcccagagcaggatggtgttactctagtctcagccaaaacggggactcctggggtctgtttgtgacgtgggtggtgggcacacggctgggctttttctgtggatgtggaatgcacattcaccttgagttgcctccactgggcttagaatccagcactctctgagcctgggtcccacctgggaaaaggggcccccaggggctgtgtgtggagctggtgttggcacctgggtccagcgggcacgtgaccaccccgggttggaattgggactctgcttcctactagccaagcgagcctcagtgtctttgtaaaatggccatacctccctcctgggtttatcaggaggttagaggggaagacagaaggaacatgaaaggtgagaatctgaaaggcaaggtgctgaacagatgggcagtgccggagcacagtcagctgttcttgtttccatgtttcagcagtagagactcgtatggggaagggcgtttggggaagggtctgtatggagcaaggtccagaattgaagcgggcctctgcgtgtgcttgacacgaggcctggttgggttaggagcgttcaccaccatgtggcgttcctccgcgtgttcaacctgcggtcaagtgctcagctgggctgggcagctgaacacggcccagggaactgcccctcgcagctggcagccgcgtggcagccagggtggatcgggttgagcattcccttcagagcagtcacgatttgcgtttatcccagcagtagcctcaggcatctctgcagctttttygttggtctctttccttcctacgtttccatcggcttgtgggttttccttgtgagcagggttggcatagggttcttaaatacggggaacgacggagcccacatcaatgagggggacgtcgttatgcgagggtgggctgggtggctaggtcacagcaggattgtggcaccagcagtcaaagtaactgcaacttttttttttttttttttttttgagacggagtctcgctctgtcgcccaggctggagtgcagtggcgtgatctcggctcactgcaacctctgcctcctgggttcacgccattctcctgcctcagcctctccsagtagctgggactacaggcgcccgccaccacgcccagctaattttttttttgtatttttagtagagacggggtttcaccgtggtctcgatctcctgacctcgtgatccgcccgcctcggcctcccaaagttctgggattacaagcatgagccactgcgcctggccataactgcaacttttttggtaggatctgatgttactgcttagagacggggtcctgctctgttgcccaggctggtctcaaactcttgagctgaagtgatcttcccgccttggcctcctgagtagctgggattccaggtacacaccaccaggtctgatactattttaaacagaaatccaggtggcattgtagggtcatttgcattaaagccttcctgttgtcgaccacagccatgacattatgactttcaagcttgtgtccagagaggggttcacagagagaagtctccctcatgagaggaagactgtggatcagagataggcaaacttgatctctgaggggccagatgggctttgtggaaatgactcaaacccctcttgtgcaggcagccacaggcagtgcgtacacaagtggatgtgactgcaggccagtgaaactttatttacaatgggatggctaggcatggtggctcacgcctgtcaccccagtactttgggaggttgaggtgaaaggatcacttgaggccaggagttcaagaccagcttgggcaacatagcaagaccccatctctacaaaaaaatttttaaattggccctgcatggtggctcacacttgtaatcccagcactttgggaggccgaggcgggtgaatcaccggaggtcaggagtttgagaccagcctggccaacatggggaaaccccgtctctactaaacatacaaaaattagccgggcatggtggtgcatgcctgtagtcccagctactcagaaagctgagacaggagaattgcttgaacccgggaggtggaggttgaagtgagccgagattgtgccattgcaccccagcctgggcgacaagagtgaaactctgtctcaaaaaaaaaaaaaaaaaaaaatttagccgggtgtggtggcacatgcctgtggtcccagctactgaggaggctgcggtgggaggatctcttgagcccacgagtttgaggttgcagtaagctgagatcatgccactgcccttgagcctgggcaacagagtaagacactmtctctaaaaagaaaataccaaaccaaacaaaacacaggcagtgtgcagactggctgtggcttgccactccctggcctgaagcctggcctcttccagtcagggaacatcaggggttccagcttctgccagtttaagtcatcttttctggtgtatttcaaagccttactgtgagtatgggattaataggcacaggaagggacctggtgtgtgacagatgggtgggaggcccattcattcacacaccccgggacttgcagtgacttcctgtgtattggattcttccgcctctcattcgcatccatgatgttgaattctgactctgtttaacttgtaatgtccacatgaagccattctaaaatctccagatccctctcagaaggccctggggatgaccagttaccatgtgtctttatctttgaaggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtagcgctccctggggctcaaatgttcgttgacatggtgcatcccccacccctccccagcaaacacccgatacccccgttatgaatgaaatgctgtgtgctcagccctcctgaatgttgggttatgggtggtgctgggatgtggcccggcaaaaccacctgagcagagacaacagtgttgtaccctgctggtagttttggcaaaacacagagtgccagggataacgtggagttcggcttattcatctgttatttgacttaggtttattgctgccatgattctgctctgtcccgggctcactgacctcagtgtgtttctgtttagcttgaccattggacacttctccagggttcgtggacagacgattactgcatgtccaagttcaagaatacctgctggattccaggatatagtgcaggggtcagcaaactctggcccacgggccctggcccgctgcccgtgtttgtaaataaagttttactgtcacacagacacaaccattcctttacatattgcctgtggctgcttttctcaccacaaaggcagagttgagtattcatctgggatggcctgcaaaatctgagatggttgctgtctgaccctttgcagagagaatttaccaatgtctgaaatgaaatcggccctccggatctgcaagttcctcatctgtggtttcaactaaccatggattgaaaatacgtggggaaagagaaaccaaaaaatgacaatacagcaataaagcgtaatccacattttaagaatgcagtgtaacaatgatctacacagcatttacattgcattaggtataagtattctagagatgattttgcataggatatatgcaaataggattccattggacatcagggacttgagtatctgtggatttgggtcttcaggggtggttctggaaccaatctcccaggataccaagggagtgtccacttgaccaaagtcatgtttttccttaaaaactttatgcaccttcccatttgtataaggcagttggtattatgtatcaggatggtattatgtatcttggtactttctacactggctaacagtaaatcttggctcctggggcatgcagcgtcattcacggcatttcctcttggtgcaggtactgaacgacacctgggtctccttcccttcctggtctgaggactccacrttcgtcagctccaagaagacaccgtacgaggagcagcttcaccgctgtgaggacgagcgcttcgaggtgtgtgtgctgctgtggccrggtcccccggcatgtgcctgttccccttctccatgggacatgcatcctgatcctcctccactgccccagtctcgtttggaggagcaggaattgcagcacattccaacagctcctggaagcttcctgcygggtcttgctggcctttgggctggctaccagatggcacttttctttctgtttaaaaattttgtttgggctgggcgtagtggcagacacctgtaatcccaacactttgggaggccaagacaggtggatcatttaagctcaggagtttgagaccagcctgggcaacatggcgaaaccccatctctaccaaaaatacaaaaattagccgggcgtggtggcgggcgcctgtaatcccagctactcgagaggcagaagcagtagaattgcttgagccagagaggccgaggctgcagtgagccgagatcacaccactgcactccaccctggacaacagaatgagaccctgtctcctaaaaagtttmtttaatgtaaaaattaaatttatttttattttatttatttatttattttgcttgctctgtttcccaggctggaagtgcagtggcgtaatcatggatcgctgcagccttgacctcccaggctcaaatgatcctcccacctcagcctcctgagtaactggaaccacaagtccatactaccatgcccaagttgttgttttttttactttttttgtagacatgaagtctcactgtgttcccgaggctggtctcacactcctggcctcaagcgatcctcccaccttggccttccaaagtgctgagattaaaggaatgagccaccacacctggctaatttttttttcctttttttagagacagggtctgtattgcccaggctacattaatttttgtaattaaaagttttattggctgggcacgatggctcacgcctgtaatccctgcactttgggaggctgaggtgggaggactgcttgaggccaggagttcaagaccaacctgggcaacaaagcaagagcccatctatacaaaaaaaaaatttttttttttttttgagacagagtttcactctgtcgcccaggctggagtccagtggcatgatcttggctcactgcaacctccacctcctgggttcaagcgattctcctgccttagcctcctgaatagctgggattacaggcacaccaccattcctggctaatttttttatttttagtagagacggggtttcactatgttggtcgggctggtctcgaactcgtgaccttgtgatccgcccatctcagcctcccaaagtgccaggattacaggcgtgagccaccgtgcccggccataaatttttttaattagccaggcatggtggtgcacacctatattcctagctacgtgggaggctaaggtgggaggattgtttgagcccaggaggttgaggctgcagtgagctttgattgtgccacagcactcaagtctgggtgacagagcaagaccctatctcttaaatacacacaccccccccccmaaaaaatcctctggtctctgaggtcccaggctcctctctgaggcctcttgagttccccagtggctgaccccgtcctgccttcctttccatagttagacgttgtcctggagacgaacctggccacaatccgtgtgttggaaagtgtgcagaagaagctrtcycggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaaggtgccctgtggcgtcccgacttcccttccccttccccttcccccttccctcccctcccctcccctcccctccccactgcagggagcccttggagagctcattagtgctgtttgtcaacaggtgtcatctccaggggtggtctctgaggcctaagggtgccttcctgtatttcccagtctcccactcctgagaggagagcactgtgaccttctaggactttccaccttgcacataatacatctagacatctaaataactgctttaagagtcagatgcgaccactacactgtggcttgcattttatttaatgctgcatttcggatgccgtccggcgctagttaacaggcatttatcaagtggtcactttcaggcaggtgcagtgcttggccctgggattatgcagctgagtgaggcagacccagtccctctcttgggactcacagctgagcaggggacctgagtggttgagccaacagccatgcggagagtgctgggtgccagggaggaggtggaggaaccgggaagccggccacattggctctgtaaggccatcacgccctccctctgacgtgcacagagcccactgcacagrctaggctgsgagctggctgggcctgggtcctggacccccagtcaagtcccagaggaagacaggccagccctgggatgcttcagggaggatgccctggcttgtccctggtgctgacctctcttccccccgcagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgaggtaaagccttccctagccctgccggccggtgggggtggggtcctggctctcccgaccgccgggtctgtgcctctgtttccctggtggttaggcagggtagtggcattgccctttcagggctgtgttgaggcgagggttcatgtctctgtgatgcccagcctgtggcctgccctaggagaaccagcaactctgccattgtctatctgtttgtttgtttggagacagagtctcgctgtgttacacaggctggagtgcagtggtgtgatctcagctcactgtaacctcagcctcctgggttcaagtgattcttctgcctcagcctcctgagtrgctgggactacaggcgcacaccaccacacccagctaatttttatatttttagtagagatgggttttcaccatgttggccaggctggtcttgaactcctgacctcgtgatccacccacctcagcctcccaaagtgctgggattacatgcgtaagccaccgctcctggccgactctgccattgtctagcgaagtctccgtccctcccgtggggcagtgatggactttggcttaggtagtgggtggcagcagccttcatttctttcttgccgactgtgccaggcaccggtgttagcaacacagaaagagtaatrcatcatctgacctcactcctgaacctgactctgctgcggcattattctgattttaccagtggggaaactgaggcacaagaggttgcatttgcctgggctggtcgcagggggccagggctctgagtcattgggttcgaggctttcggctgcatgtcctcactgcaggctcacaaggcctgagtcatagaaccaaggccagcggggccctcaggttgccaggagctgggcctgttagtagctgtgtgtagggagtgcctgcttgcaggatcctgaggtgggaagcttggcagggtgccgggcgtggtgatagccagctgtcgggaaggtccttggacactctgaggaggtggcttaggagggcacactactccccaggcagtgcccagatcatggcacgggctgcgttatcagcctggtgcccacctgggcagggggtgttgcctcacctgatttggtttcttgctcctgtcactgcacagtgagcggtcgctccttcttttacaacacagaaacggaatccacaggagccgggctgctggcccaaggcctctcccagagcctgtgggactgtggggacccccttccctcccacctcccttcccgtgggccaccctcgccccaggcccacccacaaccactctggcttcctcactctagtcctcggcgatcctcaagcccaagaccccgtataggttctgtgggtctgtggtgtctgcaaagtgcagatgatgaagtagccctggaaatccaccaatgcgaccctgagttcctggatccctccctggggctggggctgacaaagggaggggcaccaaggttcatatgcagatctctgcacatgcaggtccttgatgaattccaaagtcagaaccccattccatcacgtgatttacaaagcatggttacagatcatggacatggggaccctgcttcagaggggactgtaaaggaattttcagagtgtttatggcataaatgagacctgggggacttaggaagcagtcagagggcgatggtcacactgaagagcccagagcagggctgagcgtgcagactcctaggaaccaggtcagtgtgcttggccctaccagcctctaagccgccttgcaggggaggaggaagggaaacctcaggctgctaggagacccggtccttccctcgggagcctgcagagatggcatccacgctcattttccccaagagccctgctgcgtctgcctccctgccttggactgagggggttggggctgcccagcagaggccctgggtgccaggacagtggtgtgggaggctggaggaaggggtgattgtctaatggtgtgagggaatgaaagtcatgatctagataaagaccaaggggaggggtgagcctgggacagggttttccagggagtgagagcagatgggcatgtgcaaaggccctgcacacgcaggagggagcttggcgcggtgaggctggaggagctgtggaggggcacatcaggggccggcgtcttctgagcagcctgggaaagcctgaagggcattagttggggtgaccatgctcctgtgggccaagtcaccctggacccagtgaggagagtggttggagcaggctggtgggagctggtgggagggctggtgacatgatggtggtagcaagcacgtgcaggggctggcggggacagcagcggaggcgggggcttggtgacgatgggcgtgcaggtcttcagatgtgagcagttgcaggccttccgggtagtagatggagggcagaggcagagaggtcacggctcaccctttgcctccttgacttcatcgatagcatggtgtgggcagccccggtcgagctggaatcaggcgccaccgttgctttcagtaggaggaggtcagcctcagaggcttctccatgctgagccacggggccccgttctgtcctggagctgggctgagcgacagacccaggcttgacgctgtcagaccccctgtgaaccccgccccacatctcagaatcctcttggctcctttgtctggggtcccgggatgacttgggtctgcctcactttcggagaggggaccaggagcacatggggctgcacaagaggttgaggcaagcgacctaccccccaggccctgctgcctcaccgatgttcgccacccatcctgctctgggcagcgctcatccaccttggtggcccagttaacagcgagtcgtgaatgggcactgggggtcctctgggtgctgggtggctttccacctaatggccgcccttccccccacagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtaaggctccaaagcctgccgrgaggccccggsgggtgcctggggttaggggtcacagctcatgatctgacatgtcctgttacttttctttctggcttttcattttaagagaattctgtgatttcaaatgggaaattgcaaacaggaagttgccagcataagacagaggtctcacgtacccctcgcccaggctcccckggccgtggcacctgtcctgggtgtagcaccctctcctgactggggaacatttgtttctcatgggctttctcgtggagccgtcatggcccagctccacagtrccctttttctttctttttttttttttttgagatggagtcttgcgctgttgcgcaggctggagtatagtggcaggatctcggcccactgcaacctccacttcccaggttcaagtgattctcctgccttagcctcccaagtagctgggattacaggcgctcaccaccatgcctggctcattttttgtatttcttttttgaaatggagtcttgctctattgcccagcctggagcacagtggcatgatctcggctcactgcagcctccgcctcccaggttcaagcaattctctgcctcagcctctgagtagctgggattacaggcacccaccaccatgtccggttatttttttttgtatttttagtggagacgaggtttcaccatcttgaccaggctggtcttaaaactcctgaccttgtgatccacctgcctcgggcttccaaagtgatgggattacaggcatgagccaccgcgcccagcccaattttttgtatttttaatagagacaggatttcaccatgttggccaacctggtctcaaactcctgaactcaggtgatccgcctgcctcagcctccccaagtgctgggattacaggcatgggccaccatgcctggcctccacagcattctcgctgccatccctgggttgccggccagattaggcagcctcggagggtggcagtgaacaccagctactcgggtttcctggtgattcccacatttgccccaggggtggcaggtgagggctgttgggccccatgggggcatttgttggggctctgtcatgccagagtttggcctgcgtgactttgcgctctccaggaggcatatggatgaggcggtgtgtctccgcaggtgaagtggagctggaggagtactacccggccttcctggacatggtgcggagcctgctggagggcagcatcgaccccacgcagtacgaggacaccctacgygagatgttcaccatccatgcctacgtgggcttcaccatggacaagctggtgcagaacattgcgcggcaggtgagccgggccggggtggggccggccctgaggacggcggaaatggctctaccatcatttcactccccgctcgggagggggcccgtggtcagcacagcaaacctatcctgttttttcttaattgagacaaaattcgcataacgtaaaattaaccattttgaagtgtacagtttggtaacatttggtacattcacaatattgtgcaaccaccacctctgtctagttccagaacatttcatctttccaaaaggagaccccatccccatcagcagccactgcccattcccctgccccgagcccctgacatccagtcaactgctttctgcctctgtatttccctcgtgcttcattcctttttatggctctgtaatactccattgcgtgggtagctacgttttgtttctatctcttggtggacatctgggctgtggctgccttatagagattgtgagcaatgctgctctgaacatttgtgtacaagtttttgttccgtgtccctgttgacaaacctttcttgaggttaaattgacaacatggaaaaaaccttaacccacttatcctgagggagggtgggaatagtgatttcatctgcgttggttttagtagtagcaaaaacccagsccccactgaatgtcaacacaaggaaactggtcacgtaaatataaacagcagacgtcccagacgagctgggtgtggttccaggacatgggtcctgcctggtttctgccagaatcattgttcatggtgacctccatttcctggtcaccaagtaaggctgttcatcataaagtggaaaaaaagctggaaaaaaaataatgccattactctcccacccagacacagccacgagaagcatttcagacaggacgtttccttccaggttttaaagactgcttaatggagctaaaatacccaagcagaaaagtccccaaatttgaagggggcagatggatgggcttttcatcaacagaacccctgcccctgtgtccccacccagccacctgccacccatggacacccacaaccctgatttctttttcttcttcttctttttttttttttgagacagagttttgctcttgtctcccaggctggagtacaatggcacaatctctgctcacagcaacctctgcctcctggtttcaagcaattctcctgcctcagcctcctgagtagctgagattacaggtgygcaccaccacgcctggctaatttttgtatttttagtagagagggggtttcaccatgttgggcaggctggtctcgaactcctgacctcaggtgatccgcctcccttggcctcctaaagtgctgggattacaggcgtgagccaccgcaccggcatcacaaccctgatttctacagagaggtagatccctggcctcgagctgtgtgttaacagcagcacacagcgcccagccgcatcctgggagcgtcattctgtgagattcctgtgttgagatgaaccggccaaggattccgaggaacgacccccgattccgtccacctgtctcctgaggacaggcatgggcggtgccccgtgggtgtgtctgcggtggccgtctatgtacatttctgctgctgcccttggggtaaggcacagagaggtgtgtcccgctgatggcaactttccgtttcctgggtcactcgtaccagtgctgtgcgaggccgcactctgtrtcctccctggggctcaggggcgtctctccatcagctgggagttcaaatctcggtgggctcacgttgcatttccctgatggcaaatgtggctggggccctgtcctttcatgrccgttgggacatcttttctcatggaaagctatccacggtgtttgcgcctgtttccgttgcgtctgccttgttggtgactgggaggatttctgtgtctggccatgaggacttagtgaaacccatagctgcgttctgacaccttcgcttcagccccctccactttccctccgtgtgcccgaaatgggtccctgcccatcaccatccacagcagtggccactccccaggtgagggaaacacgcacggggcagcctggagagaggacacccagggcccagcacrtggtgttggggaagtgacgcaggggacgccrgggggctggcagtctgtcccctcccccccccccaggctgggcacccctcatgggccatggcttcggggacagcaaccttgcttgtgacaccaggagattggaccagatggtttatggaaagcattgattaatgctttaaaaaaatcccccccttccataaacaactcctctagaacctgttaaaaacaaagcaatgaaaatggggctgtctggctggagctgtagtgagagccacatgctgccctgctgtcccagctgtggctgcaccacaccccagctgcatctccctgggccaggtgctcactgcgggcccctccacactgtttgtaacctgcctcgaggccatgtctggactctgcctccctttttcttaaaaattagcattgctgttttttagcagtagcagttggcattcagtgggcacttgctgtgtgccaggtactgtctgaaacctatgcgtgtccaggtgttattgtatccattcaacaaagctgcacatggaacccccaaggagtgtggtcccctgaccagggcctgggctgtgcaggcgggtgattcacacagccctgtctgccccacgatccctgctgtttccattccttccttcttcagtgcaaaggtaaaaggagtagcagtgtatttacagccaagcatttaggggaaaggaacagcctgcactcaggccaccttcagctcattcctgggtttgctttggaacatwtttttccgtgtcttttctgtgtgtttctcacacccgggcagggtttgctggtctggcctggtctgttttgttcaggtctggtctggtctagttttggtctggtctggtctggtctagttttggtctggcctggtctggtctggtttggttttggtttggtctggtttggtctggtctggtctggctttggtctgatttggtttggttttggtttggtctgatttggtctggtctggttttggtctggtctcatctggtctggtgtggtttggttttgatttggtctgatttggtctgctctgatctggtctggtctggtctggtttggtttggttttgatttggtctgatttggtctggtctggtttggtgtggttttggtttggtctggtctggtctggttttggtctggtctggtctgatctgatctggcctggtttggtttggttttggtttggtctgatctggtctgtttggtctggtttggtttggttttagtctggtctggtctggttttggtatggtctaatctggtctagtttggttggttttggtttggtctggtttggtgtggtttggtctgatctgatctggtctggttttggtctggtctgatttgatttggtctggtttggtttggttttagtctggtctagtctggtctggtctggttttggtctggtctaatctggtctagtttggttggttttggtttggtctgatctgatctggtctggttttggtctggtctgatttgatttggtctggtttggtttggtttggttaggttttggtttggtctggtttggtctggtctggtctggttttggtctggtttggtttggttttggtttggtctggtctggtttagtttggtctgatctggtctggtctggtttggttttggtttggtctggtctggttttggtctggtttgggtctggtctggtctggtctgtttggtctggtctggtctggtctggtctgtctggtctggtttggtctggtctggtctggtctgtttggtctggtctggtctggttttggtctggtttgggtctggtctggtctggttttggtctggtttgggtctggtctggtttgggtctggtctggtttggtctggtctggtctgtttggtctggtctggtttggtctggtctggtctgtttggtctggtctggtttggtctggtctggtctgtttggtctggtctggttttggtctggtttgggtctggtctggtctggttttggtctggtttgggtctggtctggtttggtctggtctggtctgtttggtctggtctggtctgtttggtctggtctgtttggtctggtctggtctggtctggtctggtttggttttggtttggtctggtctggttttggtctggtttgggtctggtctggtctggtctgtttggtctggtctggtctggtctgtttggtctggtctggtctggtctggtctggtcggttcggtctggtctggtctggtttggtctggtctggtcggtttggtctggtctggtctgtttggtctggtctgtttggtctggtctggtctggtctggtctggtctgtttggtctggtctggtctgtttggtttggtctggtctggtctggtctgtttggtctggtctggtctggtctggtctggtctgtttggtctggtctgcccacagcctgtcaggattctggtctcttcatccctgtgtcatgcactctccatcctgatgtgtttctggcctttgtcgacttcctctgtgggtgaggtggggactcccgcaggaggcggggtggccgcaccacctgctttcctcccgccagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgagaggaggcctggggctgggaacacgccgggaggcccggccgctcactccrctctggactcagtcctgggtggaccctggttcagcggctgggacaccggccctgctgcagagcccatgaggtacctttgacctgcaggaagcatcagggctttgggagggtggcaaaggcgggaggcgggtggccttgcgagcctgcgctgtgccggctgggctgtgccggcagtggaggctgtcagcgttcctgctccgcaggtgatgttcctgcagcgcaaagggcaggtgatcatgaccatcgagctcctggacaccgaggaggcccagacggaggaccctgtggaggtccaggtgaggccctggccccagtctgtgccacgcataccagggagcgcctgagggcagcagcatggggctcccaccagccaagcgcaggccgygcagcatccagagaccctccctctgcaggccacaggctctccttgaggcctggtgggtggggttgcctccctccctgctyccccaccaggctctcttctgtgccccctctccaaagagcagaccactcctcctgagcaagcggttgtgtcccagggcaggaggggaaccaagccacctctccctggcccccgactcccactcagggcatcccgtggctgtgacctctgcacctcttgtgtcagggctgcatcctgttcctaatccccagcagaggagccacctgggcccagctcccagtcacaatttttgcggggacagatgtttcctgctcacctcccgcatcctggtgacagtgaggcattgacccgtgtgtgtccccagggtggtcattggggcctgcagctcccggcacctgccaacaggtccagtgtgtgtgcacattactcagctaggccaaccccattcatttcctggggctaccaccacaatgaccacaaaccacgtggcttcaaacaacagaagtctattccctcaacgtcctggaggtcagcagtccacaaccacagtgtgggccgggcggtgctcctgccaaaggctctggggcggatccttcctgctcttccagcttccgggggcttctggcgctcctcagctgtggcctggttgtgtgagtcccgctgtcactgggtcctctgtcaagagctatagtctgttggggtctccgtcagggatcagagtcctctgcagcggctctcctcatgctctggcagtggggggcacagaacccctgtgagctcctgaactcagagtccagagtaagagtggccatagccctgctgtaggggcatcacgggctgtgtctctccctgtccccagcacctggctcggtacgtggagcagtatgtggggaccgagggcgcgtccagctcgcccactgagggcttcctcctgaaacctgtgttcctgcagaggtaagrggccctgagatgcatgctcygttccttccttcctgggcccagggagtgtcccctttgtcctgacgggggctggaccatggcacactgtctgggagcacttagtaggtgcctgctgtgtgctgaggcaggccctgcccttttgaggcttgtggtttgcagtggagggattagtaaccccaggacggtgaggtgtaggaggggcaaggccaaccccacgatgcgtcagtgggtgaagagtgaatgcccggactggagggagacgctgccagagctggtggggccaggccagaggcgggtggctgtggcaggaccctggaccacctcaggtcrggctaggatggcacctatgggaccagtgggggctgctggtgggtgttcagatctgggggcatttcttgttgcttccatttgctttctgtggacccctgggaggtagcacatcttctgatggtcccaggcctgggggtttcccagcctgcaaatcctcctcccacaatgccgagagccagagtccattccacctcctttcgcccccaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgccaggggaggcctgggctgccccgacatgcccctcctsaccccaagtcctggggccctgggggtccagccctcagctgccctgacacccggcctcttcaacaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacaygcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtrggcccagaataaccgccacccttgccatcctgcaacagctggactcaagtttccaggaagtggagatgtgtttctagaagtttcctgtggaacctggaggctcctgaygcctttgactccaggctgggcgattccgatgctgacccgtcctcctgggctccccacccccgctccccaartgtcacacaggcactttgtacacatcctggttttctaagaagggaacttgccatcaagattcctgtaccaggcccacggccgtctcgggcagagccacctgggccccrggtgcagccggagaccccgccgagcccctcctcccagtattcccatccccgcatgcttytagggagcgcctcttttccgttcttgaggaatttctgttctggggcttgtccttcctttgcagctgttttgaatgtagttttccttttctatttatttgcacattaaagttaataattgaatattgacatcaagccgtgagggtgtgttgstcttcctgtgagagccttgctgacttcctgccaccaggtcagtgggctggacccatgagagcaaggggtggctgggtgtgcctacctgggaccaggggagtcraagcccctccttgaaccaagatcatctcacaccctgcacctgccccgccacgacatgggagtgtcttctagaatattctttccccattccatttgcacatttagtgggaattagaagcgtctccttcgcccgagtgtctctcatgcagaacccaatttaaagatcatggtgtttgctctaaggtgtttgttctaagcttcccatgcccaacctatccgtccaggcccatgcctgcccacccaccccacacgaccaccctctgtactccttggggccccacccacttcctggctttcaccatcattttctcytcatctcctgccccctgtctgcatcccaagctccacacctgcttccgggtagcagaagccccagctctgctgtgtcccctggctgacatacctggagggttccaaggcagaagtggccagcccctccccctcagtatgggctcctccatcctctgtaggggaggggccatagcttcctcccagtgacccatgtgctccctgtacacccaagcgtctctggcagttctgaccacacccccaccggagggtcagrgctcccagggagcgtggcaagccagaccggaggccgccctgtttccttctgccttgatcccatggctggggatgcccagggtcctctgtgggcccccagactggctttcyttggtcagaagtgctgcaggggctgggaaaggctgtgctggtcccaggagagcagacaaagagcagatctccgaggtggccctgccctgaggggtcccctgccctcaagtagggcccatggccttgatgaggtgatatgacatgagttgagagaggttcctcactggccctgaagatgtctccgctgtgctggggaggggaccctgtggcaagggacagagagtggcctccaagagccaagggggacctcagagccaccactaccaccrggacccaaattctgcccaagtccacttgggcccagaaaaggcccccgagcagcagataaggacacagcccagctgacaccttgatctcagcctcatttgaccctgaaccaaagacccagcctcccaggctggacccctgacccacggaaacaaaaggtcatagaggcgtgtggctgtgagccacattcattatccagagatagatacagcagcattaataaagccgctgcatgtccagcacctccccttccacctccgtcaagtacggggaggtggctgagggtctcaggaacccctactgaggggggaaatgaaagaaaaaagaaaaaattaaaaagagaattaagcttttcctgtattaggctgacttgtctcagaggcagcaacaggcacagcccagacccaggaaaagtcttaataatactaagaagccaagacacaaaggaatgtgctctggagcctctcccagcactccctcaacatagggagaagaaaaacaaattttcctttgtttcatggtatgagtttatagattcctgctctctacacctagtgacttcaaatattctgttttatcagcagtggagtgaaggtcataaactgtctgagcagcctgagatagagccacctgggtgccatagtgatggccatggaataagccatgctaagcactagggcaaacctacataatggccatctgagttgcacagcaacggtcatgtctaatcctgagttatgagcctgttataatttgattaactgtctttgtcctgcctctgtatccctgctttcacgccactgtaagcctgcttcaagctaacccacccctttttaaaagtgtgtttaagtcaagtgctgtctttattctaggcccagtttttagacgttgagtccrgtgggtctgagtgcactcaataaagatcctcctgtatacaccccaaggtctctcttttcctcctgtttccacaacactacatgtgatgctgacagagggtgctgggacaggggcttccagtggggccccatgaacatttattctgttgctagtgaggtgtttgtctcactggcttttgcaacatataaccagtgcttcccgcctgatgtcctcacttgctgagaatgaggctaactactccaaacagcaaactgaataccatccagcaatcacgttcctttgtatttgcccaaaggaactgaaaacttgggtccacacaaaaacctgcacaagagatatacgcagccttattcaccagtgcccaaactcagacacaaccaagrcgtccttcagcgggcaaacggataaaccatgtcacctccagacaacaggatataaaacgaaatgagccatgaagctgtgaagacatgaaggggccaggcgtggtggckcacacctataattccagcaccttgggaggctgaggcaggaggatcacctgaggtcaggagtttgagaccagcctggccaacatggtgaaaccctgtctgtcctgaaaatacaaaaattggtcaggcgtggtggcacgcgcctgtaatcccagctattccagaggctgaggcaggagaattgcttgaacctgggaggcagaggttgcagtgagccgagatcacgctactgcactccggcctgggtgacagagcgagagtctgtctcaaaaaataaaagacacaaaggggcctcaaatgcatctaactaagtgaaagaagccagcctggaaaggctgcacactgcrtgattccaactatagaacactctggaaaaggcaaaagtatagaggcagtgaaaagatctgtggttgccagggggcagatgggaggaagtaatccataggtggaggtgggaggatttttagggcagtgacrcaactgtgcgacactatggtcaatggtggacatatcatgacacatatgtccaaacccatggaaggtacagtgccaaaagtgaacccccatggaaacgcggggttccagaagacagagccgtgtccatgcagctttgtccrttgcaacaaaggcaccgcttttggtaaaggacatagatagcgggggaggcttgcatgtgtggggtggggttacatggggactctgtaccttctgctgaatttcactgtgaacctaaaactgctctaaaaaataaagttttttttaaaaaagcaatttgacccaaagtcagtctcaggaggccagggggtgggggacagaacaggccagggcaggaacttgcagggacgggtgcaggcaggctgaggtctcaggaatgtgtctgcacctctgtggtttcccttctcttcttcccttctggggacctttgcaatctgggctggctgctgggtcccgcctaggtttcagattctgccccaccctgaggttggccagtcccttctctctgtggctctgggagtggagcctcagcccttggtacagtggagcaaacaaactctgatttggggccccagagaggaagcgctgggaatccaggggttggacaggctggaccccaagccctgcttccaccatggctgtccgtgcgaccctgggagtgactgtcagtcctggtgagacagggtcacagcacctgcctctcatggccattcaactgggttaatgtccctgcccagccagggaatgagaggaggtggcaccatgtttgctgctggagtgtaatggcgcgatcttggctcactgcaayctccacctcccgggttcaagcgattctcctgtctcagcctcctgagtaactgggattactggcacgcaccaccacgcccagctaatttttgtatttttagtagagacagggtttcatcaaattggtcaagctggtcttgaactcccaacctcaggcgatccgcctgcctcggcctcccaaactgctgggattacaggcatgagccaccgcacccagcctgcccatgtggcttctaacttgttccctgaccctgaccttttgctggaggcagtgaaggcaggagagagtggaggccacatccaggagcttccagggacctgaggggttggaggacaatgaaatccaggacacgccactgacttgcgcctgtctgccaatttttccccatttaaaaaagttatttaaagggccaggtgcagtggcttacacctgtaatcccagcactttgggaggctgaggcaggcggctcgcctgaggccagaagttcgaggtggtgaaactccacctctactaaaaatacaaaaattagccgggtgtggtggcatgcacctgtaatcctagctactcgggaggctgaggcaggagaatcacttgcaccctggaggtggaggttgcagtgagcagagactgtgtcactgcactccagcctgagcaacagagtgagactctgtctccaaaaaaaaaaaaaaaaaaaaaaaaagttatttgaattgtggtcaagtttatcttaatgatttttaagtgttcagctcagtggcagtaagtacattcatattgtcaccatccatctccagaactttttttttttggagacagagtctcgctctgtcaccaaggctagagggcagtggcacagtctctgctcactgcaacctctgcctcccaggcgcaagtgatcctcccacctcagcctctcgagtagcagggaccacaggtgtatactaccacactcggctaatttttgtatttttttgtagagatggttgggggggtgtctcactttgtggcccaggctggcctcgaacccctgacctcaagtgatccacctgccttggcctcccaaagtgcagggattacaggcgtgaaccacctcacccagcccagaactcttccatcttgcaaaactgaaacactgtggccttaagcactcactccccaatccccctcccccagcctctggcaccccccaacccattctacttcctgtctctatggaggtgaccactccagggacctcccatgagtggaatgactcaggatttgtctttccgtgaccggcttatttccctcagcataatgtcctcaagattcatccacaatgtagcatatgtcagaattcccttactttttaaggctgcctttttttttttttttttttttttttggcagagtttcactctgtcacccgggtgggagtgcagtggtgcaatcacagctcactgcagcctcgacctcctgggctcaagcaatcttcccacctcattttttgattttttgtagagacaagatttcactatgttgcccaggctggtcttgaactcctgagcccaagcgatccctctacctcggcctcccaaagcactgggattacaggcatgagccaccactctgaaacagcccggcctggctgtctgccctttttaagaaaataagattttggccgggcgtggtggctcacgcctgtaatcccagcacttcgggaggctgaggcgggtggatcacctgaggtcaggagtttgagacctgcctggccaacatgatgaaacctcgtttctaccaaaaatacaaaaattagccaggcatggtggcgggtgcctataatcccagctgctcgggaggctgaagcaggagaatcgcttgaatccaggaagcagaggttgcagtgagccsaaatggcaccattgcaccttcagcctgggcaacaagagcgaacctccatctctaaataaaaaatattttggccaggtgcagtggctcatgcctataatcctagtgctttgggaggctgaggcaggtgggtcacctgaggtcargagtttgagaccagcctggccaacacgacgaaactccgcctctactaaaaatacacaaaattagccgggcatagtggcaggcgcctgtaatccctgctgctggggaggctgaggcaggagaattgcttgaatccaggaagcagaggttgcagtgagctgagattgcgccattgcactccagcctgggcgactgatcgagactccatcttaaaaaaa

SEQ ID NO: 12496 - DNA, 71165 bp, Homo sapiens
ttggtgaggcagagtccactgagaatgtcagagtcaatcttcgctctagaatgagtctaattccagacaaatgttcataatttccatacatattccatctggctggtcagaaggaattaaaatgacaaaagcctttaatgacctgcagagtcccctccttgggcatgctgggatgcggtggcagcagcaggagtcaggacaccggagagtcagagcagcgccgcagttaggagcatgggttctgcagctggtctgacccgggtttaaattctggttgcacaacttactagttgtgccagtcagggccattactgaacttctctgtctcagtctccttgtctctaaagtggggataaagatggtaacagctagcacttgacaaacactggccattatgtgtgggtcattgcctaagggcttcacatgaataaattcatttcatcctcaccaccaccaggaggcagttactattccacagaggaggaaacctggacctactgtgtagtgctagtgtgaagattactcaaggaaaggcatgtgacgaactcagcacagtacctgggatagaataaatgctcaataaatattagtcactgttattatgatcatcattattatctaaaattaacaatagttctagctcttcctctcaacttgctataggatcttaagaatgtcgcttctcacctcccagcctcactgttccagtccatcaaatgagaggtttgatgagatgatctctaaagtctcctttagctctacggtattagcagtcactgatctttttttctttctttttttttgaggtggggtctcactctctcacccaggctggagtgcagtggtgcaatcttggctcactgcaatctcttcctccctggctcaaatgatcttcccaagtagctgggaccacaggtggtcctaccacacctggctaattttttgtattttttgtgtggtaggtgccctaccacacctggctaattttttgtatttttggtagagacagggtttcatcatgtttgcccgggctggtcttgaactccagaggtcaagccatccacccgtcttggcttcccaaagtgttgaagttacaggcatgaaccaccacacctggcctctctgatctttaaaaaaataattttcaataaatcccagtaatcagatgctgcactgataggtatttaggaacacttaaatttgtcattaaaatccccttgttaaaaaaggtgcattccctttgacctattcgttgtacctatatgactatatctaaggaaaggatcagagatcagcacagagatttacactccaggatgttcatggtttacagccactccagattagagacagcctgaatatccagcaatgaggatctgttgagcaaattttgacacagcagctcaacggattattgggcaatcattcgaaaagtatgctttcagtcactacttgatgatatggggaaatattccacaagtaaggtcaagttaaacaaccaagatacaaaactttatgtgcaatgtgaccccaaatttataatactagaaaaaaacaaggagatatactgaaatccgaatgaaaattatctccaagtaatggagtaggtgatatacatacatacctatatatatatatactttttttttggcatcagggtcttgctctgtcacccaggctagagtgcagtggtgcaatcatagctcacagcaccctcaaactactcttaggctcaagcaatcctcccgtctcagcctcctgagtagttaggactacaggcacatgccaccacacctggctaattttcaattgttttgtacaggcggggtatcactatgttgcccaggctggtttcaaacttctggcctcaagagatcctcccgccttggcctcccaacgtgctggaattacagccatgagccaccacaactggcccagagtaggtgattttttaaaaatcaaatcttctaagtgggaatgcattccttttattctataccttttatggtgtttctctgcctccctatttttatgtattttaatgagcatctcttttttttttttttttccttttgagacagagtctcactctgtcaccaggctggataacagcggcaccatctcagctcactgcaacctccacctccttggttcaagtgattctcctgcctcagcttcccgagtagctgggactacaggtgggcaccaccacgcccagccaatctttgtgtttttagtagagacggggtttcaccatgctggccagaatggtctcaatctcttgacctcgtgacccgcccacctcccaaagtgctgggattacaggtgtgagccaccactcccggcccatctcttgtcttttgcttacacattcccttgtctgtgtgaagagcctgcctgtttctaccagtgacaggcatgcagaccccatacatatctgttagccaatgcagagcactgtgtaacttccttgctaggaaaatacaaattcccaaaccccaaaaaagcccttgccttgtaggagaaggaggcctcgcttacggcgctggagctacttgtgggaggcagctgctgcagcttcagggctgcgctgtgggatccgtccatggtggtctagtggcgcatcccacagggcctggcctaggaggtggagctgctgctaggcggggcccaggccagatgccatctctccttgtggtgttcacctccctccagcagccgtcacttcctcatgacaaaagaatacttcaaggctgttttggcagatttacagccttctcctcagcttcactcagagaagtgccaatttccgtggctctcccaggcagacagagaggggtgtgttttccagttcttgcggtgctctagggtggtggagaggaacattaaaaatgcatggacaaggaaacactgagcccagctttgttatctgagaagagaataccattcagataaaacgtaaccggccatgacaagtgagtccattaaaaaaattcttcaaaattcaattctagcagttaaaaacaagtcctatcatgcctttgtcctccccttaatacaaacctgactcatctatctcaaaagctttctccctggcccttaatgttccctttcctcctccactctgcttccttcctcccatcgcaccctaacttaaatcctccctttttccatagctcttgagcacaagaagtagaatactaacttctccaggtctcaaaaaaaaaaaaaaaacaattccactaccacgaaaagggaactatttaagtttcagcttaggaagaaaagaatcagaagaaaagctacatccatggaaaacagaagaactggcctgctaccgaggattggcctgacacaggtgaggtgacactggtctcggaggtggaaaacctgtgtgaccaggtaactctgcctctcagagattcagttgcctcctctgtaaagtgggggtaataatgtggcctcaaataaacccagcaatgatgagaatccctactaatttcatcggacttatattttcagtgcttcccgagcttttcctttttttggagacagaatctcactctgtcatccaggctggagtgcagtggcacaaacatggcctcaagctgggctcaagcaatcctccctcagcctcccaagtagctgggacctcagacgcgtgccacaaggcctggctaatttttttgtagagacagggtttcgccatgttatcaggctggtcttgaactcttaggctcaagcagtccacttgcctcagcctcccaaagtgctaggattacaggtgtgtgccacttctcaaaatttgctaccaaacagagaagagaaagtatacttctagtgtcctaggaggcatggccaaaaccctgcttaaaagtgttagggttttctttgaggactttttatacattttttagaaatgtattctactgcatagtctatgtttattttaatagaaaaatgttttaaattgcttttgatgtgccatgtgctacctgttttacctttgccaggtcatttaacttttcagccagtttctccagctgtgaaatatagataataatgttcccactccacatggcagtcatgagaatttgatgaaatcatacatgtaaaatgcaggcatagcaaatggtccatgaatgtgagctgctgttaagattaattttattctctcctgtttaattatttattttgtccattcctttctctctcatgcattcatccaacaaatatttactgagggctcactgtgagctaaacaatttctgccactccctgaggcttcagagagctgcctcctgtgtatcctgtagcttccagttccttctgctatccggccctaggcccaggaattctggttcatggtgtggacagcacatacatatgtgataaggggaacaccatgtccagtcctgggatacaacaaatgcaggtttagcatagggacagctacagaaaccatttggcttggtttcactttgtcagagggcctcaggatgaaattattgctactacctgcagacgaggttatatatccaatatacagacatgagatgtaagcattcaccgggtaactttatcaggtaattcacatcccatagctagacttccctgcctgtaaaaccctatgaatatgtgtttgcaatcttgtggaaagcataattgttcactatactttcacgtacatgtgaaaagcattattgtgttacatttctgtaaaaatgttttagcatttgtaataatcataagagccttaagagtggctcagggttctttctacctctgagaggccccgggaagcattcaaccatgaagcagtcatggagttgaggagcgcaaactccagtgaggtgtttgcggaataccctgttcagttgctcccagctgagatctagcccagagcctgacagtgacttctatacataccaaccaactgactaaatgagatctagcccagagcctgacagtgacttgtatacataccaaccgactgactaaatgcaggctggttaagcactgggtgcactgtggccccttcgcagtcaagaatgcctttctaaggcctaatcaaccacaactccagagcttcaacaagcagatatactcagccccacccacaggaggtcagagaaagccaacagaccttagcgacatgtcaatcaagggagtggtgggaacccaggcctcctaacatccttcagagtagtttgcccaagtgcttttctggttttgcttttgtttgtggtggttggcattgctgtggtttaatttttcttttaaaaagcagcttccctctctgcctcaggaactcgcaggcctctgaagcatcgcctgcaaagattgaaggctctccctcagctgggtgggagtccggactgaaagcctggaggaaccctttgcaagctgtactcccttataagacacatacttttcacctggtgactctcttttcctgatttcgaagcatttcttcaggacctacatatgcccgagaggcaagcagtcacctctgcgttgtcaaccaccccacaattagagcacgtggtcactgacccaaggaaggaatgagaattcactaggtgctctgcttccattcccaccccgtttatctcgatgacggatttcaccaatcccacagagcacgttttacaaatgagacagccgtggctcatagcgtctgtattcgaatttgcctctttctgaacaaatcaataaaacacgctctttcccaccacccgacgatctggcttctggaggtgagcgccagttccctgccaagcttcccgttcctcggctttggctcacgagaaggttacattcttccgtcccgtcccactgagctggaaacttacaactcgaggagacagcacctctgttccagaagcgggcttagaccaagaacgcctcccctcatcccacctgctaactccaccatctgctgccgccaggaagcccgagccgctcggcacgaagaggagaaattctggcaaagttaactccatgtcacttcctggtttggtagagcctggcatcacctttagtaaggtagcccatgcccccgctcctcttggcctcgatgcaaaactggaaagaacattccaaggcaacgggacccaggttggcgaggctggtgacagtaagaaggaagggtatgtacactaggggacgttaggtgacttcgctttttccagaaaaaaacgaaggttaaattcaattccccttcctcccggtgttaatcactactcaccggcggcgtctcctctaaggcccacctatcaaaaccttctgagaaatgactcggactcttcgtgcaacccggaggcacagcctccttcatcccttcccaattcagagctgccaagatgctgcagtgttttgmtttcaaaggtcgcgatttgatttgccagactgcctgccagtcagaagttggcaggcatttcgcgcaggcaagtggctgcgaggacggggagtaggcgggacagcccctggcaattggctgcgctgcaaagcttgcttgaagcataagggarcgacctggggctagagcttggcgctcacctggagcggggaccccctagcggccacaggaagaatggtgcggcgactcccctgccccctctcccgctgtcccagagagcttaggtggttgctcgcctccacctgcccggcaggtgggcctggttttagcagcctgccaggtgtcctcccttcttatcctcatagccaccttccgggctttgctcctgctgttcccctacccgacgctctcaccaagtattcaaatccaaaacgtccttgaagacccagcgctccccagagcccycgcgagacttgggaccaaacatatctctcctttcctgccctcctggaacacctgtcggataccaagcctcccagcaatactgaaggtcctgaaacgagcccagcgcttggttaatgtttctataatgtacataattatcacggccatgataattaacatgcgcatggagttttacagatgacaagcttctcatcgctcacacgttgtcatatacacgcatttgctttcagatcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgagagatttttctgggggcgtggttgggcctgcgatctgagggacrggccagggacagtttataaataacatatttgggggccggcgcggtggctcacacctgtaatctcaggactttgggaggccaggaggatcacttaagcccaggagtttgagaccagcctggacaatatagtgggaccccatctctacaaaaaaatttaaaaattagccrggcgtggtggcgagcgcccgtggtcccagctactcaggaggctgaggcgggaggatcgcttgaactcgggaggcggaggttgcagcgagtcgagatcgcgccaytgcactccagctgggcgacagagcaagaccctgtcaaaaaaaaaaaaaaaaaaaaaaaaagcttggatttcaccctaaatttaaaggcgagccattggaggactttaagcaggggagtgacaaggtcgctgagaccgccctgccctgaagcgtgtgaagaggggctcctggaatactaagtggctgcccttgtatagtcgcccatgtcaatttttttttttttcttctgttagaaacagggcttggggccgggcgtggtggctcacgcctgtaatcccaacactttgggaggccgaggcgggtggatcacctgaggtcaggagttcgagaccagcctggccaacgtggtgaaaccctgtctctactaaaaatacaaaaagaatagcctggcgtggtggcgagcgccggtaatcccagctactcaggaggctgaagcaggagcatcgcttgaacctggagggcggaggttgcagtgagccaagattgcgccactgcactacagcctgctcgacaaagcgagactctgtctcaaaaaaaaaagaaacagggcttggatgaatgttaattcttttaggtatattccttgaagcaggatttttgagtgagcaaaattctgaggcttttggtttatcacaagatttttgaagcatggcctagataaacctcttattagttccccaccccgctacaggccctgatgtaattaacctaagccctaaaattcggccggcttctctgcggactttgaaacgcctctaatgattggtcaacaacttttcacgttaaagaaacagaggatgccattggctggagttacctcgcggacggcggaaggtggactcgcgaatgttaggccwgtgggtgccatagcgaccgggaggttgggctggccagattcagctgccgggaccggaccaggtaggaagcagttccggcggggggaccggtccctgaggtcgtggggaagagkacacggcgcaccatgtcctccgcatgggacgcccgcggagaccccccggcctccgggtgcttgcggaattccagggctgagctaggtggagccccgagggcgggaagaagccaccatgggagttgcccctgcgtcggggcgtgtcctcggtrtttccacccgaaaagtggtgacaactggggcttgcctgctccaccgagctcctgccaggggcgtgggcgtccgacccttctggctcaggctccgcgagtgcgcaaaagttgggaggcttcagtgcctggcagtgggtggacgccaaagacctgatctctactcataggttcaccccagctcagggggtgtcccccagcaaacgacttccctgctctgggcctcgatttacccatctgtaaaataaaagggtgagattggaacctggtggtcactagcccgccgctaaatttccttccagctccctgatacactttctcagcctatgaagactatcgaatgggttatttacctgagagtgctttgaaaaaatgtaagctgcttccaagatgcttataactgagtagataaaaatcgcctacagacgaaactactcaggacatccaaaaaaattctatctaaagtaacagtatacatagtttagtacatgtttatataccctgtacagtaacatgtataatgtaaactgtaatacttagcatatataacgttttttaaaaacacaagagatgataaaatgaaactgtgcctatagttgtgatcatgtgagctgtccttgtagaatctaactcccgctggaaatatattctgagcacagctgtacacacaattgctaaaaggtgtctacctctagtattcattcattcattcattccaccaatatttatgaagaaaatactawttttaaaaattctcaatactattattattatttttgtagagacagggccttgctatgttgcccagggtagtcttgaacttctgtctcaagccatccttccccctcagcctctcaaagtgctgggattacgggtgtgggccaccatgcctggccaaytgagcaaatactgtatgtgaggaaatagactgaagattcagagttgaactttctactggggaagatcataaacaaataaagtaataaacatacaatataatgttgggtagtgaaaagtgctttgaaaaagataaagcagagtaaggggctagagagagatgggttggtgcttcttaagagagggtggtcagggaagtcatccctaagaaggtttgagcagaragtctcgtgaattttgtgacaggactgcaggacgatgcctgggtccggtgaggaaaggagctccccatgcagcaaggagatatgtggcaaaagccagggaggtcccatgtggagaagaagattagtctttaggtggtggggcacgacaactgccttcaaattcttgcagaatagtcatatagaacagtggctttcaaaccttttgactgtgactcatggtaaatgcattttatattgtgacccagcatgcacacacgcatatgacaaactaaaacttcacaaaagactacagactatgacttgcattttgaaaatcaccaatgtggaagagaaatgagacttactttgagttggttccaagggtgggaattaggacggatagaaaaagaaaaaagagagagagaatcagctttgatacaggaaggaactttctagcaattagaactgtccaacagtgaacttcccccaggagtttttaaactgtgttctgatgaaacctagcattctgtgaatattcaagagagtcaaatatttgcccccacccagccatcccttatttgctttatattttgaaaactatatgcaatattgtaacttcagaaacccaaccaggtaaggcacggtggctcactgtaatcccagtgctttgggaagctgaggtgagaagatcacttgaggctaggatttcgagaccatcctgggcagcataggtgagacattgtctttacaaaaaattttaaaactagccaggtgtggtggcaggtgtctgtagtcctagctactctggaggctgaggtgggaggatcacttgagcctaggagtttgaggttgcagtaagctatgattgcaccactgcactctagcaagtggacgacacagcaagatcctatttctaaaaataataataacaaaccaatcatacccactcgggtgctaaatgtcaaaatttagcaagttaatatttagtgtgtgctgcctgagaggttattatagaggttaaggagtgagtagaagtcagacttcctgagttcaaagcctgattccacttttcttctaatgtgactttgggcaagtcacttaaccccccaccaaacttaagttttctcatctgtaaaaagtggggattatacctcactggattattayaaaaattgcataaggtattccatagaaggcatttaggactgtgcaggctcaataaatgatagctattattttaagttgttaatacgatatccctgtgcgtatattaaaaccctacattaatacaagcctactgcaggataggcagtgttaaccacttcacatggatcagcctaagaggaaggtactgttatcactcccagtttatggaggaggaaataggctcagaagtttaagtgactcatcgagaatcagagctattaagtggcaggccataaccttgaacccaggactggatactctggactgctgcgctggcccccacgtaggaatcgcttaaacatatgttgttgattcggaaagtggtatatcttcactgctctttcttagattctaggtccatgccatcctgtcatggacagttatacaggtggaccagtgaggcacacctgggcagtgctctgttcacatctgtcctgcacctgctctcatcctgccttcacaggtatgcagtgagaagactggaaagcattattaacagtgtggtcttttggtggtaggattggggattgttttttatttgtttgtttgtttgttttgagacggagtctcgctctgttgcccaggctggagtgcggtggcgcgatcttggctcactgcaaccttcacctcctgggttcaagcgattctcctgcatcagtctcctgagtagctgggactacaggtgcacgccaccatgtccagctaatttttgtatttttagtagacatggggtttcactgtgttagccaggatggtctggatctcctgacctcatgatccgcccacctcggcctcgcaaagtgctgggattacaggtgtgagccacagcgctcggccatggattgcagattgtttaaagtttttttgtaatttatcatattttcttaaatgttgacagtgtacatacattattattatagtagtcctcccttattcaagggggatatgttccaagaccaccagtagatgccagtgaaacagtggataatacccaaactgattactgtcaatcagactgtttctgttcatatcttccactcacaaatttaatgctttttccatcttaactaagcacttatcatgctctgtggcaacagctttttatagtttgaggtgaagcaccaaaactagcaccaatttttttcccctttgaaatttgatggatagaagttttattcttactgtagatcttagcaacctcagaatacagtttttttcttgccttattaagtcaagaactttcaccttttcacataaaggaggcactttacagcttgtctttggcatgtccaaagtgctggcatcactactcttgtgctttggggccattattaagtaaagtaagagttacttgaacacaagcactgagacaacgtgatggtggatctgacaatcgagatggctactaagtgactaatggtggggtagcaaatacagcttgaatgtgctggacaaggatgattcacatcccaggtagggtggagtcagacgataggagatttcatcacatgcctcagaatggtgcataatttaaagctgatgaattatttatttctggaattttccatttaatattttcaaaccacaattgaccatgggtaactgaaactggaaaataaagctacagacaagggtggactactgtaaaacaggaagcttaatatttttctaatcactcataattccagaacactaatacattttttaataacagctttattaaagctagggcagtagatggttcttactaaaatggtataacactgaggggtggtaaatgaatagtgrctgctttggttattttttgagacagggtctcactttgtcacccaggctgaagaacagtggcacgaacatagcttactgcagccttgacctcttgggctcaagtgatcctcctgccccagcccctaaggtagctgggactacaggcacatgccaccatgcctggttaatttttatattttttgtagagacggactttcaccatgtttcccaggctggtcatgagctcaagctatcgcctaacctcggcctcccaaagtgctgggattacaggagtgacccaccacacccagccctaggggctgcttttatagatactaaaagaccttgttaagctggattggtgattgtgctttgatcattattgatttgtttctgttattttgaatctcttaatttcttgaagaatgttgtcaataattctattaaatatcaaatttttagtatagattgtccaccaaaaaaaagttgaaaattgctgctgtgaggattacagaataaagtaagraaaaatactgcatggaaaaggaccagtagagtgtaaaatcatttattcaatcctttactcattagtatatataaatggtataagttccttagggaaaaaaatgggcaaaatgaaacccaagtctgctaataaaaaataattgctatggaaattaaattgtgcccttgctattaacaactaaaaagtagttaaatgtgttaaacaactcacattggacaacaggcacagtacaataatccctgaaggaagaaaaacacggtgagtcctacaattgcccccatttagtactggggtcagtttttaggccatattgtaggaaatccaaatgaattctagatttctgagttgagaagataaaaataagaattcagagaggccaaagaggctagaatttatagggagaaccctaaaggaaggagctgcaccaaaaatgttcagaaacctgaagagaggtctccttaagtttttggctgagcagtaatctgcacatgcatgagaagaaactaagactggggaaatacccatcaaaaggccataggctgaacaatttctggggcttaaacagaactgggaatgttgcatgttaccataaaccagaatgcagagacatggtattagataggaattgggtagagttcacagaaatgtcatgccttagtagtggggataaattattcccagaataaaagctgctctggacttgccataacaaagtttaaaagcttgaaagggtcagatggatctacaagttactgaaaagtgtgccacatcctttgcaggaatatatcaaaacccagcacccagcaatgtaaaattcaaaatgtccaatatctaatacaaaattaccagacatgaaaaggaaaatatgacccatatctgagaggaaaatcaaccaataggaacagacttaaaaatgacagattatagaattagtacaaagaaaccttaaagcagctactatgaatcttacaaatatycctaaggatgtaaaggaaactgaacatgatgaggctagaaatagaagacatagaaaaagagcccaaatgtaacctctagaaagaaaaaatacaatatttgaaataagaatgcaatggatgggatttgcagctgatgagacttcagaagatcagtgaacttggcygggcatggtggctcatgcctgtaatcccagcactttgggaggccaaggcaggtagatcacaaggtcaagagttcaagaccagcctggccaagatggtgaaaccccgtgtctactaaaaatacaaaaattagccaggcatggtggcaggcacctgtacccagctactcgggaggctgacacagagaattgcttgaagctgggggcagagggtgcagtgagccgagattgcgccactgcaatccagcctgggtgacagagcgggactccgtcaaaaaaaaaaaaaaaaaatcagtgaacttgaagacatgacaatatagactacccaaatgaaggacagagagaaaagagacttaaaaatattgaacagaatatcaataacctttgggaaaatatgaaatgatctaatataactgtagccccaggaaagaaggtggcagaggcagaaaaactatttgaaaaaataatggctgaatattttccaaatttggtgaaaactgtagcctacagattaaagaagttcattaaaacccaaatattaaagacataaagaaaattatgccaaggtaccatgaaaataaaattgctgagaggcacatagaatagtcaaagtaatagaaatagaaagtacaatggtggttgccagggattgcagggaaaaaggaatggggaaatactgaggaaacaccatattgtaggaaatactggggaagtaccatattggttaatgggtatagcatttcagtttttcacaatgaaaagatttacagagacggatagtggtgagggttgcacaacattatgaatttgaattccactcagctgtgcacttagaaatggttgagatggcaaatttttatgttatgtgtattttaccataataaaaaattaggaaaaatcaaattgctgaatgaaagtgatacacagaaaagcttaaaagttgatggataaaaaaagaattattactgacagaggaatcaaaataagcattacagtggacttctcatcagaaactatgcatgtcagaagacaaaggagtaatataaaagttcttgggagaggtaggaagagaaaaaaacctatgaacccataattctatactcagtggaaataattttcaaaaataaaagaaaaataaagaccatttcagacagacaaaaacctagagaatgcattatcagaagacctgcactgcatgaaaagttaaaagaatttctgtagatagaaggactatgacactagaaagaatcttgaatttacacaaagaattgaaaagcactgaaaatgataaaatacttttttcttattttaatttccttaaaagataattgagtgtttaaaaaaatatgagattaataatatatgtagaaataaaatgtatacaaaagtagcaaaaaggatggaaggtaggaaatggaagtgtatttttgtaaaattcttacattatatgtgaagtaacatactattgtttgactgtgataaattaaagatgtatactgtaaaccttaatcactatacataagtatagctaatatgtcagaaatgaagataaaatgaggccataagtaatatgcacttactctcaaaagatccaaaaaaaagagacaagggccaatatamcaagtaggaaattgataggtttaagcccagccatatcaagtgctacattaaatgtaaaagttctaaacactccaatcaaaaggcagagtttgattagattaaaaaccaggacctaatatatgttttctttaaaaaaccatctctaaatataaagacacattcctgcaagcagaagtgtgaagaaaactcaataattaaatataaagacacaagcaggttaaaagtaaaaggatagaaaaaatatagtgtgctaatagtaatcaaaagaaagccaaaatggccatgttaatatcagaaaaaataagacttcagaacaaggaatattaccagggctaaagcagggtatttcgtaatgataatggggtcaattcaccaaaaagacataaaaattataaatgttcatgcacctggtaatagtgcttcaaaatacacaacaacaattgacaaagcttaaaagagaaataaacaaattcacaataatataatatgggaatttcaacacttcttagtattgatagaaggaatacattgcaaatcagtaaggatgtaaaagacttgaacagactatcaaccaatgctacctaattgacatttataaaaaatcccattcaacaacaaaaggaaaattcaaatcaacaacaaaaagataactagagaatccccctgactacttggaaattaaacatcagacttctaaataagccatgtgtaaaaaagaaattacaatgaaaaataaaagatattttaaactgaaagaaaaatgaaaacacaacatgttaaaatatatgagatgccactaaaatggtgcttacaggaacatttaagatattaaatacatgtattaagaaagaagaaggcgctgggtgcggtggctcactcctgtaatcccagcaatttgggaggccaaggtgggcmgattacttgaggtcaggagttcgagaccagyctgaccaacatggtgaaaccctgtctctactaaaaatacaaaaaattagccaggtgtggtgggagtgcctgtaatcccagctactggggaggctgaggcaggagaatcacttgaacctgggagttggaggttgcagtgagctgagattgtgccactgcactccagggtctaaattcaattattgaagcttccacctaaaaagctagaaagagaagaacaaatgaaacccaaagtaagcaggaagaaagaaaaaataatcatagaagtcaatgaaatagaaaatttaggaaagcagtaaagaaatatcaataaaaccacatgctgttttcttctgaaaaaatcaatacattggtaaacctatagcgagacttaacaaaaatatgtaaaacacaaattaccaatatcaggaatgaagtagggacatcactacagaacctgcagatattgaaaggataataaatgactttatgcccgtaagtttcgtgatagatgaaatgaaaaaaatttcttaaaatacacaaattaccaaagctcggttaagaagaaatagataatctgaagagccctgtatgtattaagttaatggactttgtcattaaaaatcttcccgcaaagaaaactccaggcccagacggcttaacttgtaaatttaaggaagaactaataccaattttacgcaaactgtgccagaaattaagagaaaaaaacaccttccaactcatgtgatgaagcaagcattaccctgatgcccaaatcaaagacatttttaaaatgaaaaggaaagctacagattaatagccctcataaacacagatgcaaaaatccttaacagaattttagcaaactgaatccttcaatatataaaagtgataatatcttatgaccaggtagcatttattccaggaacactaggttgttttaacatttgaaaatcaatcaatgtaattcaattaatatattcacaaagaacaattgtatgatcatctccatagatgcggaaaaagtatttgataaaattgatcacctgttcctgttaaaaactcttaggaaacagattagaagtgataacgagcttttattttaaaaaaacctacaactaacattgtacttaatgccaaaagactgaatactttcccactcgagccagtaacaagacaaagatgtccattattgtcacttctgttcagtattgtactggatgccctagtcattgcagtattacaataaaaagaaataacaggcatacaaattggaaaagaagaaataaaatgttttattcacatacaacatgattrtatatgtagaaattcctaatcgacaaaaaagctactagaactgaaaaaaaaagtttagcaaagttgcaggatacagcattaatatatataaattacttatatttctctataccagcaataaacaatgagaartttaaaaaattttaagaccatttttttgacataaaatatgaaatacttaggaatcagtttaagaaaatatatgcaatatttgtacactgataactgtaaaatattgctgagaaattaaataatatcaaaataaatggagagtataccatattaatggaacataatactcaacaaagttaagatgtaaattctccctaaattgttctatagattcaatgcaatctcaatcaaaatccagggaggttttttcttttagtagaaattgacctgtaagttatattcaaaagggctagtacaagagctaatatagtcgaaataattttgaaaaataagacaaagttggaactacctgattttaaaacttactctaaagcaagatagtgagctgttggtataaggatatacacagagttcaaaagaacagaatagagaatctagaaatagcactatgtatatctaaataaacacatacacacagtagatttttgatgagtgtgccaagataattcagtgaaaaaagggtattctttttagcagatggtgctggattaattgaatctccaaatgcaataaaatgaaaataaaatgaacctgacccttaccttaatactgtatacacagtttaattcaaaatggatcctaggcctaaatgtaagagctaaaactataaaacttctaaaagaaaatgtaggagaaaatatttgtgaccttgagttaggcaaaaattgcttagatctgacaaaagaaatcttaaaaccttaaaagaaaattttgacaaatttgatcaaaatttaaaaatttgcattcataagatagtgttaagaaaataaaaaggcaaacctcagccggggagcaaatattttcaaaacatatatgataaaaggcttgtatccagatgtattaacttgtacaactcaataaataacccaattaaatccaattgtttttgggttttgtggttttttgtttttttgtttttttttgttttttttttgagataggctgttgctctgttgtccattctggagtgcagtggtgctgtcatggctcagtgcagccttgatctcctgggcttaagcagttctcccacctcagcctccagagtagctgggactacaggctggctaattttttatttttcgtagagatggggtctcactatgttgcttaggctagtctcaaactcctcgcttcaagcaatcctcccgcttcagcctcccaaggtgttgggattataggtgtgagccacaatggctgtccccaatttttttgttttaaaggtagaagatttgaacacacttcactaaagaagataaataagcacatgaaaatatccaaattaaaatgacaatgagataccactataaaatcactagaatgcctaaaattaacaagattgagcaaacacatgttggtgaggatgtagaacaactggaacaaagtactgatctatgcaacaatatggaagaatttcaaaagcattacactaagtgaaaaaagagtgtctatgattgcatttctgtgacattctagaaaggcaacaattgtgacagcagagcagtggttgggagggtgctgactgcaaagggacacagggagcttctcagcatcatagataaattaatatcttaattgtggtggtatttaacttggctgtaaacatttgccaaaacttggaattgtacaactaacactgatgaattttatttgtgtatacattatgtctcagtaaagctaaatttaaataaaaataggccaggcatggtggctcacacctgtaatcctagcactttggatggcagaggcaggcagattacctgaggtcaggagttcgagaccagcctggccaacatagtgaaaccccrtctctgctaaaaatacaaattacagatggtgggcgcctgtaatcccagctactgaggaggctaaggcaggagaatcacttgaacccaggcaggggcagcggttgcagtgagccaagatcacaccattacactccggcctgggtgacaagagcaaaactccgtatcaaaaaataaaaaataaaaataaaatccaagccttcagtagttctgtaagcaacatcaacagtgacttcttacgcagttcctactgcaggcagcaccagcacaatgtgcttgggactttgggtcactgcacttggtagatctcagccggcacccacaccatttctcagtttaccctgtagatagaacagaacccatttgcaataattaaccaatgtgaaatgatctctacaaatgctgtgttttgctgtttcaggtgcttaggagaacatgcagtagaacttttcatcaaacaaatggaacacrtcacagaattttgctaacatggacaactctgcacagaaaaatgaacgcactggcaaacatcccagacgtgccagtgaagtacagaaaggtacatgtgtctttgcagggaggagatagctcctgacatatgcttattttagtacataagagcaaatttggggggaatagtaagtcctgggttatatccacagggccatccttacaggcataccaaatagrtggctttaggccctactgtttcaagtgtgacgattgggaagaaactgagaagaaaggatgagagaagaaggaggaagtctgttaaaaaataaaaaactaataaacaaaacccagacttgttagttccatgtatctggtaagaatctctatcctcaaatttagatatgtaagagatctttttttatttcctagaactcaacttgagttatgactgcaagtccccattctgctgggttgttggaaaggataactccagccattatcagcataaatcctatctccctcgtgattgtttcaagttcagaactttcccaatagttagtgtgatcccaggaggctgggttggggtggggaggaatactcaggtcattggtcaaccatccacattggtgagatccccagtgtcccagctcatgtgctccctttggttttgctagtgttcrccaactagtgttctggttcgttagtgtggcttaggaattattgctgagacaggaaacctcattttgagatccccctaggctccagcgctttttctttcgaggctgttaccacctccctggtgggcttccagagtcgctgctgctctcaaatccagagagatctctctttcttcctcctatcctctgattttgcactctctttttctttaacatttctttaaattgaagcataaatatatattcagaaaaagtgcacaaatcctaattgtatagcttaatgaatattcacaaagaaaacaccacctatggaataacttctcagaccaagacagaatgtcagcagcatctcaaaagcccttgtcccttctcagatattatctcccttccctgcaaaagtaaacactacggttatcctgacttctcatatcattaataactttagtttgtttttgaatgttatgtaaatgtgaatcatacaatatgagctcttttctctcaggcttatgtttcagagatttaacttcatgttggtttgtcttatctatgagtaatttgttcattttattactcttgtttgaatacaccacaatttatttatctattctactactgaaggacatttaggttgtttccagtttggggctattatgaataaaaacttctgtaactattcttgtacttgtcttgtgggacacatatttatgtatttcatgggtctatacctgaggagtggaactgctgggtcatagggtatgtttagggtaagcttagttgatattgccaaacagttttccaaagtagctgtgccaattttacctccttacaagcaatgtatgtgaattccagctgctccaaatcctcaccaacattttaagctcataatagttttaatttgcattgcctgagatcaatgagattgagcactttttcatgttgactggccttttggatattctctttggagaagtgactgttcaacttttttgcccattttcttctgctgggtcttgtcttgtcttttcttttttttatttataggagttctttaaaccattctgtccttttcttatttatagggattctttattctagaaacaagtcatttgttagctgtaggtaaatgtcatcccttatcctgggactttccttttcactctcttaacaatgtgctaagacacagaaactcttgattttaatatagcccaatttatcagtctctttatgtttagtgtacatgtctattttattaatacttaagaaatctttgcccatcccaagatagtttcttctagaaactctattattttaccttttacatctagatctacaattcacttgaaattgtttttgattgaggaagatgcccgagtctgttgttttccatgttgacccagcaccatttattgaaaggctgctcattctctactactctgtattgctgttgctacctttgtcataaatcaagtgtccaggcatatgcagctctgcttcttgattatttattctgttcaaatatcatactgtcctaattactgtaactttataataactctttagtagcataagcccttcaactttgtacttctttgtttatgctggctattcttgaccccagtgcatttccatataaatttattttacttttttatttttaatttttatggatacataatagttgtacatatttatggtgcacacatgatattttgatacaagaatataatgtgcgatgatcaaatctgggtagctatacaaattttacaatcagcttattaatgtcttaaaaaaactctactctcattttaatttggattgcattgattctagaaatcaatttaaggataatttacatctttacaataaatattaacttctctaatccatgtatagatccttttatttaagttaccttaaattgttctcaatgttttggagttttctatgtagaagtcttgcatatcttcattatatctattgtaggcatttgatttttatgctgttataaatggtaattttaaattttattttaaattgtttgttgctgctgtacaaaaaaattaattgatttttgtatattgaccttgattctggtgacctcactaaatccaactattacctcttatagggtgtccacagattattttgcaatttccccatayacaatcttgtaatctgtgaaaatgacaactttatttcttcctttctcatccatatattttatgtatttttaatatattttatgtaggcgtttgtattggctagagaccttcagtacaacgttgaatagaaggataatagcagttgtactagtttcactccctgtctcaagggaaagcctttaatatttcacaatttggtatcctgtttgctataggcttttgttatagacaccttttatcagattaacaaagtttgctcctattcctagtttgctagagtttttcttttaatcatcaaaggatattagatcttatgaaaagctttttctgtatctactaaacagttacttcaccaaaaaaaagatatacagagggaaaatagcatatgaaggactgcttagcatcattagtcattagggaaatgcaaattaaaaccataatgagataccattacatacctaatgggatgcctgagattaaaaagacttcccattgctgataagaatgtgaagtcatagaaattttcatacgctaatagtggggatgtgcaaaagtacaacgactatgaaaaatagtttgacagttttttaaaaagttaaacatatgatctagtcattccactcctaggcatttaccccgcaaaatgaaagcttatgtccatttaaagacttgtagataaaatgctcatagcagttttatttgtaatgcccccaaactggcgacaactcaaatttacatcaccagtgaataaacatcatgtttttatacaatggaatattactcaacaataaaaagcaatggagtattgatatatcagcaacagagatgaatctcatagtaattatgctgagtgaaagaagccagacaaaaagagtacatgttacaggtatatgatttttttaatctgttgagatactcgtatggtttttcttttttagtccgttaatatgatgaattatattgatttttaaatattaaactatttttgcattactggggttggtcacgatgtattatctttttatatattgtctggtttgattcgctaaaatttttctaaggatttatgtatttatgtttatgagggctgytgacctctagtgatctttttccctcttgtaatgatgccatatagttttggtatcaggtagtggttgcctcattgaatgagtttggaaatgtcttttcctcttcagttttctgggacagcttgtatggaattgataggtggagtgttctataaatgccaattaggtcaggttaggtaatagttttgttcaggtttcatatatctttactgatctatckacttgtttaaattatcgagggagatgttttgagatctctgactataattgtgaaattttctaytttttctcgcagttttatcagtttctgcttcttatattttcaatctctttttattgggtacatcagcatttaggactgttatgttctcttgaggagctgactgctcataatgaccccattatgaaatgaccctctttattgcaggtaatattttttgctctgaaatctactttatctgataatatctaactatcttttgattagtgttagcatagtaaatctttttccattattttacttttaacttatttctgagtttatatttcaagtatgtttctccaaggtaacatatagttgggtctttctttcttatccaatctgagaatctctgttttttaattgggatatttagattatttacatttaatgtgattattggtgtataagtttaagtctatcatcttgtgacttgctttctattcgtcccatctgttctttatttaccttttctctgtctcttgtattatttttaatgcttcaattttatctcctttgttagcctattaggaataactccttgtagtattttcctagtggttaccttaaagcaacagttggcaaactttgctccttggaccaaatctgacccactgcctatttctattaataaagttttattggaacacggccaccccagtttgtttatgtattgtctgtggctgcttttactccataatggcagcactgaatagttgccacagagaataaatagactgcaaagactaaaatatttactatctagccaggcatggtggctcacacttgcaatcccagaactttgggaggctgaggcaggaggattgcttaagcccaggaggtcaaggctgcaatgaactatgactgcaccactgcactccaacctgggcaacagagcaagaccctgtctcaaaatatagatcaataagatagatagatagatgatagatagatagatagatagatagatagatagctatagatggatagatagatagacagatatgtactatctggcccttagaaaaagttcgttgatccctacatactttagagtttatagtatatatctttaacttatcatggtctaccatcaagtgatattataacacttcacatatagtagaagaaccttaaaacagtatatttttatttttcccttcctggcctttatgttattgttgttaaacattttacttgtacatatggtataaaccctacaaaacagttgttatttttgctttacataaattttttttttttttgagatggagccttgctgtgtcgctcaggctggggtgcagtggcgcagtcttggctcactgtaacctacacctcctgggttcaagcaattctcctgattcagcctcctgaatagctgggattacaggcacctgccaccatgcctggctaatttggtgaggaggcctcccaaagtgctggattacaggctaccacacccggccagtaatcattactttttaaatgtttaaaatgttatatttaaattattcaaggctgggtttggtggctcatgcctgtaatcccagcactttgagaagccggggcgggcagatcatgaggtcaggagatcgagaccatcctggctaacacggtgaaaccccgtctctactaaaaatacaaaaaattagccgggcgcggtggcgggcgcctgtagtcccagctactcgggaggctgaggcaggagaatggcgtgaacccgggaggcagagcttgcagtgagccgagatagcgccattgcactccagcctgggcgcaagaacgagactccatctaaaaaaaaaaaaaaaaaaaaattgttcaatttatactcataattttatattttctatttacccacatatttactatttccagagcttcattcctttatgtgattcagatttcctactggtatcattttctttggcctgaagggcttcccttaacatttcttgtagctcccatttgctgatgattctttcaatatttatatagttttaaaagtttttattctgcttttgcttttgaagatatttttactgagtacaggattctagggtgacaggttttttttttccttttattgccttaaaggtgttgttttcagtatcaatctgctgtcattctcgtatttgtttcttcatatgtgacatgtcttttttctctgcccaattttaacattttcttcttatcactttttaagcaatttgattatggttggcctacggtgtcattttcttcatgtttcttgtatttgatgttaagtgactttcttgaatctgtgagtcaatagtttttttaatcaaatttggaaaaatttcaaccattttttcttgaactatttttttctatttcttctctcctcatatttctttttttgagagcctgattacatatatattaggctcctcaaagtttccacacagctcactaatcctttttcttgtcctttttctgttttattttgtatagttttatttctaggtcttcaagtttactaatctttttttcctctaatgtctaatttgctattcatctcatctagtgtatttttaatctcagacatttagttttcacatctggtagttcgatttggatcttgtcattatatcttccatatctacttaatatgttcagtcttttctctggcttcttgaacatatgaaatacagttagtgcagcagttataatgytcttctccactaattctatcatctgtatcatttctgagttggttttgatcatttattttctccccactttgaagtatatttttccttcttcctcctattaattttttatcaatgccaggtattttgaattttacctcttaggtgctatttttgtagtcccataaatattcttgtgctttgttctgagatgcagttaaattatttggagacagtttgatcttttcaggtcctgctttaaagctttgttagctggaaccagagcagtatttagtctaggggtaattttgccccatttctgaggcgaaaccctcctgcatactctatgttccatgaattatgaggttttcccgctgtgactcatgaaaacaggagctattcccggccctgtggaagcctcagggattgctcacttgaattctgccaggcggttccttctccagccctgggtagttttctcatgccatgtgttggtcaatacccaggaacttactcaggggaccccgttgcagagctccatagctctccatctgggtagctctctcttctctggtactctgctctgtgaacttagctgtcttggtctttctggactcccagatctatttcctcaactcaggaagaccacggggctccatctggatcccttcttcctgtgctgtggtcttgagattttctcctggcagaaagctggggrccatcttattgccaacctcatttactttgcttctctcagggatccctgtcctttgttgcctgatgtccagtatcttgattgctttatatatcttgcccatttttaactttttttttccagctgggagggcaaatctagtcctgttttggtaagaaataggagttcagtcatccagagtgtttttcaaaaattctactttttaaattgtttcatcaagagggctgctctgacacatgcatttctgttatagccagaagccttggatctcctttccagtcaggcagaaacctctcctttccccaggagaatgtccttcctttaaccttttttaaataactctctytttactgcctcctctgcacactctcttagctgttctataggcttaggcttttagaaacaaaagccaggaagtcttgcagctgcttctgccttttgatttgctgtatagctctcttaaagcaaacaaaccaaaaacatagccattcatctacttaaatggggaggggaggagaagaatacatttactgtatattggtatccccaaatattttctacttaaacacgtattcagctccttttacttgcttcatcctccacccaggcagattaggcttcagtgtccctctccccatcgtgtttattgagcacttaytagaggccagctcaggaagaggaagcacagctcagagctcaagagcctggactcattaggcaaatcatgttcacaccctacctgttccgcttaagtgctgggtgattcggatgagtaacttaatccctctaagcctcagtttcctcaactgtgaagctggttcatgattgtaccccttgaggggtccctgttgtcttcaggcttcctgctctgaaaaggagtattgttttttaaaaaaattcagagatgaagaaatgagccttactgatagtttccatacaaaccaccctctgtcatggctaacacatactttcttctttccttctcttgactgttttttttttcccccatttctgcgcgtatttcctctctgaaggttaggattctgatgttaaaataatttggcttactgttgtgaacagcctacagagtcaggatgcacccccccacccaaaatttggtttggatgtcaagacttacggtgccacacacacgctcatgaagagtgtaggaaaaggcttatcayccacatagtgaggccttctgaggacagcagcacagccttcctaacctgatccaataatggcttgagagagcagggaaaggagcctggcttgggggttttcttatggttggaaagcgaggctggactgagggcaggggtctgcgtggtttgaacttccagctggtgccacaggagggagctctgggctttctcatccgcttgcccagtggtagggcagaagggaatgagggagtggtgaagctgaagagctatcagccatcaaacatcaaaaaactggagtcagagtccattacacttacaggttagagtctataatcaacctgctatgcagacagatgctgccaagttctagcagttgtggaagtctcagcaggaggggagtttatacatcagacatgcatgtatacatcgcagcctagacaaaggaacttttaacttcagtttctatagatgatccctttctgctttttaaccccatgtctgctcaaaacrgaaacgaaaacttacacctgtcttgcacagtgccctgaaaagtgagagccagccccaggctgggatttccctaacctctttggattttaacggcctaatgctggtgtctgaatctaggccaaggagcagtgaggacgcttcctctgtcctgaccgcgcctcgtccaggctgctcccagaatagttttgctgtctccttcctgcctggcaagaatgtctttactatcatctccttccttttctccgggacagcctgtttaaggtactttatgtgaccacatctcactaatttaagagctggaggggggaagtccgataaattgccgagagggaaagaaagtggggaatttttttttttaatccggtttcgtgtctgtttcctgtcaaaaggcaagtttctcttctctaccatttaaaataaaactttaatatacacctttgtgttttccacatttgtcaatcattgttttgtattcattttgattttactccatttttgttgtttaggttttactgctgcatatccaacacaatcctccattccttttaaatctcaagcttcagtaatcccagaatcagaaaaaaaaggattcaataktcargccaagagatttcctcataagaaggtaatgacgttgtctcaggggttctttcgttttagtctggattttagccttgcgggacaggcacgttctgtctggctgctgtgtctttctgtggacagtggagggcagtgtgctcccaggagccgcggcaccagctccactgaggggcaccgactggactaactgtaagaacgagcctgaaaaatgggacatccagggaaaaacaactgtgtctggatttatggcgccaaaaatattgaactggaccaaaactattttaagaaaacaatatattttaaaaatcatcataaagctaaaaaattgcaaaaattcccaagtgttatcaattaagtaaaagattaaaaaaaaatcttccccatccttgtgagaggaaatcacatgacttcaaataacacaagaggaaaagaagagtcgaatacatctagaattacctttggagggccgggcacggtgscttatgcctgtaatcccagcactttgggaagctgaggtgggagaattaattgcttgagccaggagtttcagatcagcccaggcaacatagcaaaacccaatctctacaagaaaagaaaagaaaagaaaaaagtacaaaaattagcttggcatagtggtgtgtgcctgtagacccagctactcaagaggctgaggaaggaggatcacctgaacctgaggaggtcgaggctgcattgaaccaagatagcgcaactgtaccctagcctgggtgacagagctagaccctgtctgaaatwaaaaaaaaaaaaattacctttgtaatgagccctgccctactttaaaaacaaaaaaacaaaaaacaaaaaaaaacttccttaaacaatgtgttattagccgggtgcagtggctcacacctgtaatcccagcagtttgggaggccaaggtagacagatcacctgaggtcacargttcgagaccagcctggccaacatggtgaaaccccatctctactaaaaatacaaaaattagctgggagtggtggcgcacacctgtagacccaactactgcctctcctgaggcaggagaatcacatgaacctaggaggcagagattgtagtgagccgagatcgcactactggacttcagcctgggcgacagaatgagactccatctcaaaatcaccaccaccacaacaacaatgtgttatcataytcctgtgtcacccaccacccccscttccctaaatcttgccgcatctcttttcctctctaacctggaaagttctgcgtggttcctgaccggtccttatttaatctttgggatttctgggacctgactttctcctctctcaccagcaggggacagaagcaactcacaggcgtccttagagtctaaaaagtttttcattccttcattcatttaagcaagacctttagaatactgttcttttggaggagtcctcatttcacatatcttttgctgcactctaaaaatggttttcatcttattaccttgcccagatggcagagagggaatgaggagatctaggttctgaacggagccaaggcatggagtgaggggccttggccagccctggtgccctcagcctgattcctccttggtagatgagaacgctgaactagagaatgtttcaagtttcttccacttctgatattttaggattctaagaaagcaaataataaagaatagagtgtacgcacacaaacacacacacacagttttaaatcacttgtaggttttctccaaagataatacatatttgctcaggagttttcttctctccctagtttctctgttttaactgtttggctctttcccattttctgtctggtttcccatttgtcaatttaatgataatatattgtccctctcyagratatttgcagcccagcctcygataaaaacaatagcagccaccatttacttatccttactatgtgtacttttagactgccttttatctctaatcctcagaacaatgctgaaaggaagggtttattattttaatttaacagaagaggaaaccgaggcttagggaagttcaatgacccacccaaggtcacacaatgcagggtttggcacttaagaggctcaaagtaaatgtttgctgaatcaatgttgaaagaattagacctcaacccaggtctagttcactccaaagcctcttgctctttccacacactgcaccacacctgcctttgtggcccgcaaagctgtaaatttggcctgtgaaagtcagcaagtttctgaaraggccttagcaacacagaccaagctgaagacaggggaggatgtcagctaccgtggatgggccccattccccgtgatctagttctgaacactcaaattcagaaagcaagccggctcacttgtcaagttagtgttttaaaagatgattgcttctcagaacgtttttgactaaaggaaccaaggaggcaggtagccaaacctacaggcagcatcgaatagagatgggaattgctcagagattgggttccaactttttaaatgtggtcgtgttacttgacaacatgaaaactttcatctcagcatttgtaagcattttagaaataaggatggaattttatggaaagggcaggggatccatcaatcaggctttccgtgtcctactctgtcactggctstgtgcctttaaaccagtcacttgacttttctgggcttcagtttcctcaactgaaacataaaatttgtattatataatttttgtggtctcctcaagttataaaaacagaaaaacaaattcctattctatgttcgttctcatttttcccgagggaaatggccattgagaagttaaagatcttgtttaacatcacctgataatttagtgaggcaatacaaattaaagacagatttgaaaactccagggcttcaccacccttcttaaagcattagtcacccacaccgttgctccagatcgaacatggctgcctcctcgcagtagtcctgtggcccaccttagcacatctttgacacagagaatcagtgccctttgaaatgtgcacttaccttgtgaggctaactttgcagtgaaccatcaaggtctccttgcccagctcacattccccatgagaatcttactgcagagtacagtgaatccttcacagagctcagtgtcgggactggcaattttggctgctagaaatgaagtctgttttcctgaacattttcgagttatttacagatgtgctggtaactttgcgtaggtgaagagacatgcctgatctatgtggcagagcatggcccagcagcctgccggccattttctacccccgcctccctgtttctgtctccacttcaccctggattgtggtcactgtttcccaaactgtgtacccctaaggacaccacttaatgtctttgcttctctgtttcctcatcctaaaaataaagatgttgtaataggtaggtaagcccttgccaggaatgagtatttcatggttctacacctcatcccttccaggcttgaataaataaatacaggtaggacataggtaccatgtgctctagatgggcacaatttaaaaatatatgttaataccattacatagtaaatctaccctcccaaatgggaagcyagccagtggttaatttgtgatgaaatcgtacaaagttaatattgttcacttattaacttgatatgacactagaccagggatgtttaaatgaaagaggttcagtttgcagaagtcaccatgttcaaggggacagctgccccaagtgtgccctcagctgcatatctgacccacagtagggtctgtcctgcctccctgctctgtgaagcctgacttctctgtatcagtcaccagtaccccttcctaaggggtctgcaaacactgggctggcactcatgacatgccaggtacccctcaaagacctttgcatttattacctcatttaatccccataataaccccatgagctaaatcccatcattatccatacttttcagataatgatcctgagatgaaaagagggtgaagtagctggtgcagtggaggctgggcagagtgaggatgaacccaggtagcagctcctggtcctcagaccctgtttccccagcatcttcccgaggtggaggcacctcccacagctcgtcttatgcccttgacacaaggttaatgtgtgtgctgtcttacctccaccacctgcctaggrgctccttgggcagtggtcattgctgtcctttccagaccccacaaacccctcaaaaatggatcaaatgmccccaactcaaatctgcgcatttcccatggagtcacgaccacacatccatccatgagcactgttgtgatacatctccttcctcccattcctaaaccctgtgagctgctaacaggttgcgcctgtatcttccatccttggcacaggtcctgatgcacagtaggtttcaatcagtgtcckctaaattgcatttttgcccccatcccacgcagggcacttcaacaggctgctaataagctgctcagtcccactctgaaggtttgtgactcccaagggagggtcctggctccatggaggcagtagcaggcaacatcgtgcgtggtgatggtgatggtgatgatgatgatggcgggccgcatcggygctgttccacccactttatgtgtattgaccccttcaatcctcacacttagaggcagcaaaggagacagtgggtagggcttccctagagcactagtaaatgcgagttctcttcccttctccctccccatacatgtttttgttttgtttgtttatttggtttttgccaagaaaccaaggagtggctaagttcacaccagtcacaacttggattctcgttctctgggatttgctctgagaggctaaattcatccaagtcacagaatgtcagtcgcaggaactgtttttgcacaggcgaaaggcctctctgagggtggcatccgcccacctctagaagtcacaggagaacgcttgacatttccctcccagagacctacttgggcgttgcacgaaggcggtggtgtgctggtcaaccaccatttaccctcctcgaagaaaagtgctgagatgtagcatctgcccgtttttgtgacataaatactsccaccgtggccaayttcaagccaccagcagcaacattttggaatttttaacagttgtcctcacaagctgccgctggccagctccagctgccgctgcctggaggactctctttttgctcactaagaacaaacaggcagcactccattcctccaggctaagtggtaacagccttcttgccatttgccttggactcaagccagtatgcaaagtggcagaattaaagtgtgttaaagcccaggaaagttgtgagcttcagcaaatgaaaacacragatgtccagttaaattagaatttcagataaatggcaactctgttagtacaagtatgtcccaaatattgcatgggatatactaaaatcatcatctgcagtttatctgaaattctaatttaactgggcaggtaggatggmgccggcatttaggtcttgcattttgtctggaacccctagctcctcagacacatatgagtgctcagaaaattcttgcaaactgatggtcaggttcagagtgtggtgataaccgggagctagaggtgtgtgtcttcactatctactatttaaacctagaagagtcacagtgacacttcctgtgtcagctttcctagattcagggactctggaagctcaaaagcacccaaggcccawcaccttggacttacaaataaggaagcccagagaggtgacttgctcaagatcacttagcgtgtggcagcactgagactacaatttctgattcataacccggtggggatttttttaatcctatgtaatctcatttgagaattagtttggtttcgtggttaagagcagactctgtggtcagartgcctcggttctggctctgacatttactagttatgtgggccttatctcttttggccccaacttctttaaaatggagattaagtgagctaatagtacatgtaaagtcctcagaacagtgcatggcacaaaatgagcactcgagaaattgatgcttgccctgaaaacagttgcctagaaaaatctcttccttgtctccccatagcccttcgcatctgcatccacaacacgagggttctcctgggctctcggcctggggtgctggagtacctggctccacagtgcctcctgctgcctgcctcactctccatggcagtcagttcctcttccgtccaccggggatcattctcacctaaagcaggaatcagcacccctgtcgtcacctcccatggggcaagggtgaaaggactcactgcatttaaaagtcagcacagaagaacccgttaacagcactttgaccctatcccttatatgaaaccataattacacactgcccagccagactggaaagtcctggaaggcactgatggtaccttgggctttctaccctaaggaaggcagtagggatggtggagacaggacaggcctgagtggcagagattggagacagcaagctctggagtcgggctgtctcggttcagctctggggtttgccacttactagctgtgtctctgggcctcactttccttaaagtagccctgatcatacctcactgtaaaaggcttgttgtgaggagtaaacaagacagcacacaccgtgcgcttggcactgaagtcaggtactgccacttacagcagcgggaccttgggcaaattcatctccacgtgccttagtgtctccatttatcaacgggggacagtaatcccttcatcactggctgatggtgaaaatgagaccaactttgaaaagcttctgacaccaagcaggtacccaggaacctcttgccacagtggagcatccttagcatttcacaccactcagccaacttctgtcaacatttacttccccctggtaactagcatgggaaatgcaatgaaagcccgatgagctsccgcagcagaaatgaacttggaagtgacctctcacttattcctctctcacatgcctgcatcattcagcacttgagcctcaagagcttgcctctttttgtctgagagttagaaatggcctggtttgggttgaaggttgtttttgtttcattttgctttataaacagaaacactccctggtttctcttctgaaaggctgaggaggaagctgagtcaggtggggtggggtgaacatgaaatcgctcacccttcccttgccgtgggtctggcttacccaatcactgcacactgacttgcacatcagccgcattcagtgtcccactttaggcccatttctctaatgacttgaaaaaacaactgtgttcttttggaatgcggcagggcatagtggaaagagcaagggctttgggagtctagcctggcttggaattccagccccaccacttggtaactgagacgaagatcgggcaagtcaggaaatggtggagctaggctgtcacccaccaagtggtggtagcgcctgtgctgtgggattacagtaaggcttagtgttaatggatgtaaagcctgtggaaaagcacaatggaattgaagtatctcratgacaccaccttctcttccctttcagaatgatatcccaggacctgggttctacaatgttattcaccagtcaccggtgtccaacagtgtctcattgtccaagaaaggaacttgcaygtttccctcaatggtgagaaccacttctcttgagtaaagcatkaactggtcagtaatttccttcattcattgcataattatatattggacatctggtcctttctctccaaaggcctatggttctaattaggagagtaactgcctcctcaaatttcatgcaagtaaattggaccctgtgtctctaagtaactttttcccatctctacccactgccagggtgggaagagaagccagaggaatcttgagaacttgatccttccaaaccaattttgttatcactgagtgcactaagcaagtattttcctgagatgtttaggcatgccaggaaatagttactcttacacatcttggtgtaatatgatttttacaatgcttaatctaattggttgtcaaactattgagaaatctgataggactaaaaagaaagccggcagtgggcctgaaaagtactggccccacccctttccttctcttcgtaagatatgggacttaatttttgttgagggctgtaacaatcaagtagctatatgaattgccaatgaccctgaccagagttgggcaaagataggcttcttaaaaatgtttatacattgtcaagaaaaatagatacagcaaaatagataaatggtcaagaaaaacagatacagcaaggggaaagatacaaactagggtaaggctacctgaggaagaaaagtgaaaagtggacaggcacggtggctcatgcctataatgccagcatttcggaaggccaatgcgggaagatcacttaagcccaggagttcaagaccagctcgggcaacatagtgagaccccatctctacaaaataatttaaaaattagccaggagtggtgatgtgtgtcgatagtcccagctactcgggaggctgaggtgggaggatcacttgagcccaggaggttgaggctgcagtgaactatgatttcaccatcacactccagcctgggtgacagaggcagactctgtccaaaaaaaaaaaaagtgaaaagaaagcaagcccagactctaacattaaattaacaaacatatgccatcttgtccctttaaaagttataataatttcttgcacagatgtattatgatgcctgacattggaattgatttttttttttaaccacacaaagggaccatttaagacacactaaatgtagctacatcttattggaattcgaatttggcagaatyggatactcaaggaacagaccagctttggagttaactccccattaccgaagaagctgagtttgtacatggcctcagtaggtccacagaacagccatgcctctacctatttttctgccaccagctctgctaggaaagaagctcaaaagaagtgccgtctcatgaagtcctggtgtagaagacaagacttcagacctgatcctgcctcagctgtggattcttgacgtgacctcaagcacgtcacccttctgtgtcccagttgcctcatgaaagtggagactccctggaggcactgggcaaattaaygttgcaatgagtgaaatrctctttgaaacagcaaagcattataaacatgctaaatattatgattgttaccacctgagtcacaaacaatacttcctgcaacacctaggttttctctccgagaacttctttgctaaataatggcactgcccattccttcttgrtgccaacaaagagactgaatcagaggacacgattggttgtctacaaggctttgcgtgcggtaactttccaaatgaaaagcctgactatctggaggagaaggggcccaaggcaagagctgagtgttacagaacctagccacgcctttcaggcctttaaaaaattcagaaccaaaccctaaagaaggcagactttgagctgctcaggcttccccctctcctccctttcacaaatatgggaatttgtatttatagttatgttacactcaggtataagcacttaaggtcctgtacctggggatgggtgcctgaagtggtcgatggcgatctattaggagatctctgcgttttacctcattcccgtgtgaactggatgagaatttcatatcccccaccccaccgcctctttcagtaactttcacctttagcacctcctccrcttctgcatcccaagacttagagggaattaaaagtagctctcatcagagaaagatcagaatgaccagtaggaatgtgattatgggtgaggctgaccaaaaaactctgtgggtctataaattttagaaacttcctcatgactgttgaaacaactacacccaaccttttgagagacctgtcatctctctaagtctgaatgatataaagagctttattagtatattccaaatctttgctccagaatcttccacaggactgactaggagaagtgtatgaggcaggtgggtggagagtttgatggcctctctgtatttgcatgctggcaggagtggctctagaaaagttagtaggtgctggagagaagttcataaatgccggcatttggccagattggaggccacaggcctggcaagtaaaccaasgggtgtgtagtgttggtgagtgagtgttactgtagccacattctgagactaattctattacgatactttataaaacattgcctctactgggacttttttgggaagaagttttttcattttcaaaatgtaagttgtaggtgttctaaaccaaaaaagagtctatgattgaatgggcttgctgttatcccagagccatgycgctcaaccctttccyctttagaatgggctctctgatccatgtcatgtagtggagrctgactgcttgggtaggaatgctggtcctccgcctgaattagctggggaagttcagcttcctcatctgtaaagtagagataatcataagatccactgctcagggttgtcctgaggattcaacacaaaaacccaccaaaggtattggttaactcttggccagaatgaaaaagatgaagcacgttcaaagctggggtgaccttacttctaggagcatcagcaaatccttacacactgcatgtagccacttcttattagaattcgagtttggcagagttggatactcaaggaacagatcagcgttggagttaacttcccattactgaagaggctgrggttgagctggggcttgaacccaggttaggctctgaacaacttaggctctggacaagaacactcccgcttctggtgctacacccmcccaaatgctagtgggggtccataaaccagacgctgaggaccgtcaccaccaagcacagagtgaagtaggggggccctaatgccttccttttggctcacccactttctgtgtttgtgtagttattgattcctatcaagtgagaaaatccagggcaatgttctcaagcttttgaccattaaatagtgggaaattttttgttttatcagactccaatacttgccatgctatcttaggggaaagtgatgttatcactgagtttctgtgacttttgtccctgttcttttgacaaacattgattctgtttgttttttaactgaagataatttatcgtggcttcctgaaagggtgggattggttctgttaaaccgtgaaaatactgtaggatttgatgaaaacagtaatttggtggagggtaggaggcacagatggacaacaagccccctggagctttgtttgaagcaaactcgttgcttaggcagttcagatcatttaaccttagaaacaagatgtgagattttactcagaagaaaagcytaggctgagaagagcatctaaagcttcctatcacataaattacccaacagctgatgagtcaagggtaagtggcctggaacaggattgggtggaaatgcatttatggcaaaatcatttttgccaagtcccaaacagaagatgaataatttgagttagtttacagaagcgagtacaggtctgaacttgcgttttccaagggaagatcctcaaagccygaggtcagtttatcattgttacctgccagagtttcgccttttataaaatgcrtttagaccttgtgctggtcaccatctttttgacatctgtccttcagatccacaatattatgtgacaatgctgattcctttkgttgtctccttacagtgcgcccgattggacaccatcrtttctaaataccctgcagcgaaygcatacactatcccatcggattttatttccaagagagactttagtaattcgtgttccagcatgttccagttgccaagctttatgaaagctctcaagtttgaaactcctgcaccraactattacaatgtaagaactctgcctatgcttgctaaatayagatcgaattaatggtttactaaaataaaaggaagaggggatcttggggacatcgtattttaatgcagttgtcaagccagttagcatttgttgactacccaatgggtgcctaaggctgtacaagactcttacagggaatttgcagaccccagagatcaggatgggcaacatggaggccagtatcaagctgtggggaggccactgccctgagaaacacatattctaattactcttgtcctgtaacctttctgggacgtagttttctcatctgtaacaatgggtgtattatttaccactttgtctgcagccactaatgatttactttttaggttcttctagggaaaataaactttcatatcagaaaataggtgttttaacagtcgtgccctgctgtgccaattatgatcgctttgtattcactgacrcagaatggcatggatggttaagagatggactcaggaaggtttggtttagctctcatctgttgccactttctaactgtgcggccttcggcaagtcccttaacctttccagggcttagtttaytgatctgtaaaatggtgatgtatgttcacctcatcgtgttaatgcaaatattaaatgagataatgtatgcttcatgcccaggacagcaccagtcacacaaggaccacacaatacatggagattggtagggctgtctttgttagtacatgaagggtatttacttacccttaaatacaagcaagtaagtaagtcacagcccccactgtacaatggaatcaattctacttgccctacagggttaccataaggcaacgaacgtgaaagcactctgaagtgcgcaagatatgaattgtacttaagacattaatgttatgccattttccaaactattttggttttatacatttattataccatttccttttttccttcataatattgataattaataattatttttctgactacaaaaatcctgcccaccttctatgatggattcaagsttttttttgagacggagtcttgctctgttkcccaggctggagagcagtggtgcaatctgcaggctccacctcctgggttcacaccattctcctgcctcagcctcccaagttgctgggactacaggcacccgccaccacacccggctaattttttgtatttttagtagagatggggtttcactgggttagccaggatggtctcaatctcctgatctcgtgatccacctgcctcggcctcccaaagtgctgggattacaggcgggagccaccgtgcccggcctcatttaagattttctagtagccacatctaaaaagaaaaagggacagatgaagttaatttgagtaatatagtttacccaacagatccaaaatattatcatttcaacactaatcaatataaaagttatgaattttatatttgaggaagactattttccttgtagtgagtctttaaaatccagtatgtgttttattcttccagcacattttaatttgggccagccacgtttccagggccaatagccacatgcaacctgtggctactatactgggcagtccaactccaggcagtcttccctcggcataatcagagcctgaaaatgatgaggaggaggaggaggaggatgaagcacttctcatgtactaagtgctggtctaagagttatgtattaatcatatttaatactcacaagtgaatccataaagtggattatcttgttcccagtataaagaagagaaagctaaggctcagagaggtgaagggacttgcacagttacccagcttgaaggcatcatttgcacttcagtgggcaccagtggatggctggggtggaaagctggggaatgatcaaagtcacctcrttccagccctgacaggcttccctctgtggatcctgttgctcctctgtgccaggctggtgatacagcttagattccagtggggaattcagaaaagaacaggtaaacaaacaaaataattacaaactgtggtcaactttgagggacagctggagcttgagggagaatatgtgggagatatggaggttggcagtaccaagtcagccttctctgacttggtggtcagagaaggctccgagactgagacccaaggattgaggaagagccagggttggagaaagagcatgtgccaaggtcctggtatagcaaggagcccagcccacgaggaccttcaggaaggttgagtggctagtgtaggatgagcaagaggagaagggagaagggggcaccagacagacaccggccaattcacacagggccctgaagatcccaggaggaagttcacattttgttctctgggtcctaggaagcccatgagtggggctggaggtatggggtggtgtgatctgatgctttttttttagatggagtcttgctctgtcgcccaggctggagtgcagtggcacgatcttggctcactgcaacctccgcctccccarttcaagtaattctcctgcctcagctgggattacaggcacatgccaccatgcccaactaatttttgtattttttttttttttagtagagatggggtttcaccatgttggccaggcttgtctcaaactcctgacctcgtaatccatccrcctcggcctcccaaagtgctgggattacaggcatgagccacagcttccagccaatctgacatattttttaaaaagttccttccagctgctgtgtggtgaatggactgcagtgtgggttggagagtgggttctggaaaaccagcgaggagattattatgctaacaggagagatggcaaggtgtgatacaagaaagtgatcagaaaggggcttagccattgcccctttgtcagtcccaagtgggaaccaggctacttgggagaaaaacacaggcaccgactgtctgtgcggatgcccctctctgcagcctcccggttgtagctgaaggatgctgccgtcagtgtttcatgcaccattctccccgaatcactgtctactccttcacccggcttcctgtctccaatgcccagcacaggtcctgggatgcagtaagcatccaatcaatgtttatgacatcaaaggaataactttccagtagtatgcagctgttaatctagaaagkacctcttcccaagatagaattgtgtccttctgccaatagatacatttaggcgcatgttttttgttcattattgtcttaatatgaccctgaaaataatacacgctcatcataaaatatattcaagccctgtagaaacccattaattagaaagtggaagtcccttataattctacttcccaagggaaaccactgcatcaaaaaccaggtgcaggccaggcacagtggctcacgcctgtaatcccagcactttgggaggccaaggtggacagatcacctgaggtcaggagtttgagaccagcctggccaatatagtgaaacctcgcctctactaaaaatacaaaaataagccaggcatggtggcacacacctgtaatcccagctactcgggaggctgaggcaagagaattgcttgaacctggaaagtggaggttgcagtgagccaagatcacactactgcactccagcctaggtggcagagtgagaccccatctcaaaacaaaacaaaaaccagatgcaatttctttcatattctctcctacctctgtccctccaccagtattagcattattctgtacacagcacacatgcattttcttcttagatttctttccatggcaatacaataaatctgcttcagtcttttttaacctgctgaatattttcctggccccatggggaaatcttccagcgacacacactcagcgtatacaaaaatgctccctttttcagttgcttttctgtctgggtgaaaaataaagctgaagtgctgttttgtctacaggtggctttttttcaggccaggagaacaatggttgagtcaactggtgaggagtagaaatgcagtaatcctgttagccacactgtgctttgaggtctgtcaaagcctttctctgcctttgctgccaccatccctcacttgtatattcgagtcctcttccttggtaatgtgttattaccttctctccggcaacctggctcctctccccaactctccgtgtccagtaattaacctgtcccatctggtctctttgtttgccctctctgcatgccgtctagccattagggccctgggaaaagctaaattcctccacctttgtaaacacaaaatcaaaatgccatctgcatttctcgagaaacattttttttgacaaaggagtatcacagcaaatcaaaccatcctggccccagcaaatagtttcactcattcagcaaatatccccagcaatcacaggtttaatttgtattgcctctgttctccaatgaatacaggagaccgcaaattggcatttaaaatatttatgattcacgtgtaacagaagaatgatctcagggtttttttcctattatttttagagttctgaacacatcgcgcactctcaaatgtatttcgtgagttggccagaattcttaatttctggtcagttcaggaaagttgagacaagggaatgcttgcaaatgtgatcacaatcttaaatgatacgactttcttgtgtgccccaaatgctgcatttatagaagggctgtttgaacagtgagcaatgcacctaggaatgaggatggggatgggtaggactacgtgtcctgaaaacagtaaaaatagtagaaaaccaggtgcagtggctcacgcctgtaatcccaacactttgggaggccgaggtgggcagatcatttgagtctaggagttcaagaccagcctaggcaacatggtgaaaccccatctctacaaaaaacacaaaaaattagccaggtgtggtggcgtgtgcctgaagtccctgctattctggagactgaggtgggatgattgcttaagcccgggaggcagaggttgcagtgagctgagatggcatcactgcactccagcctgggcaacacagtgagactcagtctccaaaaacaaacaaaaaaaaagtagcaacaataatgaagataatttgcgggtgtagcattacacacttaaaaaaaaacactttccggctgggcgcagtggctcacgcctgtaatcccagcactttgggaggccgaggcgggcgkatcacgaggtcaggagatcgaggccatcctggttaacatggtgaaaccctgtctctactaaaaatacaaaaaaattagctgggcgtggtggtaggcacctatagtcccagctactccggaggctgaggcaggagaatggcgtgaacccgggaggcagagcttgcagtgagtggagatctcgccactgcactccagcctgggagacagagcaagactctgtctcagaaaaaaaaaaaaaaaamaaaaaaaaaaaacactttcctagcggtgatctctgctgggccacccccactccctgacagaactccacagcaagtggagctgactgtccaatccgttttacagatgagaaaactgggtttcagagaggttacagaactgatgcggggccacacagcctgtccttagcagaagtgagcctggaagccaccctgcagctagctgtgtgttctgttccttgttgagtgaccagcattttccagggatcacaaactcatagaccacttgagctgggatgacagggaagccacagccagtgtgacgtttacagctcacatctgttcatttgctaagaaggacaggtttcggtttgattttttttacgtagatttgccacttgtccaggcatgatgacgaagacaaagaaaggaaaggtactgagtacattgggtgtattttctccccctaggcctctgtctcttgctgcaagcagagaaacaacgtctgtactcgagccgggtttatgtcaaaaacccaaagaggatctttcgcttttgctgataaaggacctcccccaggtaagcagctgctttgcactggccttgacctaagggttaagtgtcccagatttgatttgcagggcacctacttcttcacagggagtctttggaaggatttagtctttgggtggggaggagtagcaggcaggtactgaacaaagaggagaggtgagaagacagccagcaatccccaccaggaggacaatggctggctctggaaatgggcctccaaagcagcttcctggcctccccttttatgatctggcatacctgctctgggcagccaagtggagaagtggcttctcacctcagaaatgtgcacattcgtataccccagstgccattaggggccactggggaggggcaggagatacagggcatgaccatacatcctgttccttcaacactgagctgccacgttcattttctcctatgctagaggtgacttcatcatccagtcataaaacagaggaggcagctctgtttccggagcacccactccacggtgagtggtttccatgcagtcttgcaggtctgccgtcataggttcatccacttagccctacttttcagatgaggaagtggaggctcagagagttgaaatgacttgcccagtgtcayacagccagtaaatggcagacacaagcccagaggggtctcactaacgagcccacgtyctccatcattccattgtcccttctggaacctccaagattcaggaatacacaagagctttcctgcaagtgtttcccctgccggccttggggaagggtgttgcacctctcctgtgctctctgacctccagtgctggagcacttattatattagattatcccaaataggtcccacagaccacaccccaaccccagaagccctgggcaccagagctgccccaggaaccttgggccccagaagcaggaggaggagcagggaaggtttgcttctgcaatcatgcctcttgcagaggggtgtggataaaattgtagtgcatgtgagatttcagcaaatccagattaaagttgaaaagatcartctgaagctgaataacaaaaccagcgctaattaggaggctcagccccagttcatgctctcctgccttgcatcatccatgggcaaaaccccaccttgtctatttatacagaagaacaaagccagcatccctggggttggccagagtccctgccagtgagccctgggatgtgggcacctccacagtctgcccctgctcctgctccctcccggggtggggggatcctgagaagcccccagccccttataacacagaacaggaggggaagtgtgggtactagcatctgttaagctccccgtgggtgccaggggccttacattcattatctcactgaatgctccaaagccccatggagcaggtactcaccacataatcatgggctcagaaagtgtgagctcttcttcttcttttatccccacttcacaggcagaggagatagaaaagcaggtgacaggcccagtgtccaacagctggatttttttgtttttgttttgttttgttttgtttttttggagatggagtcttgctctgttacccaggctggagtgcagtggcacgatctcggctcaccgcaacctccgccccccgggttcaagtgattctcctgcctcagcctcccaagtagctgggattacaggcatgcgccgccacgcccggctaacttttgtatttttagtaaaaacaggatttcaccatgtgggccaggctggtctcaaactcctgacctcaagtgatccgtctgcctcggcctcccaaagtgctgggattacaggtgtgagcaaccacgcccagccccacagctggattttaatccaggctcatctagttcaatatctggtaccttcagctcaccctccaccccagcttcctggcggctggctctctctggtagtggcagcataaatgccttctattccttgcttttgcttttcattgttttctgtattttgtaattcaagtgttgctataacctttttagtagaaatatatatacaaaacagagaatatgagagatagttatccagtattgtaaatgctgctgacatctgcttctttaaaaatttaagcatatactgggaacatttttttttttttttttgagagggagtctcgctctgttgcccaggctggagwgcaacggtgcaatctcrgctcactgcaaccttcgcctcctgggttcaagtgattctcctgcctcagcctccagaacagctgagaatacaggtgcacaccaccacacctggctaattttttaaatatttttagtagagatggtgtctcaccatattggtcaggctggtctcaaactcctgacctcaagtgttctgcccaccttgccttcccaaagtgctgggattataggtgtgagccaccgtacccggctgatactgggaacgtcttttcatgttagtaaaaatcctttcggaacatcattttaaataaatatatagtatattcttatatgatagtaccataaattaaggagccagtattgtcttattgaaaattgtgattattttgaattgattgctaatatgaatagagtggtggagaacatccattcacagggctactgacaacttaggggtgagatcgcttcctcttcaccccagttttggtcattctcttcttccttaaagctttgtacacaaattcattttattctgtcacagtttcttgagacagggcattgtggtgtggtggggaagtgtgggctttggagacaagcagaccagtctctacatagtggtgctcaacacatacatgttagctgggcatgatggctcacacctgtagtcctagcactttgggaggctgaggtggggggattgcttgagctcacaagttcaacaccagcctgggtaaaataatgaggcctcatttctacaaaaaaaaaaaagctgggcacagtggctcacgcctataatcccagcactttgggaggccgaggcaggcggatcacgaggtcaggagatcgagaccatcctggctaacatggtgaaaccccatctctactaaaaatacaaaaaattagccaggcgtggtggtgggcatctgtagtcccagctacttgggaggctgaggcaggagaatggcgtgaacctgggaggcagagcttgcagtgagctgagatcacgccactgcactccagcctgggcgacagagcgagactctgtctcaaaaaaaaaattttttttttaatttgcagggtgtggtggtacatacctgtagtctcagctactcgggagactgagatgggaggatcactgagcccagcaggtcaaggytacagtgagctgtgattgtgattgtgccactgcattccagcctggacaagagagcaagaccctatctcaaaaaaaaaaaaaaaaagatagttgttgattgcatgatatttacaaagcatccactatgtgctaggaacttaaaatattattcaactgtcataacaactctgttgtcagaagaattattattcttagtttatagagaaggaaaactgggctccagcaaggtggagagatttgtctaagtccctggttagatgaatgtcctttggcaaattatttaacaatctctgagtctcagtttcccatgtgtagaatgaaagcagtaatactcatcttgccaggctagtgcgagaactaaatcagctaagtgtgtgcttcccgtgccatctgttctctgcatggtgaggattgtttttggctatctcagtcagcccttccacttggccatcctagagtgatggtgccttgcagccatcaggtgtgttcttaggggtaaggtactgctttttatttacttgagaagagttccttattctgtcctaaaatttctttctccttagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgtgagtcccaatcattctggtctttcttttgaaaggtggttgtggggaagaagcccaacatagagaaaaggatggggtgtcactgcttggcagagcacagtgccgggccactctcttcaggggcccttagtcacacataatgatgctcagtaaatgcctgttgaatgcctgatacttattgagcaaccactgtgtgccaggaacttaaaattgtattcaattattattataatcctgttgtaagaattgttactcttaccccatagaggaggaagcaaggcttcggatttggcgggacatttgcccaagtccacacagccaacttgaggagccacagggaattggctcaggactaagtctttcctcattccctgtgatgctggattcccctggtgctgacattgttctatttttstaacataaaatcttcgctggagtggcaggacattcagaagcagtcaagctctcatagctttataccgatggaagtttaagccctgactttcgagttggtgatacctgctggatttgtacttcagctctgctgtttttatgctctgtgaccttgggcagagttctaacctctctgagcctccatgccctcatctgtaaggtgggaataattcctgcctcgtaggattttgctttcagaattaaaaatacatgtttggctgggcgcagcagcttgcgcctgtaatcccagcactttgggaggccgaggtgggcgaatcacttgagatcaggtgttcgagaccagtctggccaacatggtgaaaccctgtctctactaaaaatacaaaaattatccaggcatgatggtgcacgcctgtaatcctagctactcgggaggctgaggcaggagaatcacttggacctgtgaggcccagattgtggtgagccgagattgcgccactgcactccagcctgggtgacagagtgagaccctgtctcaaaaaacaaaaaaagtaaataaaatatatgtttggcattggcattgcagctggtgactcaawattaacacagatttttaaaagtaaatacagggatttktgttaccctgtttaatatcctacacattttatattactctcacctaagaggctcaaatactcacagagcttatttatttctcgaatggttctagaacttctggaactaactgcagttagggttagtcctcctgttaccatctcagctctcacccatgcgtagcccctccagacagagctggccactgggagggctggccaggtgggaccaacaatatatcctcttgggcccctccagagagatcaggcaggtgttaggagccatagccacagtgggtcagaagtccaggcaacccagggaggctgccaacattgggcatagtctgatcatcagcctagggcaaggggaccacagttagagagaggtgcaagttgtgaatctgccaagtcgaacttaagatctggagaggggattgagacctcagctggaatccaccagaggagtcccttctgccctccaggtctagggctctgcaggctggccttgtacaggctgtagggctaggggctggggcaggccagtctccaggaacagctctgtctctggaaagtctctctccagagacctcccgcctccaggctggcatgcggcatctctacaagtaactattcccttactctgccagagaaagagtggtcaagaggacaggtgttggagttggccgaccagagtatgaatcccagctctgtaccttccagagacttctcctctctgagcctcagttttatgttattaagtagagataaggatcttatctcgtagggattccatgaagattcgatgagaagatgttggaaaatagctattaccggttgggcatggtgactcacgcctgtaatcccagcattttgggagcccaaggcagatggatcacttgaggctaggagtttgagaccagtctggccaacatggcaaaaccccatctctactaaaaatacaaagctgggcgtggtggagggcgcctgtaatcccagctactcaggaggctgaggcaggagaattgcttgaaccggggaggtggaggwtgcagtgagccgagatcatgccactgcactccagcctgggtgacagagcaagacttggtctcaaaaagaaagaaaatagctattacccttataatgatagctgtggttattgtatatcctatagacctactaggctatattatacaatacagctgttmtttggcatggcagctmaagcccccagcccaaatttggaagcttcttcaaggaaaatggtgaaataacataagagtggaggatgctcaatttttaactgctttatctggagaaatatcttctggcttttgctcaagtttgaacaggtggtttgagatcgttcttattttatggcgtttgcatttgtcagtcagcagactctatagatttctagttctgtactggaggctcaggtgaacaggacaccacgcctccagccaacctcatctgggaacagcctcgaagccaggtggaggagcctgcagcaaaatgccgggttaggtggccccaggggtgtatggccatgtacaacccatggggccgtcttcccactgggcagtgcagcgggactgcgtgtctggggcttctagggctcgctggctctctgtcaatgcttcacaaataaaaggtctttggttaataagtctgagaagcactgcatcgtaaccctctgcccctgagaacatcgcagtctgcacaggcatcttaaaggctctgagaaggcctgcagtaaaggaacctattaacccgctgtctcctaaacttgggttcaccctgatgaggggatggtgccccaggctctatagcacgacatttgtatagctggctctgtggtctggggctgctctgggcacctctctgggtcttcatttctctataagcgaaagaagggtgtctgcatttctgacacatcagaatcccaggtttgctcaccatggactcaggagagcacacaggggacaacgaacgtggagccagcctggacccacagaggaggtccagattatgtattttaaaattaacgtgggaaagatgaagctaagaaatttatcattttatttggaaagcaagaagataagactggtaggctttggactattctaaaaaaaacatttatctgttcccgatgaatgatgaagaaaatgatgtaatgaaaagaaaagacagctgaatatcagagtgttgaggaaatatccaaaatccagtttctcaaattccagttctgttttctcctgtgtccctggagggaagagagggrcaggagctacacgggttcctgaggtcagtagacccctgaggtgaccccatctgcatgcaccttcccttaggactttgtccacatcagaactaatcctctttagctctccacggctacgtggagcggcggtgacttgccgccatgtttctttctcgggaacacacgcgtgccatgcagggggagacctgccctcatctgtcttgggttggagttgatgggcttcccattcttgggcagagttacagctacagaaatgcttttctggatctgctttcttcagggtgcaggaagcatcagtgcagatatgaattctccctggagtttttagtctcatgttactggccaaaaaatgtaaagcccagccgtgagaggatggctggatatgaccaaagctcaggaggccaccattagggcagggaayggctgatcacgtcccctgaagaggccatggaggcagcgtgggcagtggattgattagcgtaggccccaaagtcagtaccatggaacctccactttccctgctcaccagccctgtgggcctgggggaagggaggtcacttaactcccagtgrgttcaaagtcatccttggtgaaccaggataagaacacctcataatgtggttgtaaggataaaaggagataacccacaaaattcacatggtaacttgtatttttatcaaagcaggtgagcgggtcctctgtgtcttcctagggtttctagtgtggccccgcagggcggatgctgtgcttggggctggctgtttgttagcactggcatttctgagctccttagctaaaggtcatgccatcgggtgttccttggccatggccaccttgctgactcaaagctaagaggacttctcagcttccagggtgtcttcagaagcaaagtgaagtatcagccaaggtttcgcttctgaggtcttcaatatccgtcacagtgatgactcaatcacttagggtgagtcagggtgagagttttggagatcaaaatagttcctcctaggcaatgccttccaactcatgctccccagcaaggaggtgcaacactcagggccatttttctaacccttgatctgcttcctggagttttaagccactggatttgcacagacacgctgtcttgtcacagctagagctgaaaaatcaagccccgttggccccactccaattttggtaattagattggacccaccctaacttcccctgggattttcaattagatatgggatgcttcttcccaagcagctgtaatctgtcacccgctaccctgttaaacagatactgcattccaccccagaggcaatcggctgccctttaatgatgagaaaaattgcccctttatccctcccaaccctgggaatccctgaggcgagtgaatgtgtgcctgggagtgtctggagggtctcagatgctttccccaagtggcctgctgagtcctctaagacattcattattcttaggtgatttgcaaacagctcacattggaagctgcaaacacacttaatccagttgtggccaactcagagcctttgatagatgttttctttccacggggcagggccrggttggcttttataactgagcaatgaggctcataaaagccctggtcacaatgcactgtgggctgccctgggtttgatccagcctgacctttgtgatttgtcagccccacctcgacatggagggaccagccctggatgaggatgaaactgtcatgtgggcctcagatgcctgggctcctttacatgctgccagccctctgcttttctctgcacttcagcaaatgttcccgggatagggctaggggcctcaaagctgaggaagacacaataccttcccttaaagagctaggcaagtaaaagccatagaaaatgcaacattttaaatgcaaagtaatagccagaatgtattcaggggccacatactctgagctgagagctctcagatgtgacctgccgtcgtccttccacctctcctccaggtgggtgtgtcattccgagtttacagtgaagtgcaggctgttgacggtggtggggctgggatttgaatccaggtccctctgcctccaaaatccatctccaaaacccwtgttcctcacttgagtcacaggatgggaacattcaagacagtcaggtggggggtggcgagacaggcgtgggtggaggagagaagtttccctggaagaaagtgagaacgtcaagaattgaattcgagtttgcagggaaagttggtgtttctcacagaaggaacagcagggacaaaggcatggagttgctgaactgtgttgtgttgggtgtttctggaaggtaaaacggaagcagcaggacatgggagattaggctggattgagaggccataaatagatcttgcctttaagttttcatcagggtttgtaagtggggagtatcagaagcaagtgaacaacccaggaaatcacyggtgaatggagggttgaaggcagtctaggtgctcagcgtctgtctccttgtgtcccaattcctgccataacagctacagctttccccattccatgcttttgctcctgctgttccctctgctggaaatgctcttccccacctgaagattttctggatttctggatggatttctggattcatcttgttggaattaatgtccctctgtctctgtctctttctctctgctttcaatgcagttttttattttaacctctattcgaacagatttcatgtttttaaacaaatgttacaagtaaagcacaatcttcctaacaatctgggtagtaggtattayttccactgttttacagatgaggaaattgaggcttaaggaggttaagagccttttctaagaacacatagctgttgaacggggaagtggggattcaaacccagctctgtctgagtgcaaagcctgtactgcctgaagttgtcaccagtcatggctgttgctggcagcggattgtcaagcccttaaggacactcaagtccgtgtcttagtacagaactgcctggattcccaagcatgcctggcccagaatcccacacatggctggtgctcatgaaagatccatagtgctaggctgaaggttctgagcctctcctgggcatactgaaggagtggaagacaagaaacctctctaacccatcttgccaagaacactggtgagtcattaactcagcgtgctccagccttctgcaggctgtccttggctaagaaagcagacacctcatggttttctcaaagaacagggtgggaatcttgggcttggagtgacccagaccagtgatggggtgacctcatataatggttgatttgttccagctgtaatttccaggaatcaaacctgtctctccatgatgccagccacaaactcatcaaatgtctggaggtgttttgaagggggagccacaagccagaacaaggagaagccagcttttatttataaggggagaggttgttgattacaccctgtaaccagttcttccatgcagattcatagcaaacagggaggcagcatgtcccccctttccctgtgggtacctttgttctaaatataagcatccacgccagctgctcctccaccacaagatgtgagcccaagcacatttatgatggctttcagtgtcctctctgaccaggggggtgtcccctgcctcagcatgactctggggtggaagggccctgtcagtcttttacgaggctcagttgcctgtctgtcaccaagcagcacacattgatgctgacacagggatcatcagaagaataacaactacctttattgagcacctactatgtgctggtgctctactaggtgctttacataccttttctctgttcattgtaactcctttataaagttagtgtcattgttccttgcaatgctgtgtatactgacgctaagctatagagaaatcaggggccttgtcttacagccagtaagtggcatgactagaattcagcctcaggtttgtgtgtgacccttaaactcagtcccctccgccatcatgctttctccatattgctaggtgccaaacacttgagttctatgccagcattcctacaaaggtgcctataactggatcggttactttgtctctccggacaccaacatttttagaaaactaaggaggttgaagaagacatcacttgggtcccctcaagctctctgtgtttaagaagttgttggctaaagtgcagtagtgccccagtggccaggaatcccaagtcccctcctttgcttggatgggctggctcccttggtcattgagtgctgggggaagctggggaaggctcccttggccattcagtgcggagaacctcctctccccttttggtgagaagccttttagaagaagccttgggtgtgagccagaaggaggcggcccttctattacatggttgggagagtagcatgattcctgtaacaagcgcagaagtctctgacaacccagtggaactttgaatcaaggcctgatgaaaggtcacagcaggaagggacctcagaggtcatcttgtccaaccccttccttttacagatggggaaactgaggcccagaatgagttagtgaccaagctaggactcaagtacaggtccggtctttcatttcatgtctcaatatcagagataaaagatagactccctttctggaaggaggggaagacagacttgaaaacaatggcggtgtgagtggtaaagggttatgcagagtctcttgatttccagcccggtgcttttccactcctgcctcctgcctccccaggaygatatttagtaggattctggaatgtcaatgttacagtggcctctaaagacctgctggtcttgggatggcaaatctgtggaatgtgggatgcttctttctcttccctgaccatggcaggcatcacaagtgggtcactaaggcctcttcccattgagtccatatgaggcctcagtttttttcacagaactccagccaggcactaccaatcaatcagagttggcacatgagatatacacggcctgccatttctggttagctccacatctccagcaatgcacactgagctctcactgtgtgccaggcctatcctgagtactgtgttttaggtrcgtcatctcatttatcctgacaaccctgacctcaaagtaggtcccatcatgattgccatgtgcagatgaagaaacagatccaggggtccccagctcactaccagtggagctagggctctgccccrgtgccgtgaccagtcctcttccagacagcttgctgctgtgcaggtcttggctgtgtctagaaactgtgccttccccactagactgccttagtgacatcttcccrttttatctttcccaaaggaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagycaggcctgcctggcccaggtcagaggattgttttaaatrattgtaaaaaccaaatcttctggaactgtttgtcattcttgggtcatcaaatgccattgatttataggttgtttcccaaataggttacagggatgagggtagatttggaagcattatcagttcacattttcacagtacaaaaatgttttgttttttaaggtgaaagggctcttagagatggtccaggccagggattcatactgaggaccatgaacatctaaaagattcaaagatagtcttgaaggggtctgtgactctgcacttggctgaagaattggcacatatagacattattttctgggaaaggaggccatagcttttgtcagagtgtcagaaaagttctttttctttattattattaattttttttacttttatttttttgagacggagtctcgctgtatcgcccaggctggagtgcagtagtgcggtcttggctcacaacttccgcctcccaggttcaggcaattctcatgcctcagcctcccaagtagctggaattacaggtacatgccaccacacccagctactttttgtatttttagcagagacagacaggggttcgctatgttggctaggctggtctcgaactcctgacctcaactggtctgcccgtcttggcctcccagagtgctgggattacaggcgtgagccactgtgcccagccagaaaagttctttttcttaaaaatatttaaactactggtctagtgtggccaggttattttacagctgaggaagccctggagagcaggtgggccacaggtccgcagcgagttcgtggcgggcagtgccaggtgtttccccatttatgccttgtttgttcatgaaattaaccagggactgtccaacggagcagctcttttgaaccttctagcgccacactctttttacaggcaagcataagtagggatcccctgttacatctgggatctacctgggagctaatatcatgagggactcagtccagtgggcggcctctgtgcttcctgacctatttgtagctctctatagagcgctttcgctattaccacagcctgaccatggccaaagctggtggcactggggactgacatgtgtggcaggtggcatgggaggatgaaggcagagctgtgatgactgccagcttggttacacccagcctttctgtgagtgttgacgatgctcccgtgcgagggagccaagatgacctgggccccaggtttgcccccagaggccacagtcaggtggggagatgccgtcagctccatactcacaggtgagactaacataaggcagactgggccaggagaaggtcattctcctagctttggccttgcaaatgtggtgataatcacaccagcaaggctgtagaggtttgatctggggctcatctagtcagtcgaggagaactcagcattgcaaacatgcaaatgctccatacaaggggtgagctccagagagggtagggcataggcagggatcctgctttgaccctgctctaccacatcctctggaagcattgcccgaatgacttttccatgccgtatgtggtgctaggcacctggcacacagagacaggcagctcctgccgctctgatcacccrtgccaaggtgggcttctgcgaggggtttcctgggcacgtgcacgtgccggcatctgcctgctcagcttccagtaaactcaggtatacctggactaccatgggctcccctgagcggctttccaagtataggaacagagaggctgtgcacgggaccctcattaaccaagtcagtatcaacatgagtttctggtcacctggggctacagttcccaagccctgctcatctcctakagaaccatgtccgcaattgtcatggcttctgcttttatggaaacccctgaactagatcaaaacaagaccccatgaagctaacaccttgcttctttaagaatattgctttactcaatttcttttcgaatttcatagaaaatagttttgtaaattttgttctgttaaagaagttgaaaagaattaaagaaggcaggaagtcagagtttgacttcccctgggccagttaagagccaaataacctcgggccagttccttcctctctgtctccccacgtgtaagatacaggggctggcacaggggtccccaggcctttccagctctgaggtagaatgccagagactgcagcaatgggccttttctctcttaatgcctccgcctctctgtcccctcacagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggyatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcaygactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaacccygccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactytgggtgccccactgggtccctcccacaggggcaggcaagcctaatgggaacccgaggcaaaaggaaacatcagtaatacgaatcctgtctttaaaactgtgatgttttgttcaccatggatttttttttggggggggggccttaattttaaaaatattgcattaaacttatttatcttgcttattgagcttttgggtaccccttaatttttgtgccttaggctagagactcacctgcccatagccttgactctaggtaggggcttgggaattaggaccacagactgtcagcgctgggaggttcttagagggatcatggttttcacacctttttaaaaaaagttttactcagacagatgtttacgagaaacccaaatatttaagtggagagaagcagagctgcagtgatggagttagggagggtacgcagggactgctgcagccccttcctcgcattgtagtggccttggagacccaccagtgagccctgaggctctgaagatgataattacaaacaaccaacagagatcatgacctgcattttatagccaaagaaactgagggctacaggtagcagtggctggtaagtctgctctcccaaaggaagaaagacccacttcaacttggcagcttaaaaaagataaatgtggccggacacggtggctcacgcctgtaatcccagcactttgggaggccgaggtgggtggatcatgatgtcaggagatcgagaccatcctggctaacacggtgaaaccccatctttactaaaaatacaaaaaattagccgggcatggtggtgggcacgtgtaatcccagctactcaggaggctgaggcagaatggcgtgaacccgggaggcggagcttgcagcgagtcgagatcgtgccactccactccagcctgggcgacagagccagactccgtctcaaaaaaacaaaaaaaaagataaatgaggcaatggaggaactgatctaaaagagacaaaaactggccaggtgcagtggctcacgcctgtaatcccagcactttgggaggctgaggcgagtggatcacaaggtcaggagttcgagaccagcctggccaatatggtgaaaccccgtctctactaaaaatacaaaaattagccaagcgtggtgtcaggcacctgtagtcccagctactcaggaggctgaggcaggagaatcgcttgaacccgggaggcggaggttgcagtgagccaagatcatgccactgcactccagcctgggtgacaaagcgaggctccatcgcaagaaaaaaaaaaaaaaaaagataaatgaaaagaaagcaagcctgaatctgtgatttgttctctaaggaaaataaaggccttgatttgtagcatttgtcaatttctgactgtcaccatggctgatttcaatgtgccaacatgaccacactccttcagagttgggaagagatacctgcaattgcttctgtgagctgtaggagctggctgcagggaacgtggcttggcctagagagtaggcgcagagctggcacaagactcaggtcatgtggctcccagccttgggtgctgcctgatggcctcagctgtgaggtcctcttcaagctcattctacacccttcccaggactttctctgcagagtcaatgatcctgaggctgtaacattcaaacacaaacatctgggcatcaggaatctgctgccttccagagggggcacctctgctccaccggtgccctgcacgtcccagcatccttcaagtccagggcaacccgttctccgcacagagccagagcgaagggagaaagaggagcgaggccccgaccaatgtagccatctctttccagcagactctcccaaaaggaacgagagcagcatgtgaagtaatgtgacgtaatacatagatagatttttattactaaataccacgtgagtatacaaaatgcatcactgaataacagctaaaaaaagtccaagaaatgtgaaatacacattttttgaaatgataaaaacatatccatgaaaaatataaaatgttgcatatatatacaatatatttatatatatatataacaaatgaaaatcgtaaataagaaatgtatacaacagtgagtggcaaggcagtagttttacacagcggtcactttgttccagtcgatcgttagtgctatttacatcctgcgctgaggaagtctgagaaagagactccaatatagtgtcttttaaaagtcatttgcactgaaaatcaagagttttcaagttaactgaccaaaggttgagaaatcctttgtctgaagttgaaggaagacagagagtgggggccgcaccagctggcgtggtgctgcgggagggagcgtgtgccgccaccatcttaacgggcagcctgcaggagcaccactgcagacaagggtcttgggaggagggaacagtcttctgggtaggtggtaaccatggtgacattgttttggggtacggggaggcactggcaggaagttcagggagcagattcaagcataccatggggatccaggccaggggaccccctaggtctctccctggccctgacgtctgtgggtctgtgactcaagggcctcttccctcagggaaggcattcaagtaacagcgctgaggcatgtggagaggttgtgtgtggcgtggggccacgtccctgctggccccttgcaggtcgtgagggtttggatgctcgagaggccttacagctccttaaggatgatctgaattttgccgtccagctcccccatgtccagcaggaaggcgacgtggttgctgtaatgctgaatgatgttgttgtccatgttgactaagattctggaatggaagaggggatgtggttggaacacagcaggcgccctgttttcaggccttctgagtgaccaggatgagtgatgggtcatacccagtgggtacctgccacattttaggcacctcacaaaccttccctctgatcctcacaacaaccccacgaggtgagggagtcacagtctcctttactgcacaatgcccagtggccgagccacaacccaacccaggcctgctggcccccacactcacagctactgcgccggattgcctctctcctggtacacccgaggatggacactcaagcaactagtatgtagatctgggggagacgcagtgctcccttagtcaccatattgaggactcggacatgaagtgtgagttcaagccccggaggggtggtgggttgggttcaacaagaggctaggatgtgtccctcaggcatgcctgagccagaggcaggtgccacacaagcccctcccagttccattcccaggaagctgaaatctcaggaggattgtccgatagacttgaggggctaggcccactctctccccatattctccaggcaaggacctgggtcaacctgagagagacggaatcttcatggctgtgggcccctgcagggagtcagagccattgtttatgccaaagaaagagcagccctctagaagctgctcctgatgaaggacccaccaagatgtgacttgagctgatcacatcaaccttctccttgccccttccctgctgtcttctgagcatgtaatggagttgggtatatccacccacacattcaccatccaccattcattcacatacacacactccccatccatcatccacccacccaaccacacccccatccaccatctacccacccatacacacccccatctaccctctactacacacccacacacacacctacctggcatctactcgtccatctacccactcatgcaccatctacccacacccccacccatccaccatcctccatccacctgcccacctgccgtcatcttcccattcatcccctatattcactgaggcctttccatgtgcagggctttgctcaaaaacaaggaccatatggagatgaattagacctagttcctgccttccaggagttttgaatctagtagggactgggaggatgaatcctcatattaccccagttcataaatggggaagctgaggttcaaagaaacaaagttatttgtctaaggtcacacagttcatagatggcagggctgggatttgaaccttttctctttctactgtatcatttttagaaggaaacaaagccctataaatacaagttaagaagcagcagatagaaggaaggcaaaatccagggctatgggagagttctttgaagtggcgcaggagcggcaggcacgaggaccccccgagggcaatggagacaacatggacccgaaggcatggcccacatccagttgtctctccctgccgctctcaggaagaaggtccaggcttgggctgtcagtggtttgagcgctgactgccaatgtgtaatcataggctcccctttcttgggtcctgcctggagttccttcatttcacagagggctctttgggcacgggaggtcggaaacagaccaggggagaccagaactgggcagaggggtgggtcctttttcaaaatcagggttgttttgtctgccattgattgcgtgcttctaggtgccaggcactgtgaagtaactgatatgtaccagctggaaggctggatccgtcccactccctagcagggccttccagcgccctgagctcacacctgctcacatctgccaagctcacacctgctcacacctgcacaagagggcttccagatgggcccacagacccctcttctcaaaagttaatgacagcgggcccctgagaggcagtaccactgtcaccaaatgtgggcctcttgttacttgccaccttctagctgtcttcagtcctgagtcacattaaacccctggccagctgccagcaaaaacaatgtatttgctcatctttgcagcacttagtggggcctgtaaagctgactctatccaccttcatccagaggactttcgggagggttttatgaaaataaaccaggcctttgatcagaatttcctgtttctcacatgaggactcagagggaggcagaagatgagcctggcctctcctctcctaagatctattttggggaacactgtcattcagacatttcagacagtcctggggctgatgttttcacggccgtgggggtgtgtggggtgcctgtgaagggctgctgagtgatgccctggctatggtgctgggcaaataaactggccagcctggctgcatcctttatttgcacattgcgtagtgattagaggaacaagcaggaggcaggataacagagtggatgcctgtacaggctttagaagtccaagatgcttctgccagttcctaactcatgaccttgtaactactgcagacctcagtttccccatacgtacaaacagagataatgatacccagctcaaagggtcaacgagatgatgcttgggagtgatgcagcccagtgcctggcatgtaggaagtgccccataaatggaaggttttagaattatgatttcaatagctggctggggcttaaggggaagcctctggcaactcagccagtggggctggggaacatccttgtacacacaccccaccctcccacccccccatgcaatcacacagcctggcctggagtgggattggtaagggaggcctgccacaggtggggctggagccagggggcatgggcactggagctgaagggagagtggggctgggcttgtctggggaaagcagagcctgccctttgccgtgaagtggatttcactctacagagcatgtgagactcagatggaaaccgaaacttggaaaaaaaagacacacgaaaaactctagacatgcatgcagctaaaaccaaaaaaaaacccccttcccaggggctgcagggatggacaccttcccccaccctcagccttctatggaaggctaggaaggaaccaaggaggaggaaggcaggcagggctgggcctgtgaggaaggcggccaggcccctaggcctgatgagatggggattcagcttgagtacaaaacttgcctcgctttgcaaagtcttctacaaaggaagatccacttgcagtagccacggggcaagtggctgagcacctccaaggggctactagcaaatgtcgctcgagttagactatccacagcaagaggatcagattggagctgtgggcagaggggctaggagtgcatttcccagggctctggttctggggcctctgggctggcaacagcaatgacaattcctcactgtctgggggccctatgcc

SEQ ID NO: 12497 - DNA, 80581 bp, Homo sapiens
aaattaacagtgattggccaggcacggtggctcatgcctgtaatcccagcactttgggaggctgaggtgggcggatcacctgcggttgggagttcaagaccagcctgaccaacatggagaaacccagtctctacaaaaaatacaaaattagccaggcacggtgatgcatccctgtaatcccagctactctggaggctgaggcaagagaatcacgtgaacctgggaggcggaggttgcagtgagccgagatcgtgccattgcactccagcctgggcaacaagagtgaaattccgtctcaaaaaaaaaaaaaaaaaaaaaattaacactgattgtctttggagtggtagaaatatagactattttttcatctttctgctttttttggtttctcaaaagaaatgatttttataatagaaatagctgatttcaggccaggcatggtggttaattattgtaatcacagcatttttgggaggctgaggcaggtggactgcttgagctcaggagcaatatagcaagaccatgtctccacaaatgatttttaaaaattagctgggcatggaggcgtgggcttgtggccccagctatttgggaggctgaagtgggaggatccctcgagcaagaggttgaggctgcagtgagccatgtttgtgtcactgcactccagcctacatataaaaatcacatttattttatgtcttaaaaaaagaaaaatttgtctgggttgttgaaatgaccgatgtaacatctttatatttgcatacacagactataaacacctcacttggggtgacagtgataaatcggatactaaagtagctacccaaaattagtagtttttgatagcagggtctcctgagaaaggatgaaaggtgaaaggacgccaagaattagtatgagaagctgtccttccattatgcagaatactcacctgccatctgtgttgtaatgcaattccatcactgctccactgtgtcccttcagtgtggcatagttatcacagtcaccatagacattccacagtactgttagggagatgggttctgtgagcattactaggcaaagggtacttataaatttatcagaacaacagttctcaggccaggcacggtggctcacacctgtaatcccagcactttgggaggccgagacgggtggatcacttgaggtcaggagttcgagaccagcgtggctgatacggcgaaaccccatctttaataaaaataaaaaaatcagccaggtgtagtggcagacgcctacaatcccagctcttgggagactgaggcaggagaatcacttgaacccaggagacggaggatgcagtgagccgagatcgcgccacggcactccaacctgggtgacagagtgagactccgtctctaaaaagccaaccgaccaaccaaacaaaaaaaactatgtagtttgtctgatgaaattaagcctatcaataattcatatatgttctgcaaagatccctaagcaatccagacgtttggccactagtaagcttaaggatcatagagccggaacatccaaatcaaaatgggcagtgaagacgggtatcatccacccggcaccgaggaaaagagttaacagaaaagagccaaataactcatttcatctcataatctggcaagaaagtagcaacagaagcatctgattttttttccttctggcttcatttgctggagtataaataaaacgactttttctacttacttctcaaaaatgggtatgagaaattcttatttctcaaaaatggaaatctggtagtagatcctaatgatgtacaggtagattatttaagggagttaccactttaggattccttccttcccatatgctagctaggattctgggtgtgaattaagaggaccttatacctttgggaaaataaaagttatttctctcctcattactgccattaacctgttatgtctagattgctaagtgccttggtaaattagctggagatttgcctctatgaggaagacattctcaaaccagaacaactcactttccaactagtaaaataatggcttctgtatttaccccatggactccaagttctacacccaagatcattcagcatgttcatgccccaattttagcatattagccatgcagcctgttatgttgccaacatagagtgataccttctgtggcacccaagatttaaaaaaaaaaatcactatctggcaggaaaaattattccagattcaaaaactatgcctcacatatcagtcggtcaaatcctgcagatgctaaggtggatccgttggggtggaacttgcagcagtagacttccccttcatgtccagagagcagcatgattggggcttgaagggaggaacatcttggaggtccctaaacaaaagagaagcacaaggtaactactgcatacagacaaaggaggctacaaaattagggggtggggagtggagggaaaagaccaagaaaacaatgattaagtgggtttcatctgacttacagaatggtagctcttctcatatgaatgcctccaacttgacactctctgaaactttccattatctacctgttataatgactctcttgttcactctctcagctcttgttgtacgaccaacttttttttggagatagggtctcactctgtcacctaggctggactgcagtagtgcgatcatggttcactgcagcttcaaactccttggctcaagtgatcctcctgcctcagcctcctgagtagccaggactacaggcatgaactagcatgccatgctaatttttttagtttttgtggagatgaggtcttgctacgttgcctaggctggtctcaaaatcctggcctccctccttggcctcccaaagcactaagattataggaatgagccaccacatttggcctggctcatttaacaaatgatggaactgactttcccaacaactctgcttggtatggagtactgggtgaaatagttttgttttatttttaattttttttgtgtgttttgagacagagttttgctctgtcacccaggctggagtgcagtggtgtgatctcggctcactgcaacctatgctttctgggttcaagggatctggtgcctcagcctcccgagcagccaagattacaggcatgcacgaccacgcccggctaatttttgtatttttagtagagatggggtttcaccatgttggccaggctggtctcaaactcctggcctcatgtgatctgcctgccttggcctcccagagtgctgggattataggcatgagccactgcacctggcctatttttatttcttattttttcatagcaaacggatcctcagcatgggtgaagtagttttgattatggtcttggacaccaagatgacacttgggcaattcatctaaacatgggctgatatgctcacttgtcaaatgggagaagtatactacccataatccccaaatctcttcagtacttcccagcattttcatatttatttatttatttatttattttttggggaaggagtcttgctctgttgcccaggctggagtacaatggcgtgatctcgtctcatcgcaaactccgcctcctgggttcaagcgattctcctgcatcagcctcccgagtggctgggattacaggcacccaccaccaagcccggccagattcatttagttttaaaaaatgttatgtgcaggctgggcgcggtggctcacacctgtaatcccagcactttgggaggctgaggtgggcggatcacttgaggtcaaaagtttgagaccagcctgaccaacatggtgaaactccgtctctactaaaaatatacaaaaattagccaggcatggtggcgggcgcctgtaattccagccactcaggaggctgaggcaggagaatcgcttgaacccgggtggcggaggttgcggtgcaccgagattgcgccactccactccagcctgggtgacaagagcaaaattccatcttaaaaaaaaaaaaaagaagttacgtgctaggcactgggcaaacagcaatgaacaaaataaacaatggagctcgctgttccagtgggaaagggggaagggagaagggaaggtgagagaaaacaagcaaactatatatgtggtgtcatgtgctatagagcaaaagaagggatggggatggtggctcatgcctgtaatctcagcattttgggaggccaaggtgtgcggattgcttgagctcaggagtgaaatcctgtctctacaaaaaaatacaattagttagatgtggtggtgtgtgtctgtggtcccagctactcaggaggctgaggcaggaggatcacttgagcccaggtggtggaggctgtactgagccagtggtcaacacagagagattgtctaaaaacaaaaaaacaaaaaaagagagagagagaagcaatgtgggttccacagtatgtggtactgcaatttaaaatagggtggtcaggaaaatcctcactgaaaaaattacatttgggcaaatattcgcaggagctgaatagtaaaccatgtaaacatttgtgaagagcaatcccacagagaggacagcaaatgcaaaggtcctgaagcagaggcttggaagagagagtaactgaagccaggtgagcaataagaaattggtcagagaggtaaagggaaagagggcaaataattacaagaattttggtttttactctggatgaagtacaaagccaccagaaagttttctgcagagtgtaatgtgatctgatgtttagaaggattcctttggttattggcttggtaacaggtgctgatacaaaggtagaaagtggaagaccagttagggtcccactacaaaaatgccagatgagataataatggcttaggccatgaggcaatgatggagatggtagaagtagcaattctagacctattttgaggacggtgccagcaggatttattgaggagatgtgaggacactcgtatttcctcgtctgagcctaaacaggacattagaagtgtgatcactatttctatcttacaaaaaatgtagttaggagcatggtttctcagttcgaaatctgcttctatcacgtacttggtaagtctgtttttccatctgcaaaatgggttaataacgttcctaacaggctgctaccaagatcaatggaaatttcatatacgaaacactttagtacaagagtcaatgaatgttagctgctatttagttgttaataataccagtgcagagaaataaagggaaaagcaacttgcccaaagtcccaaaacgagccaacacaaatcatttcccttttttcttccctccctcattcattcattctacacactcttcggaatttttgttctatgccagatccatgttagagtcaggatgcttaaacccgggtcagggttttgagcccaaggtcctcaactctaattctaatgctatctcagggcagtcgagaggctgaaaacgggcgccaaacgggggaacacgtacgcagcattcgcaggctatggggagcttttacagtgtttatgtgctttaactctgcgtagaaactctcgttctgcccccgcaatgcgggaaagggtcagggatcaccagatacagcgctctgaggggaggaagatgagctgagggccaaaggccgcctgcttcttcacttaccgcttgcagcaaggctcccggcgtcgcctgctgctgcccggctcctgggccagaccccgctcccaacagcaactcatgccgctgccgcttgactggaaccagcggcaactctgggcccttacgcttctgctgttctatcatggcggcaaccggtctcttcagcgccgccactgaccgcgctgccgctctcaggcgccacgcaattggttccaaattagtccttcctccacaacttccagcttggaagaaccaatcggctttcaatatttccatttgcaccgccctcggatagtctcttgttattgggcatatctttctgacgtcatgagagtgcgataccaggattggtggacggagctggcgaccgccctaggcgcgctgggtcttgtgggtggaaacrcgctggctgactggggtcggcgtttagttcagcgcagcgactcggggacctggagctgacgcctagtacgtatgaggaagaacggggtgggtggctgcctgagtctggaggcgacgcctcggttgtgcagtctgaacctgcccttctcagctgagggtgctgacagcaaggggtgggaggcgggccccgagtccccagctgtggtaagtagtagcctgggctccctttcggggcaggagcggagccttggggtctctggcggcaagacccagcccctgcggctcccttcttcaagagcgcccatcgtggccagtcctgtgccgggcattcccagggagaaaggcctgcgtcccagcctcctccggtgccccatttggccgaggaggctgacttgtttctgccactgattttgcagtttttgatcagggcctactgtatgcccccctgagagagacagtgatgaaggaaatgtccgactccttctccagagcacagtcttgttgagaaatttgagactcatgcccatgaacgtggtcattgcctcagtcgtcctgctgatattcatttagcagcgcgttgggggtatgttgtgaaccgggcacggtccctactctcagggcgtttaactctggtggggaaaacgttaaacaatgacctcactaatacatggaaatgcctcctactgctgcctgatgctatgagtgcctgaaataagcaggaaggtttttcagaggaaaagatgcctgcgctggtagctgcaggaagtgttgtaattaattaggtgaagaagtgaaggcagaaccttccatagagaactacttgttcagagccctgaggcacttgggaggaaaatgactaaaagcacaaagagccagtgtggctggtacaaagagaatgaagggagtatggtacaagatgaagctgtacgtgatagcggtcagaccttgcaggaatttgtagcttttattttaaaacggatgagataccactgagccgtcttcccccagtggggtgtggtggaggaggggacttgatccctcaggctcagtggtgtgaacagacgggggttggggaagccctagtcgaygtatgtggaccacttgggatatgcagtaatcctggtcagagatgtcagtgaggactgagatatgggtggaactgcagagaattggacagattctagaggtatataggaggtaaaatgggtgggacttggtgatgggttgattttagggagtgaagagaggaatcaaaggtaactcctaggtttctggcttatgtagttgaatagatggtggtaccattcactcactatcacggaatccctcaagctggatagggaacactagaagatgattagagaccagtttttttttgttttttttttttttttgagacaggttcttgctctgtcgcccaggctggagtgtggtggtgcaaccttggctcactgcaacctccacctcccaggttcaagcaattctcctgccttagcctccccagtagctgggattacaggcgcctccactgtgcccggccaatttttgtatttttggtggagatggggttccaccatattggccaggctggtctccaactcctggcctcaagtgatccacctgcctcagcctcccaaaattctgggattacaggcctgagccactgctcccagctgagatcagtttttattgattgattgattgattgtgtggggtcattcatgacatccaagaggcagtttgaaatacagctttgtgctcagaagagagatttgtgttgggaatataaaattgggcataatttgtatatacatgaattgagccataggtgtgggtaaggtcagctaagtcagaaccttgactagttccaacatttaatggtgaagaacaggtgaacctacaggagatacagaagaaaggaaggaggactggaagaatgtctcagaagcaaaagaatgatttgtgatagaaatttctagaatttaaataacatgaagattgaaaaacatattttggcttttatcatcatggaggtcacagtaaccttagcaagagttattttgttggtgtgattgggccaaaagccagatatgaggcaaggatttggacaagaaaatgtaggtagtgaacctacacagtatttttcatagatctgattgtaaagaggaggagaggatgtgctaaccgatggggataagggattatccaggatccagttgaggatccagttttgagaaatttgagaatattgtagaagatttgaaagtcactgtggagtgtgggagaatgaggttactagagaaatgtaggatgcaaggaaaaaaaaaatttttttccagcatatccagcrgtttagtgcatgcatggagaaaacctttytgggtatggcaaggacatcgcttgctcaagacacattctaacctctaatatgtcttctcttcctgaaaaatctggaaaactaaaaaccattttcttgactcccttgcacctaaggtgaaaattgaatttggaactgagttaaatgtggaaagaaggagggtgtgagtcatccagttttgctgccagtcatggcagtaaatttctccagtcaatarctccctggtttggtggcttgctgcagtgatagccataacttycctggattgtggcaaaggtggtattattttgtgggttaggtgttgttcctggaagttctgccaaagtcttttattgcartacatcccttactgcttaagtgggttctgttgtctgcaactgtccctgaccaggttagaggtactgccagagagttaaatataaagacagagttaaagggagtttagggtgttgttggaatgatgggctatggaatctaagctggattggaagaaaactgaagaaaaaggggagggctgatagattggaagaaaatagaggccaataaatcagggttctaatgaggtcaaagaacagtattctctgctagaggatttctgtttatcctaaaaggcttattcagttatctgtttaacttctctacttcccccagaccctctttctcttcctagctactacttttgtttgtttgttttgagacagtcttactctgttgcccaggccgattgcagtggcatgattatggctcactgtagcctcgacctcccaggctccagtgatcctcccacctcagcctctccagtaggtgggataacaggtatgtgccaccatgcctggctaattgttgtattttttatagagataaggtcttgccatgttgtccaggctggtctcaaactcctggcctcaagtgatcttgctgccttggtctcccaaagtgctacgattataggcataagccaccatgcctggcccccaagcttctgctttagcacttatcacattgcagtgtaattggtgttattttgtgggttaggtgttgttcctggaagttccgccaaagtctgttattgcaatacatccctttctgcttaagtgggttctgttgtctgcaactgtcccgggctaggttagacatactgccagatagttaaatataaagacagagttaaagggagtttagagtgttgttggaatgatgatatctgatatccctatcagattaggaggtctttgagaacagggactgtgttgaaaagggtggtttaggccgggtgctgtggctcactcctataatcccagcactttgggaggccgaggcaggtggatcacctgaggtcaggagttcgagaccatcctgaccaatatggtgaaaccctgtctctactaaaaatataaaaatcagctgggcatggtggtgtgtgcctgtaatcccagctactcgggaggctgaggcaggagaatcgcttgaacctgggaggaggttgcagtgagctaagatcgcrccattgcactctagcctgggtgacaagaacaaaactctgtctcaaaaaaaaaaaaagaaaaaaaagggtggtttagtggcaagtgtgtgtggcccttggaatggcctaagatttgtctctttcttgctgtgttgttttggacaagttatttcattcctgtaaaataggattacttgctttgtagaggagttttagggattgaaagcaggtttataaagtaccttatatataaacatcaatcaatagcatactgaattgatgaattaacaatttaaatggggtaaaattaaatayttcactattttagtagacaatttccatgtgtgttacactgtgctaggcactggagatttggggaggaaggatatgatgatgtgcaagacaaaggcatgcttacaagagttccacactctacaaagggaggaaaaaaatgtccctaaaaatgatttgaatcccatcyccatcattcatattttgcaatcttgagcgagtttacttagcttctcttgtgtcctcatttttaaaatggcaatgataattgcctgttttatgggatagtcaagaagagaattattgaatgtcatgaagataaaattttaaaaagaaaaattagttaagagaagtaaagctcttagattaatacatggcagatatgaagcactcaaatattagctattataagactttgaagggatcttaggaataattgactgaaagtgtagtgtcgagtggtagaataagtgctgatcctggggtcttataccartgttgctaactgtgagcagcctttgtcaaatcacttggcttcattttcagtggcctaagagtaataggtttaattatttccataattcctttaagtttttacattttctgagttcatcttttgtgtttttcctggcattttactattcctctttcctgcttttggctattttctcaacaggtccacgactggaatttgaaagcaagaagcatctatcttacatggtcactctagaatttggtgggagggaggaaagttggaccaccagtttgacatttgaaagtgtcccggccgggtgsggtggttcacacctgtaatcctaacactttgggaggccgaggcgagcagatcacttgaggtcaggagtttgagaccaacctggccaacatggtgaaaccatgtctctactaaaagtacacaaattagctgggcatggtgttgcatgcctgtagtcccagctacttgggaggcagaggtgacagaatcacttgaacccgggaagtggaggttgcagtgagtcgagatcgcaccactgccctccagcctgggcaacagagcgagactccatcttaaaaaaaaagaaaaaagaagtgttccatctgttgatctgtccaacatattaaatgggacctagctccttcttcttctatatcctttagaccagaatgtgttcccccctctttctctacctgtgcttggcatatagtgaggctcagttcactcatttaaaaaaaactgagtacttgtagtataccagaccccaggaacacaaaatcaaatgagaaatggtccttggtttcatgtttgaatgaatggatccagacgttgctcatcctagctcttccatgaatgatatccacattgattcctctaatgttgggacctagttagtgttagagctatattctacaaaatttagatttagaccgtgtattagcccattttcacactgctctaaagaactccctgagactgggtaattataaaggagaaaggtttaattgactcacagttctgaattgctggggagtcctcaggaaacttataactcatggcagaaggtgaaggggaagcaaggcacgtcttaagtggtgtcagaggagagagagagagagcaagagaaactgccacatttaaaccatcagatctcgtgaaaactctgtcactatcatgagaacagactgtgggaaactgccatgatccagtcacctcccactaggtccctcccccaacatgtggggattacagttcaagatgaaatttgggtgaggacacaaagccaaaccatattcgattgtgaattctttttgaggtatagtgcttaagaatgcaggctcttggccgggtgccatggctcatgcctgtaatctcagcactttgggaggctgaggtaggaggattgcttgagccaggagttcaagaccagactgggcaacataatgaaatccagtctctaccccccctcaaaaaaaaaaaaaattagccaagctcgttggtgtgtttctgtcccagctacttgggaggctgaggcgggaggatagcttgagcccaggaggtcaaggctgcagggagccatgtttggaccattgcactccggcctggacaacagagtgagaccctgcctcaaaacaaaaaacaaagcaaacagtgcaggctctggagtcattattctgtctctgttcatatcctagtagttttagttagcttactttgctcacaattccagcacagcttaaagataaactaaaattcctttaaattcttagggttctagtcaattagtactcaagtaacaaaaaaatctaaatccaaacaagctggaaaatgataacaacaaaaatcttgaccaggtcagtaaggtgacacattaaatgaagttccaaaaaggctataaaatgtctggccaatttaatattgttctttaaacttttcattgcttgggggataggaggacaggatgtgtagggtttttttcccagttgcatgtgtactttaaaatttttttttgaaactatcacataattatggaagcatgtacagataacatttttctgaattatttgagttaaattgctgacccaataccccaacagccctgaaaactttttttcctacaaacaaggacattctcctctatagccacagtgtaattaccaacattatgaaattaacattgcattacttctttgatcctcaggccccacctcttgatgctcgagctctgactrcccattctgggctgctccagtgtgtgccttcatcaccttattcttccctatattgcagttctctttgtagatttcctcctcacccagcttagactctgacctcactctgggccaccatttcttctcctgtatcctttacttccatcccatactttcctttctctgtcccttgttttggaaagagagtggctagtaattggtcccctgttgcttccctatgtaacacagttgtttaaaacatgcaagcaaaatgctttgttctgcattcagagctattgcaaggcaactccaaatggtgtacctcaatccttgtcgacttactggctcttttaagtgtatgaatgtggtcctgtctgactgactgtatctatcttaatgttatatactcttttttttttttctttctgagacagagtctctgttgcccagggtggagttgcccagggtggagtgcagtggcatgatctyggctcgctrcaacctccacctcccatgttcaagtggttctcctgtctcagtctcccgagtagctgggattacaggtgcccaccacaatgcccagctaatttttgtatttttagtagagatggggtttcatcgtgttgcccaggctattctcgaactcctgggctctagtgatccacccgccatggcctcccaaagtgctggtattaacaggtgtgagccaccgtgcctggctcaatgttatatactcttattttttttttttagacggactctcgctctgtcgcccaggctggagtacaatggtacgatcttggttcactgcaagctccacctcccaggttcatgccattctcctgcctcagcctgccgagtagctgggattacaggtgcccgctgccacgcctggctaattatttgtatttttagtagagatggagtttcactgtgttagccaggatggtcttgatctcctgacctcgtgatccacctgcctcagcctcccaaagtgctgggattacaggcgtgagccaccacgcacggctgtatactctttaaaagtagcagaactctttttttttccaagtgaaatcttacacagaattttaatatgtaaactggatcaaagcagaatacgttgttacagtaggcacccttgcagtaattctcactcactccccctttcactgtggcccaccataaggttgggagattaactgtgaatcagtaataattgacctttgcctaattactgaggagaggcttctacccaactgctctgagtgggacttctcccagctctagtttctttgggggttctactccctcagcctttggtatggaggctcacctctggttggttgacttagaggcagcctcactggtctgggaccttgtggtgacctagatatttcagagttgactttttttttttaatttcttttttttgagacagggtttcattttgtcttctaggctggagtgcagtggtatgatcacggctcagtgcactctccatctcttgggctcaagtgatcctcctgcctcagcctcctgagtagctgggacaataggcaggtgccactatgccgagctaatttattttattttttgtatttttagtagagatagggttttaccgtgttgtccaggctggtcttgaactcctgacctcaagcgatccacccaccttggccttccaaagtgctgggatacaggcgtgagccaccatgcccggccataattttcttttctttttttwaaaaartattttgtggagatggggtgtcgctgtgttgcccaggctggcctcgaacttctggtctcaagcattccttccacctcagccttccaaagtgctggaattacaggtgtggactactgtacctggcctggaagttgactttttaaaaataaatttggattaactaaggagcctctgagtaaccgcartagaaccctcggtttctacagaatttgaaaaaaagttttatattccatatttaaaaaatgacaaccatttactttcctgaaattgtaaacctgttatagtcatacccccttgttcatgggggatacattccaagacccccattggatccctaaaattgtgggcactgctgaacccagttgctatcaattggaagacgtttctgtttgtattttctacccacaaatttaatgccttctccatcttaactaagcacttatcatacactgtggctataactttagcagtttgaggtgcaacagcaaaactaacatgaatgtttttttcttcctcacaatttcagacatcgaagattcattcttactatagatcttagcaaccttagcatacaattttttttttccccttgagaactttcaccctttcacttaaaggaagcagtttacagcttctctttggtataccaaaattgccagcattactactctgcttcgtggccattattaagtaaagaaaggattatttgaacacaagcagagatacttcaacagtcagtctgataaccaagatggctactatgtgactaatgggcacttaatatacactgagtgactagtgtatgcagcatggatacgctggacaaaggggatgattcatatcccagatggaacagagtgggatggcacaagatttcatcacactaataagaacaacataacagttttaagcttatgaattgtttatttctggaatttttcatttggtgtttttggaccgtggtagactgtgagtaactgcaactgtggaaagtacaactgtggatgggaggactactgtactgttatatttcaggctttccctcaaaaatgcatgccagtttttttttgagataaggtctcactgtgtcgcccaggctggattgcattggcatgatcgtacctcactgcagccttgatctccttggctcaagcgatcctcttgcttcagcctcccaagtagctgggattataggctggtgtcaccacacctggctgattttttttctttttttctttttgagacggagtcttgctctgtcaccaggctagactatagtggggccatctcggctcactgcagtctccgcctcccgggttcaagcaattctcctgcctcagcctcccaagtagctgggactacaggtgcgcaccaccaygcctagctaatttttgtatttttagtagagacggggtttcactatgttggccgggatggtctcgaactcttgaccttgtgatccacccgccttggcctcccaaagcgctgggattacaggcgtgagccactgtgcctggctgattttttttttttttaagtagagatagartctcactgtgttgtccaggctggtcttgaactcctggcctcaagtgatcctcccgccttagcttcccaygattacagtcgtgagccactgcacctggccccagtttccttcttgaagaattgcatggggtttcttaggccactgttctacaagaggtataaatctgggagcattaaacctagctttttgtatgcttatcacagcagaagtctgtaagcaacaatgtaagttcatttctgctttagactttttttttttttttgagatggaatcttgctctgttgcccaggctggagtgcagtggcccaatcttggcccactgcagcctccacctcaccggttcaagtgattctcctgcctccagagtagctgggattacaggcgcctgccatcacgcctggctgatttttgttgtttttttttttttggagacggagtctcactgtgtcatcaggctggagtgcagtggcacaatctcggctcactgcaacctctgcctcctgggttcaagcaattcccctgcctcagcctcccaagtagttgggaccacaggtgtgcaccaccatgcccggctcattttttgtattttagtagagatggggtttcaccgtgttggccaggctggtctcgaactcctgacctcagatgatccacccgccttggcctcccaaagtgctgggattacaggcgtgagccactgcacctggcctatgacctttgtgtgtagagtaacagatgatagattaagatgtttgaagttaatttagatgtttcagctgctggtgcccctatggattctgtacctcactaatacgtttcaagtgttggagggataataaaagtctcctgatagaacctgatagattagtaactcctgttctagcatgtgaggtgagggatactggacagagggaaaggacaggctagagatgagattgtattgctatgaaatggaagaggcaggatttaaccagaatgtaaaacttggaattaacctgtttatgagctatttctcaagaactgacaaatctgcctgtattagctctgtgtacttttagtacagtaataaaaagacactttggctgacctaagcagaaaagggcaagtttagtataaggatataagattatcttagggagcttgaggacagggatgttcctgagctgtgggataatactagaacaagggtttggatgtcctgaaaggattttctttcatttctgtttcaagtgaagctgtcaatttaatggatggtcattgtaaatcrggaatacttaccaaaatcaggacatcaagtcatcctctgaaagtgaaaggaagcagtgggggttgaggagagaagaaagtatttacctgtgaaaacacaagaaaaataatttcaggtcttactggtgtcaaatgtaattgggaggaaagagaactgaggatagtaccattagatttatcttggcagtgatttatccaacagagtaaagaggcatgtttaagagccgctagattgctggtttcccctctgtttaagatcaggaggctgagcaagattatctctaaggtaagtatccaaagctgtaagttttgctacttaggcagtatcagtgtcacctagtagctggttgaaaatgcattatctcaggtaacacctcagacctactgaactgcaatctgcattttcacataattcagaaatagttaaatgaatttggtacatccaacaatggattattaggtacgtgttaacaaaaagttgtgtatgcgtatgaattgctgtagtaagaaaatgatttcatgattccattaaaaaaccacttctacatataaaaaaactgtaagaatatagatcaaattgaattacaggtgatttcattttctttattattaatgtattatctgaatttttttattatctgaactttcacagtgtgtatgtgttttaattttatcaagaaaaaaaaagtaagcccttttctctttgaagtcacttcagatttaataccttagcatagtagttaagagaatggactctggagtcagccagtttgrctccccatttcctggctttttgacatgcttagtaatttaacttctggaagcctttgttctctcatctgtataatataatagtaatagaacttacattttaagagttttgagaattgttttgttttgtttttgagatggagttcgctctgttccttagtctggggtgcagtggtgtgatctctcactgcagcctctgcctcccaggttcaagtgattctcctccctcagcctcccaagtagctgggactacaggctcctgccactatgcctggctaatttttgtatttttagtagagatgggatttcgctatgttggccaggctggtctggaactcctgatcctgagatcgtccgacctcagcaaccacagtgctgggattacaggtgtgagccaccatacccagcctgagttttgagaattaaacgagattgcatgtctagtgcttagcacagtgcctggacatagtaagtgctgcattaatgtttttatttctgttattccatttttttgagatccggtcaaacatacttaacatcttttcccaccctcccccaaaattcttccccggcaaaaaaaatagcaaaaatagcaatttaaaaaaaccaaacacaacaaaattagtagcctaatggccttgggtaagtaacaaattgttgagaaataggatcaaggtttccaaaactccccacaattagaataaacaaaagagatttggataaaagtgtatggtgttaaatctagtggtattattctgtagagaatagctgtggattgtctgcatattcatttctttaatgcagatatctctctaattggtgtctgatttctttatgacaggacacttgtattagctttaatagaagagaaatggaggagccatagaatattaaggatgaattcaggaaggcctgagaccatggaaaacttgcctgctctctacactattttccaaggagaggtatattcttttgtgctttgaaaacccaccatttatgttaaaatagattaagggtgacaactgggtttgttgttcctgtccacttaagtctgtcttgagcattacagcttaaatgggaagggccagcggaacatctggcaatcacatgtgccttctctaagctccagatatttaagtgcgtagttgacatcgtcattggaataccagcatgtgtaatttatgttttaaaatgaatttattttttcactgctgtggtttgaatgtgtcccctaaaaagcatgttttggaaacttaatctccagtgcatcaacgttgggaggtaggacctagtaggaggtatttagttcttgagggctccaccctcctgaagggattaatgccaattattgaaaggcttgaggctgtgagtttgatctctttctctccttcttaccctcttrccttccaccatgggatgacacaacaagaagattcttgccagatgctggcaccttgctcttggactttccaacctccagaactatgagccaaataaatttcatttctttataaattatccagtctctggtattctgttaaagtaacacagaacatactgagacactcaaaaaattgtttctcttctagatgttttcacctcaacaaatagaaccactatcctgcaggttcccagactacacatctggccatcacccttgatttctcttcttgatttgattttgattttccctcccactccagtctatttgcaagtcctaattatatctctggtctatgtacttctttatccccttggcaccctattagttaaaactctctatctcttgcctggtctttactgggatccctgcttcatcgtagctcctctccagtctgttcttcacattgtagctagcataagatttttgtttttgtttttgttttttaattcttytttaaaaattgagctggggtctcactatgttgcccaggctggtctcaaactcctgggcttaagtgatactcccacttcagcctcccagagtcctggggttacaggcatgagccattgtgcttggcctagaataagatttttaaagtaggttggacatgttgctttctcacggctcttcagaagcttctcattacaattgaatacagacatggaccttccacagcttgcccctgggtgctctcacaatgttgtttgttctaccctgctcgtagtcaagacacactggcctccttaatagctttgaacagtctgagttcttgctctctctttaggatttgtgcacatgctgttttctttttagtctgtgctgctataacaaaatacctgagattgggtaatttataaagaacagaaattyatttctcacagtwctggaggctgggaaatctaagatcaagttgtcagcagatttggtgtctagtgaagactactctgtttccaagatggcaccttcctgctgcatcctctggagggaagaaatgctgtgtcctcacatgacggaagggacagaaggagcgaactcaccctttcgagcccttttatgaggcactcatccattcatgaggggcctaagggccccacctcttgataccattgaattggggattaggcttcaaagtgaatattggagaaataccaaagttcatgttgaactttagtcccccmcgtgggggtattaagaggtggtattaagaagtattaatcacttgggaagtggttaagtcatgaaggctctgcccttgtaaatgtgattaatgcccttatagaagaggctacagagagctgcctggcccctccattccttctgctgtgtgaagacacagcatttgtcacctccaaaggacacaggaataaggtgccatcttggaagcagacagtgagcccttatcaaacacaaaatctgctggcaccttgatcttgaacttcccagcctccagaattgtgagaaataaatttctacggtattttgttatagcagcaccaacagactaagacactcttccttttaactacccactttcccatcatcttgtattcatcctttaggtctcagccctaatgtctcctcagaattttttttacccatcataaataaatcggttcacactgtatttaattatatacttgtttaatgtctatcttcctcacargacactaagctccatgagggctgagttgtgtctgttttgttgtatatctcagtcttaggtggatgggtagaaaatagtaagtgcttgatacatttttgatgaccgaatgaattatcaacctttggtagagaaggcatatttgtttcaagagcagaggctttgaaaccagacaaaatcgggattctagtcccagctcttttgcttgctatgtgagcctttagggtgtcacttaatctctttgaacctcagttttcttgtttgttaaatggaggttccatttattcacagtaattctcttccatagaattactgtgatggttaaataagctatcatctataagaatacaatgcctgagacatagtaggaattaattaatgttggctccctcctcttgaagtgaaagtaaagccaaaaaattgttttcagtgtcttacaagagcatgtagtttgcttgttcatttgtttgagacagagttttgctcttgttgcccaggttggagtgcaatggtgtgatctcagctcactgcaactgctcactgcaacctccacctcccaggttcaagcaattctcctgcctcagcctcctaagtagctgggattacaggcgcccaccaccacacccagctaaattttgtacttttagtagagacaaggtttcaccatgttggccaggctagtctcctgacctcaggtgatccacctgcctcggcctcccaaagtgctgggattacaggtgtgagccaccacactgggcctctttttttttttttttttttttcttttttttgagacaagatctcactctgttgcccaggctggactgcaatggtgtgatttggctaactgcaacttccacctcctgggttttaagtgatcctcccactcagcccccgaggtagctgggactacaggcacacaccacaacacctggctaatttttctgtagagacaaggtctcactatgttgcccaggctggtcttttgaactcctgagctcaagtgatctgcccacctcagcctcccaaagtgctgggatcaggcgtgagccatcgcacctggcctgagcctatagtattttaatggtatcatttatacttgatattcatacttggcattcatacttgctttatatggttgacaaaagttttacatcctaataatgtgaggtcttggagggcagactttgtgattatcagtcagttatagataattgtggctcttgacttctgttaagttgatcccaacttgtaatataacagtcaagatacaaagtataataccattttaacacatagcaaacagctctgctctttaaagcctctgtcctttttctttatggctcatggtatccccaaaggttagtaaggtaccggagctcagaagaaggaagtgtagcactggaggtgaaactgatttttctgatcatgaagccctcactcatcaggtgctgcccaaaagaaagggaagaacactctgccctccacagaataactcggatttctaaagtggatcctaacctacagctcgctcttttcttttctcttctcttctcttctttctcttttttttttttggacagagtctcgctctgtcactcaggctggagtgcagtggtgcaatctcggctcactgcaacctccacctccgggttcaagtgattctcctgcctaagcctccagagtagcagggactacaggcgtcagccaccacgccyggctaattttttgtatttttagtagagacagagtttcgccatgttggccaggctgacttcaaactcctgacctcaggtgatccacccacctcggcctcccaaagtgctgggattacaggtgtgagccactgtgcctggccacctacagctttcttatatgagatggagcttgaattagtgcaggttttatatattactatcaaggatggatggtctttaggaatgttcagagagaactttatagttctaacttactatttcagtagcatattttgaaaagggatggtttagaagtgacttggagttagggaaagagaaatacgataaattggaaagaagaaacttttcagaatattcatccaataaacatttaatgagtacccaatatttacaaagaagaggagttacattaaaattgaaaaaaaaaaaaaaaggtgtaagcctaatctatgccagcactttcacacattctgtcttattgaatctctccaaagaaattgttaactctatttgatagatagggagactcttctcagaagttaagtaatcgcctagggattaataaatggcaaagctaggattctaaatcaggtcctctttccaagtttactttctgctaaactgcagctggggttgtgcaattgtacataaatgtgtggaggaaccaaaagacccatgagaattcttttttttttaagatggagtcttcctctgtcgctcaggctggagtgcagtgggttcaagcgattctcatgcctcaacctcctgaatagctgggattacaggcgcatgccaccacacctggctaatttttgtatttttagtagagatgggttttcaccatgttgaccaggctggtctcgaactcctgacctcaagtgatccatctgccttggcctcccaaagtgctgggattatagatgtgagccaccgcacccagccaagagaattcttttgactgaattgagttataggaggaatatagataaatttgktggttctacagtcatttgttggtacaactctgttacagcatttatcctggtctgtcttgtattattattacttgtatgtgtctctctccactactagatcgtgagttactgtagagcagaggccatgattgtctcatatgtcttggtaactacttcaaatttatttaaaatgactgggcatcccttttttaaagttgtctttatttcatagtacctgacatggtatcttgtacatagtagataggtgcttaaaatggagcccaagcctcacaggactagttgtccttgaagaaggtggtgtttcagcccatgtcccagctcttctcttgctgaacttagcagggatttgggacctagtaattaaatagctgagaagccartattcatcctgtcatcctctgagaagcatgttggtagcagagtgcattatattaatacatggtaggrggtacgagcatagcartgagacttgggatttggcttaggcttgccatagcccaagaaatgctgaggggagattcatgttggtaaggtcgaaatagcattggactagaagtaaaaaaaaagtctgtgttgtacttggctgwgctactatctttgtgacttttgacaagtaacttatgcccctgagcctcaaattcttcatttacattatggtgacaacaagtttcaaggccatttgccacctataatctgaagatgggaaatttactttacccaagctctaatgaattcagttgagatagttactgaattttttcccctgagctatttgactaattattcttgggacaccaggcagactgcgtgatcatctatggcaggtgtgattgcaccctaggagacacagtgatgaaaacacctggtgctagaaatctgaaacaatgcctaaacagttgagtgcatccattctggagcatattaacctttccttttgggagaggccaaattaaggtctattatattacctctaaagaccataatgtgacactggagcttcaggattgaaaagtgagattgtcttaatttatagcagtgaggtgaatttggctctaacttccagatttatttatttatttattcacttatttatttatttattgacagaatcttgctctgtcacccaggctggagtgcagtagcatgatcttggctcactgcaaccatracctcctgtgttcaaacgattttcgtgcctcagctacccaagtagctgggattacaggcatgtgccgccatgcccagctaaattttgtatttttagtagagatggggtttcaccatgttggccaggctggtctcgaactcctggcctcaagtgatccacctgcctcagcctcccaaagtgctgggattataggtgtgagccactgtgcctgacccagatgctacttttaagtttgttggatgattatgttctttaataatgttgttacacagtatgagacttttcagccctctttctagaactgtggaacaaaagccaaagtgccttcagttggtccagaaagaagcgatttgcttttatttcaattaaaaattgggagacttatctttattatgtggccctcttttacaaagaacaaattgctttgtaaactcaggtaagcactttttatctctgatctctacgttcctcatttgaaacatggtagaactggaccagctaatctctgaagtcatttctttggctctaccttgccttaattttaagcatctgtgtgattgtactgtttctttgggactctctggttcctaacccagcataacatgttcattagtataaaacatgagtttagaacttttggttcgtaacccattcttcatgttttgtcttggagagttaattcaagtgctccgtccgatgtctccattaaaaaatgagaatgaaagtttttatctatttccatcctaacattgaagtgagtaatgatgatatttggttaagtataaggcactggactagggagtcaagggaccgaggttctatccctaactttttttcttttttttttttttttttgagatgaagtatcgttcttgttgcccaggctggagtacaatggcgccatcttggctcactcaacctctgcttcccaggttcaagtgatttttctgtctcagcctcccgagtagctgggattacagacgcccaccaccagacccagctaatttttgtatttttattagagacagggtttcaccatgttggccaggctggtctcgaactcctgacctcaggtgatccacctgcctcgccctttcaaagtgctaggattacaggcatgagcctccgtgcctggcctccctaactctcaagtagttgtgtgccttcctaccagtcactaatctttttgtgcttcagtgtcttagactgtaaattattgaaaagctacactttgttgaatgtccattatgtgcyacatacctatgtcagtcactttatgtacatcatttgttatctgcagcagcaaagtgagaacaaatgggaacttaggccctgaaaggcaagttgtgtgcaagatcctacaggtgggaaatggcagagctaggattagaagccacatctttcactccaaagcatgttcactttctatacctatactgttattttttttttttaaagcttttttagagatgggtcttgctatgttatccaggctggattcaactcctggcctcaggccacgctccagcctcagcctctggagtagctaggactacaggcacgttgcacagcacccagatacacctatactattccacttcatttgcaacataaggatctactgtatatgctttctaggattgttgctaggaatagataggatatcaaataccacattgcttttggccattagaattttatagttagaggggacctatgagcagctctagtgtaattaagactccggattcaaatctcagctctgctacttatttagctttggacctccgatatgttacttaatctcttcatgcatctttttgtcatctattggatgggaataatagtaccaactctgtacagtgacataaggattatgcaaagcattttgaatattattttgcatatagtgagtattcagtatatattagtaaatagcagtgcagtcaggattgttttatttactccccttgttttagttatggtgaagctgaaacagtgctcaagatgaagcagctaattgaagacactgaaaagaataaagtttatgtatgtaagattatattgaatattttacaaataatcatttagtgttaaattcagcatatagtgacaacattaccctcgatccacaggttgggggatggggtaggctacagggggaagagagagctagagcctaggttaatgatttatctggcaagggttctgggcctttcatcactaacatttattggttgcctattacatagacccatcaagcctctaacttcatcttagacaactctgcagaagactgaggggacaactctttctctctgattagatcttttcaggttctgtcagatgtgtatgtattggctttttatctagttgtcttgatgaaacccaagactcagacttggagttaaatgtaacaggctgtatgctctggtttgatttgaagttcaggtatgaggggaggaatgccctgtgtgatccatcccaaatttattaaagttctctgtattgggtttggaggcctcagtcctagctaatataaartataactttattacctggttttttgctttttgttccttttgttcatgaaactcctctggtaatatcaatatgttccctttgttcatgaaactctgttggtgattttactaggtataggatttgggtattcctcagtatcatcacaccgtgtgataacactctaatctcccagtgtttttaatgtgtacacacatacctgtcagtctaaatttcaaaaaaaacccagaaagaatgtttgacagagcatcatttttaggcagttttatagcatacagaggcagtcaatatgaagtacagatttggggagactaggttaaatgctacagaagaaagattctcatgtatgtgacattgatttttttcccccatctttataggttgctatggtgacagactatggggcctttatcaaaatcccaggctgtcggaagcaaggtaggagtttataacttgaaattcagccctctgattctactctctgctaacactccaccacctcctaattataggctgtacatttttcagacagtagtttttcattcctttgttttctttttaatgtrtagatatgaatacaagatgacagttcatttttagcgggcagagaattgtggtctctgactcaggaggaagactggggtatagctaactgggtttacttctgaaaccagctcctccttagacttcacctgtgaccctaggcaaatcacttgacttctttagacacaggatttgcgggagggcargctacctctgtctgaggctgacagtgtgagttttctagtagatagcgcatgaaatgggaatagtattgcaagtgatacaaacatatataatatatataatgttttaagtttttttcataaagaggcgtctgttgaacatttttttgagaatcctgttataaatctataatcttatttatttaccaaaactatgttaagccgaaaaggcaggttccacagaccggttgtctgcccagagtgatttggctaggtagtggcatagccaagactagaacccaatccttctgattcctagcccctggatctttctactatatcacactgctggtggatccaaagattcaacttgctaacttcttatgctaaaataaggtttaattaaagattttaacattttaaaaaaaggcaaccataagaatactagaagaaaatctagaagaatatttcactacatgaaaattaaaaacttmactgcaaaaatcattgtaatcagagttaagtttggaaaaagaatttgtagtacatatgataaagagctaatacaaagggggtattaggaaaaggtgccaaggatatgaaaaacaactcacaggataaaaaaatattacttggtactatagtaaaagatactcattctccgtatgactaaaaagtaacttagactggtagattcatataatgggatattactcaacaatacaaaggaatgagaataaaatattcatacatgcaacaacctggatcatccctctccagaaattatactgagtgaaaaaagctaatctcaaaaggttatacactttatgattccatttatataacattcttatgttttacttgagatatgattcacataccacacatttcacctgcttaaagtgtacaattcagtggtttctttggtatattcagagttttgtgaccatcaccaygatctactttgagaacattgttgtcaccccaaaaagaaaccctgtacctattagccatcactccagattctctctatgcccccagctttaggcaatcattattctactttgtctctgtatatttgcttattttgtacatttcttgtaaatggaataatgcagtatatagtcttttgtgactgacttctttcacttagcacgttttcaaggttcatctgttttataatatgtacttaattcttttttattgccattacaaatttattgcagttccatcagttgatggatatttgggttgtttccacttctttagtattatgaataatgttgctataaatatttgtgtacaactttttgtgtggatatttgctttcattgggtatatacctgtgagtggaaatactgggtcatatgataactccatgttcaactttttgagaaactgccaaactgtttttccaaagtgaccacgccattttacattcctaccagcaatgtatgagggttctattttctttacatctttgttaacacttgttattatctttctgggtatggccatcctaatggatgtgcacggacatctcattgtggtttgaatttccctaatagctaatgatgttaagtctcttttcttgggtttattggccatttgtatatcttttttggggaaatgtctattcaaatctgatatattttggctgtgtcctcacccaaatctcatcttgaattgtagttctcgtaatccccatgtgctgtggtagggaccaggtggagataattgaatcatgggggtggtttgccccatcctgttctcatcatagtaacacaagatctgatggttttataaggggcttcccttataaaaccatcattcgctgggcacttattctccttcctgctgccctgtgaagaaggatgtgtttgcttcccctttccccatggttgttaagtttcttgaggcttccccagccatgctgaactgtgagtcagttaaatctctttccttggtaaattacccagtctcgtatgtctttattagcagtgtaagaacagactaatacaaaatccttttctttttttgagacagagtcttgctctattgcccaggctagagtgcaatggtgcaatcttggctcactgcaacctctgcctcctgagttcaagtgattttcatgcctcagcttcctgagtagctgggattacaggcatgtgccaccacacccggctaatttttagtagaggcagggttttgccatgttggccagactggtcttgaactcctgtcctccagtaatctgccctcctcagcctcccagagtgctgggattaaaggtgtgagccaccacacctgccttttcccttttaaaaatagggttatttttgtttttattgttgagttaggtgtttctcatatattctggatactagtctcatatcaaatatatgatttgcaaagatttttatgtaacatacttgaaatgacaaagttatttaaatggagaacaaattatttaatggttcacaaggattaagaaggggaaggmagtagcaatatgaaggatccttgtggtgagggacctgttctgtatcttaactgtggcagtgtatacatgaatctacacatgtggtaaaattacgtggaactaaatacatacacatacagaaacacaaatgagtacaggtaaaactggggaaatctgaacaagagccagtcgattttatctgagatgtttttccctacaccaaccaattctccagttctctgattctctaacatcaactggatgtcccaacaattcaattcaattctgacactaactacctgggaattagtgtcagattccacaaacttaagggctcagtcccacatgactaccctcacttcagatgccagccccaatattgaatcctcagattacctacacttttgtctcacttggctacaatttttgggattcccagcacttccccccaargttggtaatttgctagagtgactcacagaactcagaaaaatgctatagttactattagtttattttaaaggataaaaatgagcagtcagatgaagaagtacacagggtgagacccaaagtgttccgagtacaaagcctctgtccccatggagttggggtgtgtcaccctcttggcacatggatgtgttcaccaactctccaaactccattgcttaggggtttatrtggaggatctgttatatagacatggttgattaaattattggccttcagtgatagagctcagtctccagcccctctccccttcccggaagtcagagggtagggctgaaatttctttttttttttttgagagggaatctagctctgttgcccaggctggagtacagtggtgcaatatcagctcaccgcaacctctgccttccgggttcaagcgtttctcctgcctcagcctcctgagtagctgggactacaggtgtgcaccaccatgcctggctaatttttgtatttttggtagagacggggtttcactatgttggctaggatggtctcaaactcctttccttgtgacctgcccgtcttggcctcccaaagtgctgggattacaggtgtgagccaccatgcccagcccaggctgaaatttctaaccctatctaatcacatcgttgatttctctgtttctgaagctatctagggacccacagtagtcacctcattaagggacttaatgaataacaaaagacacttctatcactcagaatagtccaagcgttttaggaactctgccaggaactagggacaaagatcgaatatgtatttcttataccacagtatcaatgccagcatcctggttgtgttagtgtactatagttttccaaaatgtcaccattggagaaaactggataaagtgtacataaaacctctgtattctttctttctttytttyttttgagacggagtcttgctctgttgcccaggctggagtgcagtggcacaatctcggcttactgcaagctccacctcctgggttcacgccattctcctgtctcagcctcccaagtagctgggactacaggcaccygccaccatgcctggctaattttttgtatttttagtagagtcagggtttcaccgtgttagccaggatggtctcgatctcctgacctcatgatctgcctgcctcggcctcccaaagtgctgggattccaggcgtgagccaccgagcccggcctagacctctgtattatttcttttgagtgcagatgaatgtacaattatctcaaaaattttttttcacatagggcagcaaagttatcaaatatttttaaaaaatgatttaaaacactcctaaaatctttgagattaataaatattttaaaagattgctgttaatacccagtgttagaaatggatacttttactctctatcaggagcataatttcacagactttggcaatgcctattaacatcttttatgtgcttattaccctttaatccagaaattctttgaagaatttagtgtaagtagagaattacataaattatgtgcatctgttttgtagactatgcagatgattgaaagaatgactgtatttctaagacataattatgcctcatcttaccagaaagatgccatggaaggttttcatacaattccatcacactgctacctgactgataacagttgtaaaacatcattgattatgagaagcactccaatttcagagagattaaagtgagaggaaaaraaagtgcatcttagaatcaatgaaacacaataaatgtcagtttactgacatgagccaggagtggtggcatgcacctgtaattccagctacttgggaggctgaagtagtragatcacttgaggccaagagttcggggccaggctgggcaacatagcaagaccccactgatggcgatggaggcctgtctagagtggctgctgcaaagatgccagccatagtgggggctgtgcggccagggctgcatgttctatggagctggcaggagccctgcccccttatgagttagtggggtgggagcccaccctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctgagcctgggcactattgcaacctggctgggtttgcacaccttggggtggtgctgccatgccagcttcctaccatcttggccccctctggactttgggtgccagtgagcacaggagggaggcyaaaggggtgctragggtggctcagcatgggcctgcaggtgcccctgggcacagaacaactgggcgtcatggacaacatgattgatggtgacaagaggcagacaggctcctgggtggaaaggggcaggtctcggtgaagccgcaccttcaagccagggatggcctaaagcataggggccaggctgtcagttccaggtggagtctgtggcccagagtgagaacttaaggtgcttttcctgggcctgcccatggaccagtcagcacacacttctgaagactgtaaaaatcctggactcagccagacttgggcagacactgggaggacttgcctgtggaaatgggttacccacactgggtctcctctccgtcaagggctgcagatgttgggatgacctgcctgcagataagagctgcccattctgggtctcctctctgctaagagctgcactcaacaggttgacctgcctgtggaaaggagctacctactttgggtctcctgagagctgtaccatcactcaataaagcaactctttgccttgcttaccctccagttgtctgcttacctcattcttcctggatgcaagacaagaacttgggacccgttgaatggcgggactgaaagagctgtaacagatccaagggctccctgagccagagctgtgacacctctttggggctttatggttcctggcctctccaagcttctgggcaccaccatgttccccagagtccacagtggaagccgcttgtggtatgcctggtccatccacagcctcacatggagctggtgcctgtgccagcacctggagctgcctgcccagccacagcagccagtgtgcctggctgtgcacagtggctggaccccatgctcactcactcatgcatccctcgccactccgagcctggctcgcccttggcaggtgtgggatctgggacggcagcatgagccaagcgcagcccattagaccaagtggatggaacaggcctagtggccccaagcaaagctgaatgcagcctgccaggccaagtgggcagaacgagcccagcaggtccaagcaaaactcgggcaaaggtgctgctggccacagcagcttctggctggaaaagtgacacctgaagaatcttgtgacaccatctttacaaaaagttagctgggtgtggtggcagaaggatcacttgggcccagaagttagaggctgcagtgagctatgattgtgccaccgcaccccagcctgggtaagagtaagaccctgtcccttaaaaaaaaaaaaaaagaaaaaactaacatggaaagaagtctaagataataaaatttaaaaacatgttgcagaagactttgtatagcatctctcttccccttttaaagcaagtgtgcatatgcctttaatatcttttttctttatatagtttaaattactgcctatgtttagaagaaaggctggaggaatattcaacagattaacaatggtcacttctggggagttggttttgctaaggaagggatgtacatggaagagggactttgacttctggaaattttttttaagttttttctgttaaaaaaaaaatccaagaggtgatctttggataataaatccatgcctctaaccttgtagactactattctgcaaattgcatctttgcttaagaaatggtttaccagcagttttcaagctggcagtcagcagtctgtaattaagtttctcattttatgttgtctggaatttaatgacatcgaactcttccccaccccacaggacattcatctctttctgtctgagcacaggttttcttgttagtatacttgccatagctgccagtgcctgaaagtcccattctaatttgggcatatgtgacactttggggactgtgtgggattaaaggcctgtgaccttccagcagtcaatcttcaactcattttatccataccctgtcaggtgatgcctctgattgtggctgacagcttacaagtgaatctgtcagtctgacagctgggctgaggcaagcctcagagggagagctcagggagccaaataattaggtggaaactctgtgagttttaatcctgagatctataggtttattggataacttgagcaattgacttccttacagtgtatcttagtttctctgcccataaagagggaagattattaagtctcagcctgaaaggactgagttagaaaataactctgrtctgatcaggtcttaacatctttggctcaggtaggtagattctaatttgagctggtttcccagatgtcatgttctcagaatacttcagccamcactgagttgaagaccccttcctactattcaaacctaagctagattttctttcccctctcatagtattatccaatataactttctgtgatgatgaaaatattccttatgttctctgatttgtttcctgacaccaaccaactccccaattctctggacaccaactgggtgtccagtgactcagttcaattctgacattatttatctggagcttgtgttagatctcacaaatttaagggactcagtcccacaaaatttcccccatttcagatgccagctgcaagtcctgggccacttgtacttctgaccaatcagctgtaaacaggggttccatgaccacctacttaggtttgagactttgccagaatggcttacagaagtcaggaaaacactttacagtagtccccactcatctgtgcctttactttccacggtttcagttaccctaggtcaactgaggtttgaaaatattaaagggaaaattctagaaacaattcataagctttaagttgcagttgcagtgtgatgaaatcttgtgctgtcttgccrcattccatctgggacttgaatcatccctttgtccatccacactgtgtacgctacccacccattagtcccttagtagccttctcagtgatcagatcgactgctgttgcagtgcttgtgttccaagtaacccttattttacttaatggccccaaagtgtaatactratgctggcaattttgatatgccagagagaagccataaagggcttcctttaagtcaaaaggtaaaagttctcaacttaataagggaaaaacagggacccctagaggggggactgaggaagggggagaatggttgaaaaatttaactttgagtactatgctgagtactwctgtaacgggatgattaatatcccaaacctcagcatcatgcagtgtacacagataacaaacttgaacatatgtacccccggaatctaaaataaaggttaaaaacaaattaaggaaagaaaacgtaatcctgtcctgtggttgctaagatctaccctaagaatgaatcttctgtgtgtgaaattgtgaagaaggaaaaattcatactagttttgctgtcgaatttctaactgcaaaagttacagcaacagtgtgtgataactgttcttacagtatgttgttatgttattattgttaatctatttctgtgcttaatttataaattaagcttcacagccaggcatggtggctcacacatgtaatttcarcactttgggaggcgaggtaggtggatcgcttgagctcaggagtttgagaccagcctgggtaacatggtgaaaccccatctccacagaaatacaaaaatttactggtcatggtggtgtgtgcctgtagtccaagctacttgagggggctgagggggttgtttgagcctgggaggcagaggttgcagtgagccgagatcatgccactgcactccagcctgggtgacagaacaagaccctgtctcaaaaataaataaataaataaataaaaattaaactttatcttaggtgtgtatgtataggaaaaacatagtatgtataggattcagtactattctttgccagtttattataaaggatacaacttaggaacagccaaataattgaagagatacatggggtagggtatggctggagtggagtgggatcgggtaaggtgtggtggggagctttcatgctctctggtatgccaccctcccagcactaggatgtgtttgccaacccagaaactacaaatctcatgtatgggagtttttatagagctcagtctctagctcccaaccctcctctttcttcctagaagtaggagattggtgggtgggattgaaaattccagtcctctaagccagcatggtggtgagcacctgtagttccagctacttgggagactgagacagggggatcagttgagccgtccaggagtttgagtccagcctgggcaatatggcaagatcctgtctcaaaatagaaaaagttccagccctctgatcgcttggtctttctggtgactagtccatcctgaggctatctagggatcccactctgtcacctcattaaaataaactcaggtataatcaaaaggggcttactatgaataacagaatacactcctatcacttaataaatcccaggagttttagaagttctttgacaggaaaatggacaaatgtatttttgtattatactacatctgtgctgatacatgactttttcattttatttatttcaactaattgaaattgaaacttaaaacagctacatgactagtgactatctattaggcagtgcaaccctatacaattataaagttcttttttttttcctactgtcttctgccrtccagcactaaactatgaaattttgagaacagatttttcaacattatactttcagagtttcttgcttatgatagaagctcaaatatatttagcagtggattcagtttagcaaataattattgagttctattttctgattagcttttttggtgggaacacagaggtaagagaaacataatcccttgctgccctcagattgcttacagtctagtgatgtaaacaaattagagtggcgtgtaataaaaatgagtgttgttgcacttagtccatggaattgtggaacggttaggctgtttggatgagtcagggcatagtacaatacytgaggtatagtgggtgggtgttcagtaaatctcactgaatgaatgaatgaattatagcctcagttctaccattaactggcttcttggcaagtctcctagtctttgagccttaatttccttatccctgaaatgggaatgatgtgcatattttagggtcttgagtttttttgactgggaggaccatgtttcattaacgcttggatatatttttgcctataatatagtttaagcgtttagtaaatgttttagtgaatccttaatcccaacaagaataaagggtgttaaaacactttcacgaatgtgcttatattattgtcatataccattgattgggagatgaattgacttaaactgtggagagggaattaagattacccaagggtaacagtgaccttttgttttgacatttttttggctgcagctgtcctctaatgatttgagattttcacttctttcctttattgccagtggaagttgtggaagaaattaatgttgaacctaacgcagttggggtaacggttttaaggggactataatgggctcactctgttactctcatgtggtgattgaggagctagccctttccaagttgtcaggtttcgtttttttcctgtttttaccagcagacactcagatgggactaattctgtttaagtgtcatgttgggtttattgaacttgatgatggacttgatatgcctcttgggcatttatttatggcttgatgtcagaaatccatgcacaggttgctctgaagagctccctttggtgtagcgtggcaagcaaagcatttttgtttgtttgtttctgtttgattttggagcatatgctagaacagaattagatgtactttcctctatttgtaggtaagttcatctttctccttttttaaattgtaaggataatatagattaataataaaaatggggaaaatattggtatgatgtaggagacctgataaactcatatttgaattgcacttctgttatttatcagccttgtgatcctggataatttatatgatttctagatgattttttcccatgaacctttgtcaaagaggattaaatgaatggatggatgtagtatatatagtgaggtactcagcacaaagggaaggggcctcaaatattttatatggtgtcctctactgcatacacgtcatctgacttttggtggtgtgtccatgttaacaatgaagtctctcccaagaattcagactgctttctgagaatgaatctagtcatgaatccctcccatacagagtatagtttcagccatagatagaaataaaccaggtaattgcctataaaacagactgaagagatgggagcactcaagatgcaaacaagataatctgggtgtaattccagggaaaagggattggaatgaaattgtaatttaggagactgaaatctagttgattgtatcataatattcttttttttttttctcttgagacggagtcttgctctgtcgccctggctggagtgcatttgcatgattatcagctcactgcaacctccatctccggttcaagtgattcctgtgcctcagcctccctagtagttgggactacaggcaagtgccaccatgcctggctaatttttgtattttttttttagtagagacggggtttcaccatgttggtcaggctggtctagaactcctgacttcaagtgatccgcccacctcagcctcccaaagtgctgggattacaggcgtgagccagcgtgcccgtcctgtatcataatattctaccgagggagagattatgggaacaagcagggggttgtcagcttaaaacatggtaaacatagtaaaagacaggctgagtgcttgaagttggcagagtttatcttgccttatttatggcagaaatgaatctaatgataggaactgtagagatggattttttttttttctttgagatggagtctcgctctgttgccgggctggaatgcaatggctcgatctcgggtcactgcaacctctgcctcccaggttcaggcaattctcctgccttagcctcccgaatagctgggactacaggtgtgcgccaccatgcccaactaatttttgtatttttagtagagatggggtttcaccatgttgggcaggatgctctcgatctcttgacctcctgatccgcctgcctcagcctcccaaagtgctgggattacaagcgtaagccaccatgcccggccgagatggatttttttatgaggaagtgatagtacactaaaccttcatggmcaaaaaaagtatctcaaaatagttgtctcccttttgttctgattccatgtggaagcaatttctgatcactaatgatcactaatgtaattgttcaggtatttaatctgaaggcagcagctagtttacctagatgaggactgagaaccttccaggtataaggaaagtatatcttgtattgtaaattaataaactggtgtgtgtctctctctgaaccagtcactaaactgacagtctggttaatgtattttagtatataagcatctgcatgctaaagactcctgcacttatatctacagttcatacccttcccctgagctacagacttggatatgcaactgcctacctgacatttgcattcaagatcgagggcgagggctagactgtgtcttttgtttaattcactgcataagctaaggccttttggtaataagccattaatgtctcaactttaataatcctgtaccccgttataactatttttatgtttccttttggtctatgtccatatraggcatagtttcacattatttcatagtgtatatattatttaattataaaaatatataaatttttatgattggaaataatgcatgctcatcatagaaaaatagagggaaaaacacacaatggaaaatgatcattatgtgctattactaccatacagagataggcactgttaacattttggtgtatttcttttttttttgagatggagtcttgctttgtcaccaggctggagtgtagtggcatgatcctgggttcaggcaattctcctgccttagcttcccaagtagctgagactacaggtgcctgccaccacacctggctaatttttgtatttttagtagagatggagtttcaccatgttggccaggctggtcttgaactcctgacctcaagtgatccacccggctcagcctccgaaggtgctgggatcacaagcatgagccaccgcgcttggccaacattttggtgtatttctgtatattcacatatgtgtacacaatttaatatgttgagattaagattatactgtatatttaaaatgtgtagttttttgcacgtaatggaccttaaacatttccccattaaaaaaatattttctataaacatttaatggctttattctgtcattcagatgtaccacataatcattttaagttgtttccagtttttcactgctaacgcttctagactggtcatgtttatccaggagagagctacctgtaccaaaaataaaataaaataagtacaataaaataataaaatagaatttaaaaaaatgccgggtgcagtggctcacacctgtaatcccagcactttgggaggccagggcgggtggatcaagagatcaggagttcaagaccagcctggccaacatagtgaaaccctgtctctactaaaaatacaaaaaattagccgggcgtggtggcaggcacctgtaatcgcagctactcgggaggctgaggcaggagaatcacttgaacccaggaggtggaggttgcagtgagcagagattgtgccactgcactccagcctgggtgacagagtgagactccatctcaaaaaaataaaaaataaaatacatatgtgtgtgtgtatgtgtgtgtatatatatagtttactctcactgactcttagatatactctaaagacccatggaaattcagttgtagcataaaataaatacatttatagcgtaaaagagcaaaatatttcaaattaacttgcttaagctacttaaagacaaaaaaagttcatttgaaatcttttgtcattttttcactggttatatggaatcaggtgagagaaggacaagttttgatgccattatttctatgtggtactccagtaaatagactttctgttttagggaagaagaatagtgttccctcaagtatattaggttcaacattaatttccwtcataactttcattagcaatagaggaaagagatgaattttaaccagtagaggacagttgcagccaaaaacaagtcaagatgaagggcttcccctttatgggatctgaatttcctcttcaaactttaaaattaggctagttggctcattacatcataggggaaaaaaataaaccccatttgcatgaatttcaccaaatttggagattgtgtgttgatctaaaattaaaaacataatgtatataaaacattttagaggccccagagttgtttagataggtaggctatcaacctccagaatcagcttatgtaggtatgtgggatgtagtgatgatggatagagaaagtagtggctcccagtaggagctctaaacagaaagggcaggtattttgagtttcaggcatctgcaggcatccatgtgcatctctctctctctctctctctctctctctctctctgtgtgtgtgtgtgtgtgtgtgtgtgtgtgtgtgtgtgtgtgtgtgtgtgtgaaagagagagtgggagaatgagaatagaggtggataaatttcccaagcaacttcagggagggcagttattttagacaggatgactgatttttattcattcagagtaattatttatgttcattttctccagaattgaagtaatcctctattattatttattatcgaaaataaatgaaaaggttaacttgtaatactataaccactgttggcatttcaagtcatttctttctaatttttaaaatgtttttaaagcatttgtaatcatactgtataattttgcattatgcttttgttatttagtatgggaaaatgctagatacctacagtacttgatacataataggcactcaataactatttactaaagaaggaattattgacttgtttaaaaatcttttgaatggaccatcaagcgactataccataattgacctaattgttatcctttgttgtttctaaattttcctgtcttaaaaatacattraatattttgatgtaaatcacttttcctgaagcatatagtttttcctatgtataaagttattttcttaggacaggttcccagaagcaattaggggtcaaataaagtattagaactcttggttgcaaggggcagaaacttaattgggaaacattttggccaatcttgtcaggggcttccaggataactctcagttatgtttctcagttatgtttctgccccttgtctctttcctctattgctgggacttcagcctttgctgtattgggtgctcagtttatactcccagggctttgcttcttgtttaccagtgctcttctttgcttttctctggcagactcttgccatctggtggtaaagattggctttggcaattttttgtagtttacaatcctgatttgtatatgtaaaatgtaataagcaaggtggttctcccaaggaaaggattttggacagacaggaaaaggatgtttgctataagtgttttattaaatgttattaaaatattatttgatttatttttgagacaaagtctygctctgtcacctaggctggagtgcagtggtgccatcacagcttactgtagccttgacttcctgggctcaagccatcctcccacctcagcctcctgagtatctaggactacaagcatgcaccaccacatcctattaatttttctgtaatttttctagagatggggtctcactgtattgcccaggctagtcttgaatacctgggctcaagcagtcctcccaaagtgctgggattacaggcctgagcttccatgcccagcaattatttcattttaaattatttttattaaatgtgtaatagtttattagtattttatcattcttgatagccattgatagtgacttccaaaagtttattctagccttagtaatagttcttattttactatcctttcaccacattgaatattattttctaaatactttgctaatttaatggattaaaaatagtagcttgtttatatttccttttttaacttaacgtctatcataaatattttttgtaattaatttaaatggctgtttacttttttattccacagatttactatgtttgccatgctgttttccagttattgttcattagggttgttttatggttcttatatattttttaacctctgtaggtaataataccgcaagttatttatgtatttatgtatgtatgtatgtatttatttatttgtgagatgggggtcttgctctgtcacccaggctggagtgcagtggcgcaatctcagctcactccaacctctgcctcctgggctcaagcagtgctcccacctcagcctcttgagtagctgggatcacaggtttgcaccaccacgcccaggtaatttttgtatttttggtagagatggggttttatcatgttgcccaggctagactgcaagttatttcagctctgtaagttttttggctcttgtgagtttttcctttgaaaaaattctattgatgatattcttgcatcaaagataaacatctttatctttttgctttcaaataattttaccaacttatatttctatcagtattgtgtaactacagatattttatcacatctttactaatatggagcattacattttttaaattttttgttttttatttttaaaataagatttacaatatttaaaaaatagagatggggtctcgttatgttgaccaggctggtctcaaactccttgcctcaaggtattctcccatcttggccttgcaaagtgttgggattacaggcgtgagccactgtgcctggcctattttatttacttatttttttgaaccaaggtctcactctgtcacctgggctggagtgcagtggtgcagttgcagctcactgcagtttcagcctcctgggctcatgcgatcctcccatctcagcctcctaagtagctagagctacaggcacgtgccaccatgcctggccaggttttttttttttgtattttttgtagagactgggttttggcatgtttcycaggctggtcttgaactcctgagctcaggcaatctgcccgcctcagccttccaaagttctgggattacaggcatgagccactgtgccyggccactttgagcattattttaagaatgtttgttggttgattgggtataaaaagcagtctcaatttgcagttttaagtttcacgcttttcagtaaaaattttcatttttcccttgcattccccaactcttaccttcttatccagtttagagtataaataccagatatgccctctgctttacgttatttcttcttcttgtgcccaggtctggtccatcgaactcatatgtcatcctgtcgggtggataagccctctgagatagtagatgttggagataaagtgtgggtgaagcttattggccgagaggtaaagttctgtgcggctcccttgtggttagaaaggattaggaagagctgggatttttgatattttatgatagtgagtgtgtaaattttgttaattgtgctgataatcttatttttaaatcctgccattagaatctattctgaattcaaaccttctggtagactgtcctgcaaactcagaaggaatgatatgagctataaaagtgtggtgcaataagtgcacgtttgtaaaacttccctccctgaagtttacccatagggtgggccggaggagagaaaaaagaaccaaaaagagagaaggaaagttgacctatgggacaagtgtttatcacagacttcaaagaatacctgccagatacacttcagtttgggacaaaacaaaaagaacacagatagtttacagtcattttccctaatatctggcaccatgcaatgtgcagaaagtgaaaaaaatctgaaggaccctgttactcacttgagggtatgagggctgtgggtgtgggccgaccacaggagaaataagagcatacactgagtcctgttctaccagagacagcacrggagataggcatgaaagaactattattcaacaatatttaagtgcttaatatgtgctaggtttgggagatataagagcgaaccagacaaaaatgatcccagctattatggagttaatatagaatataagtagagacaatttttctttcttttttgagacagggtctctctttgtcacccaggctggagtacagtggtgccatcacggctcactgcaacctcagcctcctgggctcaactgatcttgccacctcagcctcctgagtatctgggactacaggcacgcaccactaaacctggccttttttttttttttttttttaatttttttgtcaagatggggtctcactgtgttactacccaggctggttcaaactcctgggctcaagtgatcctcctgcctttgcctccccaagtgctggaattacaggcatgaatttccatgcctgaccaagacaaatatacataaaataattgcaagttatattaagtgctatattgggttcaaacactattggaagaagatttctagttgtcaggaaaggactctttgaggagatagaatatgagctgagaccttaaagaaaaggaactagtcatggaagacttgggataggaacattccaggcagagagaataactgatgcaaagaccctgaagtgaagaagtgcttcatgtgctgcgggaagcaaaagaagaccaatgtgacaaatgtcttcatgcttaaagaagctctagaccaagtccagaaggagatctagtctcttgaagtattcaaaaacctattctggacttagggatatctcaacaaatcactatgctgaacttacctggaagaaaaacttttattttctgcctggttacttccacaagccatggattttttgagctaccatttttgtctttccctcagagggacaagaatgagattaagactgtttcctaaaattcttctgccacagggtctacctgttatgcttatttgtatctgcaatgttcctagcacagtacctggtccattaaagaagctcaatgttatgatgaaaacgttgactcttaattttagactggccatctaaatgatgtatttaaagtttttggtgactttttttggtctctttcagatgaaaaatgatagaataaaagtatccctctccatgaaggttgtcaatcaagggactgggaaagaccttgatcccaacaatgttatcattgagtaagtaaaaggtttggaaaggtgaaaattcttctgcctcccaaatcataaaatggtttagtaaatcagactgaactggtaactctaccatttatggactttgtgatattgataagttacgtaacctttgcaatctttggtttttagaaatgtaaaatgaagttagaccaggcgtggtggctcacgcctgtaatcccaacactttgggaagccgaggtgggcggatcacctaagaggtcaggagtttgagaccagcctggccaacatggcgaaaccccgtctctactaaaaatacaaaactagaaatttgctggatgtggtagtgcgtgcctctagtcccagctactcgggagactgagtcatgcactagagtctcttgaacccaggaggcagaggttgcagtgagctgagatcatgccactgcactccagcctggatgacagagtgagactcggtctcaaaaaataaaataaagtaataaaataaaaatagttaacaccttgctgcatagagttctaagatgaaacgttaacgtaccaagctcctggcattggagtgctccatcaatggttttgtttcctttcccttaatctctttctgtttctgccctttaacgagttagctaataagcattcatgaagaactattctttacctctctcccagtgatttctgcaggtggggttacgtgggtctcttccacatagagaccacgtggaagggtagagtaatccaggaacaactccagcggggtttagactcccacatcttgggatacactgtgctctgaaaacaacatcttactttcgttggctcttctgacctttcatttaggaatgggaaattatctatgtaggacaatgtctggcaatacaaggaatgttctgtctgtctcaagtctttcttggatttctttttttttttttttttttttttttgagatggggtcgcccaggttggagtgcagtgccataatcacggcttactgcagtcttgacctcccaagcccaagctatcctcccacctcagcctaccgagtagctgggactacaggcatgcgccaccacacctaatttttattttgtagagacagggtctccctatgttgcccaggttgttcttggacacctaggctcaagcgatcctcccaccttggtctcctaagtgctgggattacaattgttagccaccatgcccaggcttctttcttaaatttctcatcggaggttcttggatccctaaagtctcttaaagggggatcttggagggttttttttttttttttttttgagacaagtttcactcttgttgcccaggccggagtgcaatggcacaatctcggctcaccgcaacctccgcctcccaggttcaagtgattctcctgcctcagcctccacagtagctgggattacaggcatgtgccaccatgcccggctaattttgtatttttagtagagatggggtttctctatgttggtcgggctggtcttgaactcccgacctcaggtgatctgcccgtctcggcctcccaaagtgctgggattacaggcgcgagccaccgcgcccggcccttggagggtttattaactgtttttagtgttttagaaagccatccaaaattctatgtgtgtcctcaggttaaccatgctgttattttgttgcttttgatgataaaatatcacattgtttgtcttatgttaattaggtacgctcaatgacaattatgtcattgatgaatttaaaagacaagaaaaatgatagaatgttatttgagtgggatcttattggtgaaaagtttggaaagccttatgtttatagttctgagcaaaatcactttgaatttgaaggaattttatctggaagtaagggaaatgttattgaatacatactgcagtgccaggcattttatgtacattcttgggtacataacaacctgcaaagtggatgttatctccattttaccttatattcctactttatagcttggtgcctggtgataagtaacttacctgtggttacatagaaaattatcagggactcaaaactcagtctctctgaccttaaagctaatgcccttttcaccacaaaatgcttctcactcttgcatgtgacttacagaacttttcatatttctgtggtttagtctctaaatattaacatgtttgtaaggctgattattgacaaaatactgtcagtaatagtaggaatcttttataactcagagtgcagaagtgtttaaatctggctgtggttcaagttagtgttgggaaaaggaaaaagaaaaaattctgatgattgcattgtaataaatagcttctgctccaaaaaatccaatgctatatggactcattaaaaaatagtgaaatttcccaaagccacccttacagtgataaaatataaaacatgtaagataaaagagctaaccctgtttctcagaaaatgggtagggaagggaaagggctccctggttttgggctgtctctgtgtagaactatttttagtaataatcaagtggctgaaacagtaacttttgttgtaaattatgtctatagctgcatccaggaaggaagcatggcataatggaatgattagaggatttagagctagacttgaatcagaaagagtactggttctgctccaaactaatatatgactttgagcagattaattagtctatctgaatcttagcttctttactataaaaggagacagtaacatatatctaaggaatgcttgagtgatttaagtaaaatcttatttgtaaggagccagcttcatgtctagtctatggtagacatacatgtagctacttgtagttattgttttaaatgccgctttgttttatcctctaatatctgagattatagcaccttttcttttttcctcatactatggtgtacggaaccacacctttgcttttgaaagagtgtgtgtgtaagacccacaaaaacagagaccatgacttgtctgccattgtgcctgatgtatagcatccatagtattcatttagtttttttgagatggagtctcactctgttacccaggctggagtgtagtggtacaatcgtggctcactgcaactctgcctcctgggttcaagcaattctcattcctcagcctcccgagtagctgggattacaggcatagtccaccatgcctggctaatttttgtatttttagtagagacggggtttcaccatgttgaccaggcaggtgtcaaactcctgacctcaagtgatcccccgcctcagcctcccaaagtgctgggattacaggcatgagccactaccgctcagccctagttagtactttcatttactcatttgttcaacaaatataaggcaacttgtaataaatactaaaagagtagtttaaagcagttgtccccgacctttttgtcaccaaggactacttttgtggaagaccaatttttccatggatagggggctggaatggttttgggatgaaaccgttccaccttagatcatcaggcattaaattctcatagggggtgcgcaacctagatccctcacatgtgcaggtcacaatagggtttgcactcctatgagaatctaatgctgctgctgatctgataggaggcggagctcaggtggtaatgctccttcacctgctgctcacctcctgctatgcagcttggttcctaacaggccatggaccagtagcagtctgtggcctgggggttagggactccctgtttaaagaaagggttctaggaattcacttgaggaggaatagtttacttcaggccttgatggtcagagaataggtggtatttgagttaggttttgaagaacagataagatcttgtcagacagcaggggaaggaatggtatttcaggcaaaagaaatggtttgaggaaaggaatgaggcagaaaagcacatagtacatttgggaaccttgtttaaggaaagaagaggatatggtcaagtactagaatggaaggcttgaaagataatttagggtcagattgtggagagccatgaatatcagttaaagaatatgaatttttatttatttattttttgagatggactcttgctctgttacccaggctggagtacagtggcatgatctctgcctcccaggttcaagcaattctcctgcctcagcctcctgagtagctgggattacaggtgcccaccactgcgcccggctaatttttgtatttttagtagagacggggtttcaccatgttggccaggctggtcttgaactcctggcctcaagtaatccgcctgccttggcctcccaaagtgctgggattacaggcgtgagccatcrcacccagcccatgaatttttttaaaaaagcctttggacagagaggcttctcgtcagattaacctccccaggaatcccattgtctggccttgccctgttatgctcagtattctcatcctgtcttcagccatccatagtttgttagccacctttcattttccataaaaatctaactcttatattcatcccctcaggtcccaaagtgttaatgagataatctaataagtgactctgtaaatggaaaggggctaaaagcagtttccaattaggcatagcctgcaaagtacagtctttttcttttttattatgatcaagatcagaattgagtgtagtatataatttttttttttttttttgagacagggtctttgtctcccaggctggagtgtagtgatcatagctcactacaacctcaaattcctaggctcaagtgatcctcctccttcagcctcccaagtagccaagactataggtccatgccagcatgccccactaatttttttttttttttttttttttttgagacaagagtttcactcttgttgcccaggctggaggcagtggcacgatctcggctcactgcaacctccacctcctgggttcaagcaattctcctgcctcagcctcccgagtagctgggattacaggcatgtaccactatgctcggctaatttttgtttttttagtagagacggggtttctccatgttggtcaggttggtcttgaactcctaacttcgggtgatcttcctgtctcggcctcccaaagtgctaggattacagatgtgagccaccatgcctggcctaatttttaaattttttgtagagatgacgtcttgctgtgttgcccaggctgatcttgaactcctggtctcaagtgatactcccaccttggccttccaaagtgctgagagattataggtgtgagccacaactgctggtccatagggtagtctttagaaaaagcacatatgacttaactctgttaaaatttttcatttgtatgtctccctccattgccagactattagttctttccagaaaagaatcatgttttgttcgttttggtatacataattattactatcactagtattagcactggcgttatccacttactagctgtactgaaaaaatgagattaatctcagaatctgtgctgggatggattggaggaagaaaactggaggcagggagaccagtgagggagttattactctagatgaaacatgatgggagcctaaactagaatgatggcaatgaggacaaaaagagagacrtgggtgactgacacatttgttgmattgagtgttaagtgggaagtatgatttggtttgtagtctggkagaagccacagagtattggaattgattgtcatgggggttgcttaagctgcaactcacagccacttgaaactcatctctacaaatagataggtgaaagcaaaaaccatgtttgtgagttccttgagttatgtcctcaagtttctgcctttgttatgggtttttttttgttgtttgtttgtttgtttgtttgtttgttttggagacagggtcttgctctgtcacccaggctggagtacagtggtgcagtccgctcactgcaacctcaatcttgcaggcttaagtgwtcctcctgcctcagcctctcgagttgctgggactacaaacacaagccaccatgcctggctattttttttttttttttaagtaaaaggaatctgtactgttagaaattagaattgtgattacccttkggggaggcaggtaactagaagggagcatgagatgggcttctgagatgctggcaatgttctgtttgtttgtttgtttgtttgttttgagacasagtctcgctctgtcgcccaggctggagtgcagtggcgcaatctcggctcactgcaagctctgcttcccaggttcatgccattctcctgcctcagcctcccaagttgctgggactacaggcgcccgccacctygcccggctaattttttgtatttttagtagagacagggtttcaccttgttagccaggatggtctcgatctcctgaccttatgatccacccgccttggcctcccaaagtgctgggattacaggcataagccaccacacccagccttaatrttctgttttttgatctgagtactggttactttggtatgttcaaattatgaaaaatcaagtgagctgtatacttatgacagacatttatatatatatatatattatattatatatatatatattataatatatatatataatawwawatatatatatawaatataatatatatatatatattagttctcacactgctataagaactacctgagactgggtaatttataaagaaaagaggtttaattgacttatagttccactgcctgtataggaggcatggctggggaggcctcaggaaacttacagtcatggctgaagggtgaaggggaagcaagcatatcttcatatggcggcaggagagaaagagagagagagcaaaggggaaagtgccacacacttttaaaccatcagatctcatgagaactccctcactatcacatgggggaaatccgaccccattatccaatcacctcccacaaggtccctcccccaacactgggaattacaatgtaacatgagatttttgtgtgtgggggaacacagagccaaatcacatcaacatatatattatattttggtaagaagtctaaaaatgttttaaaaggctatgagaaatgcaacaaagagattaattctgtctgaggggctcagaggaaaagacttgatagaaggagagctagtaactgaactgagccatgaaatgtctaggtatagtgaagtggtgaggtgagagtcaagtggggaaacagagcatttcagagagggggagaactgcctgagcaaaagcactgagccacatggataagagaaaatagacttctttggccagagcatattgtgtgagtaaagatgaggctggaaaagtagtttagagacaractgtgaaagaccttgaatgccaaggtaaagaatttggagctgattttctagaaagcctttgaaggtcttttaaacctatgagtgacctggtaagggttgtagggtgtttagcatgttgagtaattatatattttcatcctctgtgcattagtgagatgaaggttagtctcattcgtaattgttaatttagggctatttcacatcattgcatttactgcctgtctcgttctgtcaaaaactttctttctttctcccctttccctgccaaaaacaaaaamccaacatacaaccttaccttgtagtatctctggccatrtctcttaagggggccggcagtyggtatctttttcattataggcaagaagagaggcggaggcgatccttccaggattacactgggcagaagatcacccttgaggctgtcttgaacactacctgcaagaagtgtggctgtaaaggtagggtgaagcctctgccctttccacgtttctctccttgtggatggacccttttctggaagaaggaggcagcccagtgtgagtttagtttaccctgttttttagccaagtgatggcctttgctgttttttccaccagactcacatcagagttcatggggtgatacattttctgttttcttttctgagtgctggccctaccagatactataccactaccaccactcctcccaccccacccacagcatatgccttgtctgggcaagacccccatgaactatgccaggaggagtaagagtgttggattatgattaacactctaattttatctccaaggatgatgattctgcaaaaattaagcaacttagacatatataacttaaagatccaagtcagactctcatctttatctctttaatgtcagagttctgaatacaatatctttttacaggatattgaataaagaatacaggatagtcacttctttttagctctatttcctcaggtttcctctactcttactcaaattttaaaaggtctttcagcctgatccctagttggagctataatgagagagattgccagcttctcattttcaggttgacctcaattgtcaccccttctccctagtcttccrtmtaccctactgtgtgatttttctacaataactggtagcagatttgtgccctggttgaagttgtggggttttaagcccctatttatcattagcatagaggggagaaggaaaaaataaaattgagagaaagaatacctcctcaggaaaactgtgggaacattccaggtatttggaaaactctgctatatttccctgccaggtgccacccagctgttggacccagaggtacagagtactttacagatagctttttttgttgtttttaaggtagggtcacccaggctggagtgtagtgttatgatcatggctcactgcatctttgacctcctgggctcaagcaatcctacctcagcctcctgagtagctgggaccacaggtgtgtaccaccatgtccagctaatttttaaaaattttttgtagagacggggtttccctgtgttgcccaggctggtctccctgggctccagtgatcctcctgcctcagcctcccaaagtactgagattataggcataagccactgtgcccagcccacacatagctttttgattatctcatacaattcctctgtgcccctaagacaggatctaccacaaactcagacacaactagcagtgtagagcatagcatctgttaaagggcccctcagtaccactataggctcagtgaaggtgggggtcttttaaccttaaccgtgtccaacaggcattacataaagaagagaagaataatgagaggtggaatttgtcccagttagtaaaggtcaggtcaaaggtagttggttttggtgcagcagaaagcacagggcagggaggcatgagacccaggataagtttgaactctgcttctgtctatatgaccttgagctacttctcaaatctgggctttcatcttctacaaatgtaggatggatttaatgatttccaaggtgcttgccagacctgacagtctgtaaatgttcagtgcccctaggtgactgtgcctatttctctgtgtgttagcttagatgtgagtgcccacttgctaccagctacctacaagctatattcctttagggcttggcctgccactcagctccttctgctaaacatcctgctctctggagcagtctttgattgtcaggaatatgttccaaaatagatcttaaaaaattaataagccccattgttaatggagggcagtaaaaacctgcatcctcatatsctttgccatttcgagaacagtaccagtgttccccacagccctgagaccagctgctagtctggctgtggttgagtgagcagtgtcatgttgaggtggtagaaaatctaccctgaatcaaacagctgctttgaatgaactcaacaatatttcctgagccagctagcccatttcaggagacttggggaaagattcacttgctgagaagagagactacttcctttttctataccttttctacttttyttctgcaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggtgaatgctactttgcttttattttatcatgtctttttcaagttttaagatgaaaatctgaaaagcctcatgcagcagtacacacctgtagtcccagctacttgggaggataaggtgggaggattgctcgaggccagaagtttaaggctgcggtgcgctrtgattatgcctgtgaatagccactgcattccactctgaacaacatagtgagacccaatctctaaaaagaaattttttttgttaaaaaaaaaagaaaaatgaaaatgtgctttttgcagaaattttagaaatactgaaaaacataatgaagcaaaccaagatcttctgtaacctttctacccaaagagactcttattggcattttgtggtatattctaatcttttttctttttttgagacagggtctcttgcagtggtatgatcttggctcagtgtaacctctgcctcccaggttcaagcgattctcatgcctcagccaactgagtagctggaactacaggcatgcgccaccatgcccggctaatttttgtatttttagtagagatgggggttttgccttgtgggccaggctgatctcaaactcctggcctcaagtgatctacccacctcggcctctgaaagtgctgggattacaggcatgagccacgacacccgtccacttttttctaggtaataataaatacagatatatatagctacacatacatgtaaatacaaaattgtggtcatactagctatagtttatacctttttttcatttcacttatcaaaagcatttcctagtatccttaagtgttcaaaaacttgatttaaragcaacataatattctaccctatggctgtatgatgatatatttaattatttttgtattactggatattttttattacttccaacctaaatttttggccacatctcttattgttttcttggataaattcctaagtaagattactgagttagggctttaacgctcttgatacattttatcaaattgccttccagaaaatacttatctgtccctagcagtgtatcagagcacctgtctcactgaattccatctcctatatctactayttatggcagagcaattcataaaacagatattattgtggtccagaaagaaacagtgcatttgtagcatgctacacagacaataaaaactattctgtaggttgatcaggaaatatttcttctatcgtgtaggatttttctaactatggccagtatattgacttttgtttcgtttttaaatctttggcaaacttttgttgaggggtcattttgtaccaggcattgtaactctaggaatacaaaaactgatgaggtccttgccctcagtggttattatctatagattaagtattatcttaattttctgggtgaggaaaagttctctataccattacaagaattagccaagtatatgaataataatttcccaatctatatattctctttctcggtgatcctatccctcctgagactttagctgcattattgacttccacattcttaactaggatgccatgggtacctcaaactttggctggagtcagtcaaatccagacttgaggctcttctgtgctatttactagctgttaatttggggctttatttttkattttctttttgttttttgagatggagtgtcattctgtctcccaagctggagtgcagtggtgtgatctcggctcattgcagcttcygcctcccaggttccagcaattctcctgcctcagcctcctgagtagctgggactacaggcgcaagccaccatgcccggctaatttttgtatttttttagtagagacagggtttcaccatgttggccagggtggtctcaaactcctgacctcaagtgatccgcctgccttcgcctcccaaagtgttgggattacaggcgtgagcctccgcgcctggcaaacttccgttttttcattttcgaagtgggattgttgtgatctttgatgacaatgttcttgcagagggatgcctgactcccaaaaataagatataaagcactgacaagtaagttcctaattagagttggctgttatgacagccctaattatcttttttagtcctccttcctaaacatacacacacacactaccaccatcaccagtaccaccaaaacccttgtttctacctttctatcatatattattacctattaatgtcagcaatactctcccaatctcccaagaaagaaaccaatgtcatttattttcctctccttttccatcccacatctagtcagtcaccaagtcctggcagtggtgccttttaagtgcatatctcaaaattgtttatcccattcccattcccactgctactgtacagtttatcccctcacttctcttacagtcagactattgaacgctgtggcctagggagttttaaaaaatacatatttgccctctacctcttaggtaccatgtttacagggcctaggtctgggcattttttttttttttaaagcaccttttttggctgggcatggtggctcatgcctgtaatcccagctgaggctggaggatagcccaagtccaggagtttgagaccaacctaagcaacatagggagaccctgtctctataaaacatagagaaaattagctgggcatggtggggcacggactgtggtctcagctactcaggaggctgaggtgggaggatctcttgggcccaggggtcaaggcagcagtgagctgtgattatgccactgcgctcctgtccgggcaacagagcgagaccctgcctcaaaacaacaacaacaaaaccacctactttatgtcactgcccacttctgttcattgttgatttctcaccctatgctttaactctgaatgttggagtgttccaagggaatctcatcctgtcctatggttttaaatatcatccctatactcataacccccaaattaagtgcttgtgtctgtattttatccaaatctgcattgctattcttgactttttctctggaactccaaatttagttaatagactgcctacttgacgtctacatctggttgtctagttagcatcaagtttaacatacctccaaaacttaattttcctagccaaagctgttctttccacatttggccctgtctcagtgattggaactcattgacccatttgataagccaaaatctgcagcctttttgtatagtgttttttgtttgtttttatggtaaaatacacataacataaaatttaccattatagaagtgtactgttcattggcattaaatacattcatattgttgtacaaccatcactgtctttgatctcgagaactctctatactcattaaacaataacgccccccattcacccttcctccctgcacttgcaaccactgttctactttctgtcttgaaaccatgtggtatttgtttttgtgactggcttatttcacttagcataatgtccttaaagttcatctgcatcatagcatatgttagaattttcttcctttttaagcccaaataatattctgttctatgtatttattttttgaagcagggtcttgtgctgttgcccgggctggagtgcagtggcacaattatgtctcactgcagcctcaacctcctgggctcaagtgatccaggagtgtgccaccacacccagctaatttagtttttgtagagatggagtcctgctatgttgctcaggctgatcttgaactcctggcctcaagcagtcttcccaccttggcctcctaaagtgctgggattacaggcatgagccaccacatcgagccccattttatgtatataccacattttgcttatccatttatttttggtgaacacttgggctgcttccatattctggctattgtaaataatgctgctgtgaacatggatgtataaatatctctgagaccccactcttctttctttttggtatatacctaatagtagaattgctggatcatatattctgtttttaatattttgaggaagcactctgtttcccattgtacgttcccatcaataatgcacaagggttcaagtgtcactacatccttgccaacacttattttctgggttttgtgttttttggagagtagccatcctaatgcgtgtaaagtgacatctcattgtggttttgatttgcatttccctaatgattagtgatattgaatatcttttcatgtgcttattggccatatgtatattttctttggagaaatggctatttaagttctttgcctattttgcataagcttgtttattttgttgttgttgttgatatgtaggaattttttatatgttctggatatcaatcccatcagatatayggtttgcaaatactttcttctaatctgtggattgtttttttactctgttgatagtgtcccttttttccctatcagatttagactttttaaaatagtggtaaagaacatataacatttaccatcttaactatttttaagtgtacagttcagtaatgttgagtatgttcatgatagtattcattgcacaaaaaaattttaatcttggttaagttaaacttacctttttttctcttattgctgatgcttttaatgtcatactcaagaaatcattgccaaatccaatgtcatgaagcttttcccttatatttttctaagagttttgtagctttagctcttacgtttaggtctttgatccattttgagtttatttttgtatatggtgtacagaaagggtccaaaatttctttgcatgtagatctctagtttttaaaacaccataggttgaaaagactgtccttttccccactgaatggtcttggcccctgttgaaaatcatttgaccaaataagtgaggatttattctatcactggtctatatgtctttatgtcagtaccacactgttttgactactgtagctttttagtaagctttgaagttgggaattgtggatcctccagctttgttctttttcaagattgtttgggctatttggggtcctttgaaagatttcatatgaattttaagatagatttttatatttttgcaaattctgatagagattgcatttaatctgtagattgctttggatagtatggacatttcaactgtattaaatcttccaatccatgaaaattggatatctatttgtatcttctttaatttcagcaacattttgtaattttctgtatacatgtctttcatctccttggttaagtttcttcctaagtatttttttctttttgatgctactgtgtgaattgttttcttaattttttttctgattgctccttgctactgtatagaaacacaactgattttagcatgttcgttttgtattctgcaactttgctaaattcacttaytcgttctaacaggatttttttgtggactctttagggttttctacatagaagatcatgccatctgtaaacagaaataattttcttgcagatttagttttttttttcttttgaggcagagtcttgctgtatcacccaggctggagtacagtcacatgatcgtggctcactgctgccttgacgtcctgggctcaagccagatctagatttttaactgtgattctatttgtatgttccaagcattattctttctcttttaaccttttagaggtaaatggtacttgttacattcctaaagagggtatatggatatctcacttctgtggatctttggttgagttctttttgctgaatatattgagtataatttgttattcctttgtttctaaagctgctttgagatatgtatttcagttcacaaaaccaattactgaggctctatctgctaggtatgaggctctttatgacctgcttagtcaacctactacccagccctccattgcctttcacttagtagaggaatggtctgatgaacaatggcagtaataatcattatacattattatttcttaaaagtatctttggccgggcacggtggctcatgcctgtaatcccagcactttgggaggccaaggcgggtggatcacttgagatcaggagtttgagaccagcctggccaacgtggcaaaaccccgtctctactaaaaatacagaaattagccaggcgtggtggcgagggcctgtaatcctagctacttgggaggctgaggcaggagaattgcttgaacccaggaggcggagggtgcagtgagccgagattgcgccactgcactccagcctgggcgacagagtgagactccatctcaattaaaaaaaaaaaaaaaaaaaaagtatctttgtgtatatgaacttctaactcatgagtcctctttgattaaaaagtgttctagggagtgtagaagggtaaaactttcctcttgatgcccactatttctaccaagatagcatttagcatcgttgtcttttcacctcattgttaatcccgtcattaccttttatgcctcatatttgtttagtgcttacagtttataaaatacattcctgtttttgtttctttttatcattatacaattctatgagatagccagaacaggaattattatcccaccattttacacatgagtaaaatggagcttcagagaaattgacgtaactcaccggaagtcacacaaatataagagataatgctgaaaaaataacccatgtcttcagattactaacaatattcttttctgtatatcacacttcaaccatttatttaactcttcaattattcatttactgaacaaatatgtattatctgcttcataggtatctagcattgtgttaggtacttgacatatcaggactcatcaagtcagtttttggtgggtttttgttttgttcccagctaccgttagccatcatgtgatgttatctattgatttgtttctgctcacaactgtaaatcaagattccagccctcctgtttccttttaccctctaaatcttggattccagcaggaggttggttttccttaacagtaaaatcttctgtctgagatggcttttttggtgtgtgagtggcagatttggacacttgtttcaggactagtcagctctgggagccaaatatggaactgagtagatttgtgaaggaacatgcctttagcagtccatgctcctgagttggacagtggagagtaggaatgcctggcgtgtggaagggcatatatgatagtaactcatgtaagttcagttaatgcatttctaacagttaaaaaagtaactcatgaaataaagatcatatggtacctacactcaagcggctaatcatataaggagaaagataagcagccaagctatgtatggtggtaaaggatagaaacacattccaaggaggttatttgattttatggacatccaaggacaggaaatgcagtgtagtcaggccacctaggactagaactggaaagtctcattaggttctcatctccgtttcttcacaagtctgtttcattacctcactttttatagtctagtggaagacaatgcaaagcctctaagaagacagaaaatggtagacctgttgaggaaccaccagaaatagcccaggataaggaaaggatgtcaccttttacaaataatgcctggtacttaataggaatacatgcactaactacctgtgaatagatagacttcataatctgtgctctctgtcattccttgggtgtcttcactcagtgaaacctgccctcagattgcagagtaataggtattgactcctgctgctggcagtgggcgataatgaaaggagcaggggcaggagtaagaataacagatcttcctaaccttgagccttcccacgtcttttcattaaaacatacatgtattgaatgccttttcccacaagtccaggatgcattgatttagttgtgtgcatctggcaccatgaacaatttttgtcccagtgactgaatgttataaataatttttgttgggcataattagaataaaaggaaactgtgtgttgcaattggaaatgggctatgaagtggttggtaaaataggaatggaggttttgtagtgaatccctggataatcttctgatgaacttgtggtctgtgctttactggcctctttcattaatcatatgccatcgtaggtctttctgaatyggtgttatgttatgaagaagtaagtgccttggggaccaagctgcccactgattatagtaaactttagatatgtttgattcagaatataattttcttttgattttaccatatgattttctgctgtaccatatatagaagaacaagaaataggaatgtcattctttggctgcagtgttggctctgtcctgctgtccagagaacttsttctggtgcctatatagagaaaggttgccagtcctgagcccactcagggacacattctctgcctattcagatacagcagagagcgttgcccagtgttgcctactcagaagccttcagtggttcgctttcttctatgacataaagtctaagttcctttaagactcttcacaatctgcccagcttcctagcatcatttcccaccagtctcttcccacacactatactccagcttcattcattaatagagcttctactgtgtgctaagctctgttctggccattgcaggtaaagtagtgaacaaaacaggtaaaatccctatcttcatggcacttagattctaatggatggggtcgattgacacagataataaactggtaaacaaatacaaaatagtaaaaataatgtatcaagtagtgataagtgctatagagaaaaattaatttgattaagggagatagggagtcctagaatgaggatgtggggagcaggtgactttcattttagataggatggtaaggccaggcctttctttttttttttttgagacggagtttcactcttgttgcccaggctggagtgcaatggtgcgatctcagctcactgcaacctctgcctcctgggttcaagcaattcttatgcctcagcctcccgagtagctgggattacaggcatgcaccaccacgcccagctgattttctatttttagtagagacgggtttctccatgttgttcaggctggtcttgaactcccgacctcgggtgatccacacacctcggcctcccaaaatgctgggattacaggcgtgagccaccgcgcctggcctgggccaggcctttctcataaagtgttgtttgagtggatatcagaaggaagtgaggacacaagctattcaggtaagtggagagagagcatttcagcaaatgtaacagctgatgttgggaaagagtgtggcatgattaaagaacattaaggacgccagtgtggctacagtgaaatgaatgaaaagagagtggtaggagaggaagttagatcagaaggaacccagatcactggggccttataggtgattgggaggatttcatctttcacttgagtgagakggatgttattagaggttttgagcagaggaatgacatgatctgacttccttttaagagaattattctggctgctatgtagaaacttagatggtcagaaagcaagagtagaagcagtgagttgatagataatccagatgatggtggcttggactagaatgacagtggcaaaaatgatgagaaaggagttgaagtgtgtatatattttgaagatataagagcaggtgaggatggcatcaaaatttttggactgtgtaactggaagatttgagttaagagaaggaatgcaggagaagtaagtgtgggagtagggagcagtcaggagtttagtttgagttgctgtctacacagatggaaagatagctgggagagtctaggtttgggagggggcggggcatagaaattgagttgcctatcagatattcaagtagaccatagagtagacagtggatatatagtttggagttcaagggagaggcccaggtaagatatataaatttgggagtcatctacatatagatggtatttatgttcatgagatcacctgcagagtaaatatagggaagagactgagccccagagtgctcaacacttagaggttatggagatgaggatgaactaacaaagaagacaggaaaggaacagccaaggaagtttgtagaaaagtaagagaatgtaaaatgtggtagaaatamcatgaatgtgttctaggtaagatggtctgtatccatcttgactgaccaagtaaataagacccaataattgaccactagatttggccacgtggaggttactggtaattttgtttgtttgtttttgtagagacagggtctcactatgttttccaggctggtcttgaactcctaggctcaagagatccacctgcctttagaaaattaagtactggctgggtgtggtggctcatgcctgtaatcccagcactttgggaggatgaggcaggtggatcacttgaggtcaggagtttgagaccagcctggctaatatggtgaaaccccgactctagttaaaaaaaaatacaaaacttagctgggtgtggtggcatgcgcctgtagtcccagctacttgggactacaagcgattcaaggagaattgcctgaacccaggagccagatgctccagtgagccgagatcacaccactgcactccagcctgagtgacaaagcaagactccatcctaaaaataagtaaataaataaaatagaaaattaagtactcaataaatgttcactgctatattctcttttttcagtttttgcttttatttttgtttttctgtcacactgggctgctgctatcctgtttcagaactatagtgaaaatgggtagactagctgctctaacaagggatatgtgcttttcctagagagcagtctttgagatgtttgaccagtggcttccttccagtgcccccttgacctgcgccatgggctcacactcctatgccatttaaaaactgttttatgtttaattttctatttccatctgatacttgaatccatgtcatttttttttaacccattatcttctgtttcccttctcacttgaatgaagttgagagagcagaagcttggttcatcttctggctctcagtcttcccccaccccaactcccaactttgcttttgaactacaaccttttttttttttttgagacggagtttccatcttgttgcccaggctggagtgcaatggcacaatcttggctgaccccaacctctgcctccgggttcaagcaattctcctgcctcagcctcccgagtagctgggattacaggcatgtgccaccacgcccggctaattttgtttttgtgtgtgcgtgttttgttttgttttgttttgagacagagttttgctcttgttgcccaggctggagtgcagtggcgcgatcttggctcaccaaaacctccgcctcccacgctcaagcgattctcctgcctcagcctcccgagtagctgggattacaggcatgtgccaccacgcccagctaattttgtatttttagtagagatggggtttcttcatgttggtcaggctagtctcgacctcctgacctcaggtgatccacccaccttggcctcccaaagtgctgggatcacaggcgtgagccaccgcaaccaggcgaactacaacttcggatgtgattgttcttttgttctgtagctcaaggctagacacgtagggaaaatgacgccatttgctggaggattggattgtctttgttcaggctgcaaaacagcttttgcatcaaagttgaggtctaggagaaggccacctccttgagcccttcttgctagctagagtccatgttccrgcatgccaggactctccagtgatttgtttttatcttccctcctcctgagccttcatctttgagagagaacaaagtggaaatagtgccaaactctgtgttataaagtatagtggttttgccgctttagccttggtcgactcactttacatttctgagttgcagtttttccatctgtaaaatgggaataataactcatgaaktttgactctacagactattattgtaagataaggatgcaaaaagcttgataaactaaagcactgtttaggtgtaaggcagtattattactctcctcacttctttatccaggctggaccaggcttgcagggaactggtgccagactctgtattttcatttttactttcccaggatattcacctatataaggggcagaacccagtgaggctcctgaccccataatatcttgtgatggacttccatggtcttgccatccaggaaggttcagcaacatagctaaactattgatttgccaactctcagctcctcccagccatggttgttatagctcggtaatgtgggtctgagaagctttgttgccttctctctactccattggagatgccaaggaagaattgttatttcatcttctcttaaaactttgacttgtctcctgtagatgcttggccaggctgtcagaacatcctrggagttaatgagagaaaaatacatatagctcccactaagtgcctataatgtgtcaggcactatagttagtgcttatcttgtttaaacctcatagcatcctttgaaataggtacttattatttccagtttactgaaaagaaaactgaggttcaaaaaagttaaatcccttgttctaagtcacatagtgagttaagttgcagagctagaatttgaacttaattctatcttattccaaaatttgttgttctaatgaccataccatgaggcctcctgttaccatacagaaagaggggccatgtgctacataggaaaactcaggagatttccattcatatgatctacatgaagatcccaactgcgcctatgcgatctgggacaagtggctttcaacttgtccaagccttagatactatctcattaacttgtcaccataggtgttttttttggggagagggggagattatttatttatttatttatttatttatttatttatttattttgagacagggtcttgctcagttgcccagcctggagtgcagtggcaggattatggctcactgcaacttccagctcttgggctcaagcgatcctcccacctcagcttcctgagtagctgggactacaggcccgcgtaaccacacccggccaatttttgtatttttagtagagacagggtttcaccatgttggccaggatggtctcgatctcctgacctcatgatccacctgccttggcctcccagagtgctgggattacaggcatgagccaccgcgcccagccagtagatgttattcttatcyccagtttacatttgaagggaacaggcctcagtgagttcagatgacttgcccacggatgcagaatagtaaatggcagagccagaactcaggtccaggtctatctaacacctgcttcagtgttctttccaccatttttcacagccagcttctaagacctggtgtatcattcagctagatttatagctctgaggctgctggttggaagctggcatccttttctgctctctttctcctcccatactttctccctcttcttagaaaccttacagaggcaatataggtatttgaaattcaaagaagagatttatgccgtgcttaaaatctgctcatactgccccattagacacctgggaatctgcctctcgtcttttgtatgggtttgtactgttactttggtagcatgatgtggtgggtatagttttgggaatgttctttctcagctcttttctttatgagtataatcttgtgaggtggctgtaaagttagagatgatgaatattcaagggtagcaagtacaggcttattatttgatggcagttatttcccctggyaccaggatctaatagaaaccagaatagcagtcaggagttctaaatcttttactcctattctttgaccttggatatgtgagtcactgtttctagatagactggctagtctttaggggcgcctttcagctttaatgtcctgcactttaaaaaatgaaagtaataagatacttgtttaaaaaaaatcaaattagacagaagtatttgaaggaaaaagtgaaagacccatatcctttcccccattcagttcattcccaatgtgtaacacttattaccagtttgatgtatccttttcagtgttctctgtgtatactaaatatacacaagtgtgtgtaacatacacagtttatatcatgtgcatatatatataaatacamatgtatatgttatacgcactggaacctacaatacatattatgtcttggttcttttacttaacatgttttagctatttttttcttgttggcacttaaagatttactttattgtttgcaatgtcttatactttttttttttttttttttgagacggagtctcgctctgtcgccaaggctggagtgcagtggcacaatcttagctcactgcaagctccgcctcctgggttcacaccattctcctgtctcagcctcccgagtagctgggactacaagcacctgccaccacgcctggctaatattttgtatttttagtagagacggggtttcaccatgttagccaggatggtctcgatctcctgacctcgtgatccacctgcctcggcctcccaaagtgctgggattacaggcgtgagccaccgcacctggccacaatgtcttatactttattaagtgttggctggacatggtgtctcacacctgtaatcacagcacttcgggaggccaaggtgggcagattgcttgagcttaggagtttgaggccagcctgggcaacatggagaaacccaactccataaaaattagcagggtgtggtggtgcatacctgtggtcccagctacttgggaggctgaggtgggaggattgcttgagcccaagaggttgaggttgcagtgagctgtgatcgtgccactgcactgcactctagcctgggcaacagagcgagactgtctaaaagaaaattaagtggtcccctattgattgtgtgctataatttttctttttttctctttttagagatgagatcttgctatgttagccaggttgatcttgaactcctggcctcaagcattcctcccacctcggcttcccaaagtactaggattacaggtgtgagccactgcacctggccaattatgtgctatgattgttaaaagcaaatatacacatacagtgttgatttttaaaattttcttttcaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttccsctcatgcaacaggcaggtttgkgagttagaggtcaaaagcagctgcctgaatgagttgttgtttccttatcactcctggtccctttgcaagtgaaccctgcagctcacccattcattcacccaacttccttcattcagcaggaggycctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttatttttcctataatccttcttcctgggtaacttacagacttaaagtcactgagcctgcattagctgacaaaaacatttaatatgttaccttagaccttggagagatgcccagcagaggtacagagccaaaggcactagcagatcactgccttcttgggagatcacttataagccctcccttttgtaatgatcagatgccctcttccctcagagttgattagagaagcagtaagaatttgtagtcataagtactagcctggtgcacaggtcagcagtcctcttggccagtggtcattttctcccaccaccatggtacaagcctgggttctgtgccctgaacctgaattctggaaagggagagactacagcatttcacagagaacagccagacccaagagctttcagtgtaggatgggcctgaagtgacagttcaatagccaaacctggggaagccccatcactgactgaactaggtcatttgaccatggagggggggcagtgtaaaggcaacgtgtaggtacagctcttttattattaaatgtgtaaggtgatcagctgattaacaggctccgagactgtccatttcagtctcccatccagtgcttcttcctcagtaaccttcaggccgttatttctgcccactctctgacacacaggataaaccaagactcccagagttatgttaccaaaggcaaaaaggcaactgggtggccttggctctgctttattgacctcagagcaccctatgagtgcagttaaaaaaaaaaaaaaaaaaaccacatacaccatgggaactggaactggatcccggtcagtggcacctgaccccagaagaattcgtggatttgtacaaaatgcagaggaagaaatgaggcaatgtggtgctgagtcgaggggtagccgattggcagagtagtagtcagcaacagtgcagtcaggtcatgcctctttctcataagtgcgagtgcaaactgcagtgccgtgggtgagtgtctggaaggaaagacagagtgagatggggggtggagccaggaacaccattgcgagcattctaccctcccttcctcctgataattgtcacttgagtacctactatgtgccggctatatgtatgtatgtgtgtgtgtgtgtgtgtgtgtgtgtatacatacataattttttttttctgatatgcacagcaaatccttaagacaggcattgtaattcttattttagagatttggaaaaaacgagcctttagagaggaagtaatttggtcaagatcctgagtgtttttccttcccttataccatttggcttccttcatccttagtgtctaagatggtgcctggcatatagttgacaaataggaaaaatatccagagactcaggaaaggactgtgtttggctactaactccaatccttccctaacttagagtagtgccagggccagagccctgtacctcccactatccggtctggcatcatagagccagacccatggcctcaccatagttcagctgccactgagaatttggtcctgcatatcacatccccaccaaagctaggcacctcattccaaacttcaaggggacccctgtcccacatgagtacaagaatgcagttaacaggttatgctgacccaagaaggtgtgcagtgaagatgcctaggtgaaaacctgaggccctgtggttaggcagaatccacagttggctgctctccctgggtctggggggaattcagtcaaggctagattctccaagtgaagtccccaagcttgaacagatctgccagcctggctgtggtacttcctacccaagcagtagtcaagtagtttcagtaggccagacatagaaagcatgaaaatggggtaggactagaatggggaagaaaggactgtactgtcattcagtgtccccaccagtcacgagcctgtccctgcaagtgacaatgcagtcctagggaggagaggaaagggaatgctgagataggcaatgggagcccctcctagagggcctgggatcagatttggccctgttttctacttcttcctgaggtgaggcaaggtagaaacacaggaagagcaaacaaaggacatggagcacctgctgtgttcctcaatcagtgatgctttgtgctgtgcatacactgtctcttacaggcttcccagcagccctacaaggttggtattattaatacccgttttacagttgcacttggaaaaggtgatttgcccacagtcatgtagcctataaggtaagatttgagttccggcctgtgtgagtccaaagccactacacagaaaattcccacctgataccaccctgacccacaaccactctcttgtcccagcttctacagctctcaggggaggacttggctttttagaacaggcttggctgaaagagcagtagtaataaccaatcagatatagctccaaagttgcccatcttaccaggatgagttttccatcaattagctcccgcacaagtgtggtctcttgcccgtcccatttctgcaggtgaacaagtttccctccatccagtgtcacaatggactgtggaaagagggtagaggcctgagctgtgatcttagtcaggaattgaggggcagggtggggtctggacactgggccacagaggacacagcctttgacccaaactagtgatggtgtgaggacaagagctcaggcaatccgcctcccagctatccctgcaagacatctagttcacctccagcctctgctccactactgcctttctggggaagaggccttcagatattaggcaaggagggagaggcaggcagtatggtggagccagagagcctggctctgagaagtaccacaagccttcaagacagacacttatctgtactctaggtgattcccgtagcctggtcccctcagatacaggtgggatttactagtctatccctgggaaagactgactgaggaggaggagtagtcctgagaatctttatccagccttgtggttagtccacataatgtctaaaagacccttagtgataggaagtattggataattagacttcctgccctgtattcctacaccttttcttggtccacatcatgtgacctctttagccaacaagagggcagcaaccacaaagtcctgtgactggatgcccttgaagtggttcctcagctctgggtgctgccagcatacatacatcagctggttctcatttggcagctcttccagctctctttcctaggagtttgggggccacaaggccaggctaagggatcctgatgagcaaggtggttcagtaggagaatctgagaaggttctgtgtattgtttaggtgataaggggtatgaggcctgtctcttagtgtgctcttttttatccttaccttactccttgttctcattcccctagttttttttgcctactcagagtagatatttttgccctaggcattccacagggctattgtgtttaattggggttcttgccccttgagaaagtaggcaagtccaaggaggtatgagcaggtggtggggcagccacctttatccaaggtagactgccatctttgggcaccatccccagctctgctgccagccacctgtgtgatcctgttctttctggggacagctatgaggaagaggaaacagctgatggggctgaatgatagtgtcatgatagaacactgctatagggacaccctatagaggtcaaagcccttaagttctctcgctcccatgcctggcctggaaggctgaggcaagctgccaagacagccactgcagggtgatagaaccctgggaggaggggctaaggcttggtgggaagacactgcaaacacattcatgacaaggtgaatgccctatcacggaacatagctcttcctgcctgtcagctggcaacactggaaatagtttgtcagggtcattggccatgtctgggagttagaagttgaagcggcatctgagtaggtgcttctagttcctggctgccttttttgctgctggaggtcacaatgacctcactcagtggagggccctgacttctgggcatcattcctaaagcacttcaggtcacagccatggccacataactctgccatctatggaaggggaaagaaacctagagctactgcataccttgcacagggtcacccagctggagctggagtagatactgaggtcagaagaacatcctggctctgtgctgcccattccgaggcagacaatagatgaatcccaagaagggagggaagaaaacaagaggacagaactgacatgtatttagcatcagtggcattccagcactacacaggctttatgaatcttgtttcatttaaattccccatgatagtctgcccctcagggtgcaataccagggagccaagactaccagcctattctcttttagagtctcagcactctccattccccacccctgtttccctgacttaccttgaccttcctgtcatctgctgttgtctcatcgaactccacccccaacttaaagctgatctctgtgttcttgaaggtgctgtgtgtttttagggtgagaatgtccccattcttttcgatgattgtggtaggcttggtcatgctggccacctgcctggtagcaaaacccacacctgagggtagggggaaggttatgagtatatgagctggggtagagaagcagtgtacaagaaactcaatgaataactctcaggcctgggtatggggaagtggaggactgtatctttcaaagcctttgcatgggaattttaaaattcagtcttgcgcttagttctgtttggtgaacacagataactgatcccattagatgagagatacttaaggaacagcagtgccatagcaagtcagtggcagagctgggattagaataagctactattgggccaagtgtggtggctcacgcctgtaatcacactttgggaggccaaggcaggcggatcacatgaggccaggagtttaagaccagcctggccaatatggtgaaacccgtctctactaaaaatacaaaaaattagccagatgtggtggtatgtgcctgtaatcccagctactcaggaggctgaggctgagaattgcttgaacctaggaggtggaggttgcagtgagtcgagattgtgccactgcactccagcctagccaacagagtgagattccatctcaaaaaaaaaaaaaaaaagctactattaagtactatgagctttttgtgtagtaagaactgtacatgttatctcatttagttcttcctgttcttctgaagactgtttccacgttacagatacaaaaacagaggtaaagcccagggtcacaaatctgagattgaagcccagaattgtctgagtccagagcttgcttaagtgctcagctatactacctcccaaggctggagcataaggctgccttccagggcacctgaaaagctctcaaagccttaggaataaggctgaggaaagaagagaaacatagactttcccttccaaagccttaggcataggagttttccaactttggaagtttttaccctgaaactaagaagtgttagtgctcttgtcccttatacatggcaacccatcattttcaaagcctgttatctatgatctaggagttaggtacaaaggaagtatttgtcctattgtgcagattcaggaggagcctaaagcggtagcaacaatgagttagactcaaacccgtctcctgactcccagtctaaggctttacagagactctcttcctgacccaagcatggcttccttgggtactgggcaaagtcctaagtgtcctgcaaccaagtaaagaacaaagaactaatcatgactgccccctctccccccagcagcttaacattgaactgtcttccaaggcaaaggtgaggcaggaggcagcccagtgtagtgaggtggtgtgtgtaaagtctccaaatgtacctggctacatagtgcttgctggaagctaggtactctgcacatgccctacatgggttgttttacttaatgcttgtaacagcctcgaagcgtagattatccccagtttacaatgaagagtgcgaagtgtcttgtcgaaattcaaagagaataaactactgacatagatttgaacctcggctccaaaactgttgactattttcactgggcgattctgtccagcacatactcaatccaggccagcagttgtgcctgtggtcactggtactagacgggacctctttgccccttgagagccctaggtctacagcaggaggggcaggggctgcctctgctgttatgctgtcagcccacccttgcttggccagtgaggaacttggcattgccccttggtatcaggatgagtcaggccaatcacactcccttgcacagagcaggaccttgtcacggcactgggagctctgttcacttaggatctacccagaggtatggagtgtttgaaaaggaaaccactgcgggatgagtgagggtctgaaccaagagaaactaagaatattgagctgacagaatttaggagactcagggagatctgggttctacttagaaatgaagccagcactacttactgagagctgagg

SEQ ID NO: 12498 - DNA, 29814 bp, Homo sapiens
acacccagccagcgaaatggctatttctagtgggagagccaatatccaaagattcgtttgtattcattacagttattaccaaatatattggcccactttcttcctgaggttttctttatttccttgtcaatgttcagtgccatgctggcacctggggctggagggcaggtatatgaagcaagatagagtccattatttttcaaaaagccttcaatatgtgagaaggacaggatttgctccttaaagaatttgaaaacatattggctgggtgcggcggcccatgcctgtaatgctagcactttgggaggcccaggcaggtgcttcacctgaggtcaggagtttgagaccagcctggccaacgtggtgaaaccctgtctctactaaaaatacaaaaattagccaggcatggtggcaggcgcctataatcccagctacttgggaggctgaggcaggagaattgcttgaacccgggaggcggaggttgcagtgagctgagattgcaccactgcactccagcctgggcgaaagagtgaaactcctcaaagaaaaacaaaacaaaaagaatttgaaaacattatatcaataaaacagataatgggaaagtgttcttctgagcttgcagcaaaagtattagagcagaagctatatggctgatcatcagggaagtagtagagcatttggataacagtcagaaaatgggggtatttgactgcaataagaacccttctaacacaggttatttaggagtcccatagataatttcccagtttcaattgcatataattggttataaaaagagattatggccaggtgcggtggctcatgcttgtaatcccagcactttgggaggccaaggtgagtggatcacttgaggtcaggagtttgagaccagcctggccaacaaggtgaaacgccgtctctactaaaaatacaaaaaaaattagctgggtgtgatggcgggcgcctgtagtcccagcttctcaggaggctgaggcaggagaatcactggaacctgggagatggaggttacagtgaaccaagattgcaccactgcactccagcctgagcagcagagcgagactccgtctcaaaaacaaaacaaaacagagattataattaattacataactgagagagagaaatgttacaaatttagtagcatgggtgattctgcttgcattctactctacaatgtacctgcttttttttcaagagtctcatttcctagttaatttgctgagagagagttctatgtaaattgtaaaattattcttagtatataaattatattcagcatactattaaatacattagttgtttatacatacacattacaatatcattttttgggtgatttctgggatttccaatgaccagccccagtttttcacctaaaggctgacgttagaacttaacctctgcagcccaggcgcggtggctcatgcctgtaatcccagcactttctgaggccaaggtgggtgtatcactaggtcaggagttcaaggccagcttggccaagatggtgaaaccgcatctctactaaagatacaaaataattagccaggtgtggtggcaggcgcctgtaaccccagctactcgggaggctaaggcagagaattgcttgaacctgggaggcggaggttgtggtgagctgagatcgcgccactgcactccagcctgggcaacacagggagactctgtctcaaaaaaaaaaaaaaaaaaaaaaaaaagaacttaacctctgcataagagatttctatgggagcacagtgacagaatatgggatgtgcaaggatggattcagtgaattgatgaagccaaactgggacatgaaggaggatggcatctggagagctgtagaggggtgaaggtggtccatgtgggtgtgtagggattgtgtactttcgatgtccaaagatcctgctgctctccctgcctcttttcctcacgtttctctaccactttcccccacagaacgtgaagctcttggagcaatttgtctgcgcccacacgggtatcatcttctatgctccatacacaggttagcccatcatccctgcaccaccagagagcttttccttgtggcatgccttgtttatgtagttggccaataggtatttgttcagtggctcctgcttatagcctaaaaggtctggctgaaccttttggaaatcttggcttgctgggggctaaagtaattaaatgtggacaaaagaaaacaacaaatacagccaggcgtggtggctcatgcctgtaatcccagcactttgggaggccgaggcggctggatcacctgaggttgggagttcgagaccagcctgaccaacatggagaaaccctgtggtgatgcatgcctgtaatcccagctactcaggaggcggaggcaggagagtcgcttgaacccaggaggcacaggttgtggtgagccaacattgcgccattgcactccagcctgggcatcaagtgaagctccatctcaaaaaaaaaaaaggaaaaagaaaaaaacaagtacttctgtaagcaaactatctaaatgtagtttttaattgataaacagtgattaattcctttctatagggtcttttaacttttacaaaagacttctcacaaattgtcacataagttattttatatcattgtcaattggattagattttccaaacttggaatcgtaaatttaacaattcagaattatatttattccctaactacagtcacagggcaaatctggcccactgtcacgtccatttgttttcatattttctgcaattgcttccatgctacaatggcagagttgagtagctgagacagagaccacaggacctgcagagtttaaaatatttactatatgactctagacagaaaaattttgctaacccctgctctgaagcaagacaaatttgcagagaataattttttgttgttttttttttttgagacgaagtttcactcttgttgcccaggctggagtgcaatggtgcaatcttgcctcaccacaacctctgcctcccaagttcaagtgattctcctgcctcagccccctgagtagctgggattgcaggcacatgccaccatgtccggcaaatagagatggggtttctccatgttggtcaggctggtctcgaactccggatctcaggtgatccagctgccttggccttccaaagtgctgggatgacaggcatgagccaccgtgcccggcagagactaatctttgtttttgttttttttgggggggtgtgggtggggggatgaaatctcatttactctgtcacccaaggctggagtgcagtggcatgatcttggctcactgccgtctccacctcctgggttcaagcagttctcctgcctcagcctcccaagtagctgggattacaggcacgtgccactgtgcctggctaattttttttgtatttttagtagagacagggtttcaccattttggccagtctggtcttgaactcctgacctcaagtgatcctcccacctaagcctcccaaaatgctgggattataggcatgagccaccgtgcctggccttgcagagaataatctgaattcaccattgttgggggtggcagtacaatcagtgttcagtttgtcaagagtttcttatagtcaagctgtaaaggctgaagggactattattgttactctctcagattgccttccccaactctgaaatctcttttccctttattgaatctttgtggattgttcaactcaaccctctaattaaccacacttgcccattaaattgtgttctccctgtcttggaggttttaccattaaatggcttctctatagtggctagaccctcctaaatctttatcccagctctccaaaagatgggggagattctttcctttgggcagatggggaaactgaggtccatggaggggtcaggggaaaggggtcattaggtaaagccaatccttcccaatctacccctctgtcaccatatggaagcagttgtgttctattatttactgtgccttaaagaacaagatatttttctccccacaggagtctgtgtgaagcagcacaagcggttgacccaggccatccagaaagccagggatcatggtgagcatgagacggggcacacagcagttttgtttaggtataaggaagatgacttagggctagaaaatggatataaatgctcacacctgttcaagatggtagcacccagcatgttcttcctgacgttacattgtcccctgtcctttctcctgagtgtcttactttatcattgtcctgtctccttgttctttgtctttccatccttttccctcctattttacaactgctggtctcaatgccttaggaagttctttatataaatgtctggccctggactacatggcactgctgcataagttagtaaaaagtatacccctctgctagggcagatgcagcttcatagtccttgttcagcactgcacagctttgtaagcaagagccccagcagtatgtcagcccacacttgccctctgggccggtcacctgtttgcagtatacaacatgcataaatgtacctggtggctctgactggtccttccctttataatcctttttcttacttcatctaaaccaccctcctcattgcctcttaaatttcttttcttttttaatcccttaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgctttgggctgtttccgatgaatgccattagcggggggtgggctgagtgatggtcttttcatataagcaattgggtgatgctgtggggagataagtggtcaggcttaagccagccttgcctgtgacgcctgggactagaagccggggatgggcagctgtgccactctgtcaagatgccttgtgggcccccactccacagcatggcccactgttcactgaggggataaaaggttggacagtgagacactgggccaaggaagactacgttgccatggcactcactgccgtgggatgcagggatggaaaggagtggcactgctaggggcacagctggtttggcaagaaaaacgggggccctgtcagttgccaggacgctagggggcaaggtctacaggcggggctcctggaaataaagactccgagaggcggtgcggcgagaggaggggcggaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccggtgacagctcaaacccaccctctggcccttttctcccggttcctctccaaacctggtycaggcaccacgcccccttctcactgactagtgatcgccccttttgatgtccaggcctgcctttttggtgacctctgaccctgggcctagtgggattgatcagcgcttggatctgtgacctttcaccccgggcccaaaatgtcccaatcaaaggatgtggttgacctggcctttctgcttcctcacaataaccttaagggaggagggagtgtgccaccttgaaaggtgtgacagaagtttgggtttcagaagggtggggtgggaaatcagattggaagactcccaggcaaaggcagggagccttcagtgttaaacctgggttggagttgtggcccaggttcccaggactgactgcctaggacccgctaatttagtgagtatctgactctttatttcttctctttctctagtgttgatctacagcagcaaattatgaccattatagatgaactgggcaaggcttctgccaaggtactggagagtttttagatggagtaaagggaggacctctgtggggatggtatataagggaggcctgggtccttcggagagacttgcagaaagtctgacttaatcttccctgcaggcccagaatctttccgctcctatcactagtgcatcaaggatgcagagtaaccgccatgttgtttatattctcaaagacagttcagcccgaccgtgagtgccacatgctcttccatcccatacttaattccttccytcctcagcccttcccccatctttgactatctcttgcagatagataccactagcctgttcattattttccccgtcctacagggctggaaaaggagccattattggtttcatcaaagttggatacaagaagctctttgtactggtgagtgttattggatrctaggagttcgtataccttggtttctgagaacaaaagtgctggaggttagggggcagcagagatgccggggttcctaaaacatttttattgtttctctcttaggatgatcgtgaggctcataatgaggtagaaccactttgcatcctggacttttacatccatgagtctgtgcaacgccatggccatgggcgagaactcttccagtatatgttgcaggtatcactgacctcttcactggttcatccaaactaggggctcctttgccctgagcccttccagaagccctgcctcccaccccccatgttcccatgtcattctattcccttcccaggcttctggcttcctgttggcatgctttccccatacttcctcctaccctgagtctccttttccctgcagaaggagcgagtggaaccgcaccaactggcrattgaccgaccctcacagaagctgctgaaattcctgaataagcactacaatctggagaccacagtcccacaggttagaggtttcagagaatagatccccactgagcattcccattgaatttatttgttatttatggcaaagaagtagtgacttatttcctatcacataggtttcattttctacaaccaggctctttctttctcttgtggtaccatctctcatcctgtagtgacttctttctcatctattttgatttttttttttgagatggagtctcgccatgctgcccaggctggagtacagtggcgcaatctcagctcactgcaacctccacttcctggtttcaagcgattctcctgcttcagcctcctgagtagctgggactacaggcacccaccaccacacccagctaatttttatatctttagtggagacggagttacaccatactggccaggctggtctcaaactcctgaccttgtgatctgcccgccttggcctcccaaaatgctgggattacaggtgtgagccaccgcatctgactttttttttttttttttcaaagcagagtctcctgctgttgcccaagctggagtgctatggcaggatcttggctcactgcagcccaaccttctgggctcaagcgatactcctcccttagcctcctgagtagctgagactacaggcatgcaccaccatgcctggctaattttttattttttgtagagatgaggtctcactatgttgcactgggtggtcttgaactcctggctcaagagatccacctgcctcagcctcccaaagtgctgggattataggcgtgagccactgtacccagacttattttgattctttaccacaagttgtttcctacacctaatttttctttttttttttttttgtgagatgtagccttgctccatcgtccaggctggattgcagtggcacgatcacagctcactgcaacctctgcctccggggttcaagtgattcttgtgcctcagcctcctgagtagtagggattacaggcatgcaccatcatgcccagctaatttttgtatttttagtagagatggagtttcaccatgttggacagactggtcctgaactcatggcctcaagtgatgtgcccacctcagcctcccaaaagtgctgggattacaggtgtgagccaccgcacacaacccttatgcctaattttyttttgagacagagtcgctctgtcacccaggctggagtgcagtggcacgatctcagctcactgcaagctccgcctcccaggttcacggcattctcctgcctcagcctcccgagtagctgggactacaggtgcccaccaccatacccagctaattttttgtatttttagtagagatggggtttcaccgtgttagccaggatggtctagatctcctgaccttgtgatctgcccgcctcggcctcccaaagtgctgggattacaggcgtgagccaccgtgcccgaccccttatgactaattttcaacccaaacatagccagctcattttcacctccttgttttcacatagttcattactcatctggtcagtcagtatttattaagggtccagaataatatgcattccctgtcctcatggagctttggcctaatatagggaaggaagtcttgtttataactaagtgcagcaaaatgttactaatgctacccattcatccaataaacattgagtgcctggcagtgttctgggcactaggaatggtttactcaatgaaacagacaacagcctgggcaacatagcgaaactctgtctctacaaaaaatacaaaaaaaaattagccaggcgtggtggcacgagcctgtagtcccagctacttgggaggctgaaatgggagaatcgcttgagcctgggaggcagaggttgcagtgagccaagatcgcgccactgcattatagcctgggcaacagagagagaccctgtctccaaaaatgaaaacaaaaacagaaaaaaaggccaggtgcggtgcggtggcccatgcccgtaatcccagcactttgggaggctgacgtgggcgaatcacttgaggtcaggagtttgagaccagcctggtcaacatggtaaaaccccgtctctattaaaaatacaaaaattagcggggcatgatggtgggtacctgtaatcccagctacccaggaggctgaggcaggagaatcacttgaacccgggaggcagaggttgcagtgaaccaagattgcaccactgcactccagcctgagcgacagagtgaggactccatctcaaaaaagaaaaagaaaaagggccaggcatggtggctcatgcctgtaatccccacactttgggaggccaaggcaggaggatcacctgatatcaggagttcgagatcagcatgtggaacatagtgaaaccctgtctctactaaaaatataaaaattaactgggcatgatggcgtgcgcctgtaatcccagctactcgggaggctgaggcaggagaattgcttgaaccccggaggcagaggttacagtgagccgaggtcctgctacagcactccaccctgggggacgaagcgagactcttgtctcrgaacaaaaaaaaaaaacagaaaaagaagggaacagacaaaagtccctgtcttagtggtggagcttatattctagctggagagacaaacaaacataataaacaatatggttaataagtgctctggaaaaatgagagcaagtaagggtttgggagtactcaagtaaggtggggatgggagtatgtgggattgcaggttgaaaggggatcatcactgagaaagtgtcatttgagcaataactgaaaggaagtaagagtaaaaactggccgggcacggtggctcatgcctgtaatcccagcactttgggaggccgaggcgcgcggatcacgaggtcaggagatctagaccatcctggctaacatggtgaaaccctgtctccactaaaaaaaatacaaaaaaattagctgggtgcctgtagtcccagctactcgggaggctgaggcaggagaatggcgtgaacccgggaggcagagcttgcagtgagccgagatcgcgccactgcactccagcctgggtgacagagcgagactccatctcaaaaaaaaagaataaaaaccaaggctgggcgtggtgacttacatctgcaatcctagtacttagggaggccgaggtgggtggatcacttgagcccaggagttcgagactagcctaggcaacatggtgaaaccccatctctacaaaaaacacwaaaattagccaggtgtagtggcacgcacctgtggtcccagctacttgggggtctgaggcaggaggattgcttaagcccaggaggtcgaagctgcagtgagccgagatggtaccactgcactgcagcctgggtaacaacgtgagactgtctcaaaacaaacaaacaaaaaaaaagagtaagagccaagaaatatctggagagagagcatcccagacagaaggtaccaccagtgtatggccgtgaggtgggagtgtgcctgaaagagcaaattggctgtgtccagagcagcatgagtcagcrgaggagtatggtaggagatgagaccagagaggtaatgcrgaggaggggcmttataggctactgcaaagactggcttttattttaagtaaaaaataagatcaggccaggggtggcgactcacacctgtaatcccagcactttgggaggccgaggtaggtggatcacctgaggtctctactgaaaataccaaaattagctgggtgtgatggcaggtgcctgtaatcccagctgtttgggagtytgaggcaggagaatcactagaaccgggaggcggaggttgcagtgagcygctgaaattgtaccactgcactcctgcctgggcgacagagcaagactccttcttaaaaaaaaaaaaaaaaaaaaatagcgccaggtgtggtatctcattcctgtaatcccagcattttgggaggcccaggcaggtggatcacaaggtcaggagttcgagaccagcctggccatatggtgaaaccccatctctactaaaaatacaaaaattagccgggtgtggtggcgggcacctgtagccccagctacttgggaggctgagatagaagaatcgcttgaacctgggaggcagaggttgcagtgagctgagatcgcactactgcactccagcctggataacagaacgagactccatcaaagaaaaaagaaaaagatcattttggctgtgatcttgattttttcctttttaacaagatcactttggctgttaagaacaggcaatagccgggcacagtggctcacacctgtaatcctagcactttgggaggccgaggcaggtggattgcctgaggacttcaagaccagtctggctaacatggtgaaaccccatctctactaaaaatagaaaaaaaaattagccaggtgtggtggtgctcgcctgtaatcccagctactcgggagactgaggcaggggaattgcttgaatcagggaggtagaggttgcagtgagctgagattgtgccactgcactgcactctagcctggtgacagagtaagaccccatatcaaaaaaaaaaaaaaaatggaaacggcaataagggagccagagtagaagcaagtagactaattaggcagcaacaatcctggcgaaaaatggtggtggctcagaccaaggtggtagcagtagtgatggtaaagagtggtcaaattttaaatattttgaaggtaaagcaagtaagatttcctgacagattgtatgtggagaaagaggactttaggacaatgccaaagcctgagcagctggaagaatgaagttgctttaactgagatggtaggtagaccagctttgggggaaatactaggagtacatttttaatatgttaattggagatgtctgtgatatgtccaggtttgagyagacagttggatacttccctggagatcagggaggaggtttggggaggagagttttcagcatacatctggtatctaaagccaacagacaggatgcgatcaccatagaaagattatagatagagaagctgcccctttgggccctctttaagaagtgaggacccccaactggctgctctgaaaagccatctttgcattgttcctggttcggtgtcctgctcaccacagccacctccgccatgcacttcctctgctgcctcagagtctggcagcttaatcgacatagtccccaaactctcactttcttcttaatcccttgcatcggatcaccgctgtgccccaccatgtcagaggcagttgtggacacaagctccgtgatcaccaccaaggacttcaaggagaagttgtggaggaggcagaaagtggaagagacgcccatgctaacgggaacgctaatgaggaaaatggggagcaggaggctgacaacgaggtagatgaagaagaggaacagggtggggagaaagaggagaaggaagaggaaggtgatggtgaagaaaagaacggagatgaaaacgaagcagctgaggcggtatggacaaatgggcagctgatgatgatgaagatgacgatgttgataccaagcagcagaaggccagtgaggatgattagacagcaaaaaaagaaaagttaaactttaaattaaggccaccgtgacctattcaccctccacttcccatctcagaatctaaacatggtygccctcgagaggcctgcttgccctccacagacagtgccactgcagatgacaggcactcaccaccacccaacccaaaccagagaatttgcaacagaggaggaaaaaagaaccaaaacttccaaggtcttgctcttttaaaagtactttaaaaaggaagtttgtttgtattttttatttacattttatatttttgtacatattgttagggtcattttttttttctttgagacggagtctagctctgtcgccaggctcaagtgcagtggtgcsatcttggctcaccgcaagctccacctcctgggttcaagtgattctcctgcctcagcctcctgagtagctgggattacaggcgcccgccaccacacccagctaatttttgtatttttagcagagacaggctttcaccaggttggccaggatggtttctatctcctgaccttgtgatccacctacctcggcctcccaaagtgctcgaattacaggcgtgagccaccggcgcccagccaggttcagtcatttttaatgatctcagatgaccaagccagcctttggagggttctctgtcttacttctgactttacttgtggtgtgatcatattcattataatctcaaaggaggaaaaaaaaaaaaaaaaaaaccttgtttaaaaaaaaaaaaaaagcctgggcgcggtggctcgcgcctgtaatcccagcactttgggaggccgaggtgggtggatcacgaggtcagaagatcgagaccatcctggctaacatggtgaaaccccctgtctactaaaaatacaaaaaattagccaggcgtggtggcgggagcctgtagtcccagctacttgggaggctgaggcaggagaatggcgtgaacccgggaggcagagcttgcagtgagccaagattgtgccactgcactccagcctgggcaacagagcgagactacatctcaaaaacaacaacaacaacaaaaagtctcgttctgagcattccagtagcttctttagtgtatgtagttagttgtaccataagtagttggtttgtgtgagatggttaaaaaggccaaagataaaatgtttcatttatttgccttttttgtctatgaaatggctgcttatttatttaggcctatttgatgtatgtgtgaaacaatattgtgcaacaataaacccaaattttattttgctgagttgttctaacagcaacaaaaagaagttaaggaagagaagaagaccagcaaatgcaaccacagagtgactagtgaagtagatgaaaactgaggccgggtgtggtggctcacacctgtaatcccagcactttgggaggccgagtcgggtggatcacctgaggtcaggagttcaagaccaacatggtgaaaccccatctctacaaaaaatacaaaattagccaggcgaggtggctcatgcctgtaatcccagctacttgggaggctgaggcaggacaatcacttgaatctgggaggtggaggttgcagtaagccgagatcatgccattgcactccagcctgggcaacaaagcgaaactccatctcaaaaaaaaaaaaaaagaaaagaaaactgaaaagtaaggtgacctcaaaggccactgaagaaagtgtttccaggaggaaggaatggtttacttggtcaaatgctgctgatcaaggagcaaagaggtctgagaagttaccattggatttatctgcgttaggccattggtgatcttaatgagcagttttggtgcagcggtgtttggaagcctggatgcagtgggtcttgtagactgagaagctaggaacacagcaagaataagctactcttttaaatcctgctttaatgggaatagaaatagagcaagagctggagagtgaagtggatcaaaagagttgatcttttgcagatgggagaacaaatagcattagaatgattcagtagagagaaaatattattatgtcagagaaagtggggagaactgttgaagtgatgtcattgaatgggcggcgggggcgttgagatttggttgacaagttagccttggataggaacatggacagttaatccaytgtaacatgatttgatagatgtgattacagaggaggcataaggacatggatttgagtgctatcttgggctgggggttgggtaaagaaagatgacatgtctaatcttgaaaggcaagtgtttgtcaggtggacaaaaggctaaagtgcatttcatgtagaggaacaggcatgagcaaaggcagaaaggtattaaaccacctttcaggccaggcgtggtggctcacacctgtaatcccagcactttgggaggccaaggtaggcggatcacaaggtcaggagatcgagaccatcctggctaacacggtaaaaccccgtctctactaaaaatacaaaaaaaattagctgggcgtggtggcaggcgcctgtagtcccagctaatcaggaggctgaggcaggagaatggcgtgaacccaggaggcggagcttgcagtgagcccagatcatgccactgcactccagcctgggcgacagagcaagacactgtctcaaaaaaaataaataaataaataaaaataaaccacctttcaggacactacaagcagtgtggtgtggttggagtgctgggcatgtgcttgttggggggtgggggtgatgaggatgggctggtagacattacaacaaggtcaaggcaagggataggcagggtcttcctacagtatatttttccattaagaggcaacagagagcagtggaaggagcacagtttttttttgtttgtttgtttgtattttgagatggagtctcagtctgtcgcccaggctggagtgcagtggcacaatctcagctcactggaacctctgcctcctgagtccaagcaattctcttgcctcagcctcctgagtagctgggattagaggcgcccaccaccacacctggctaatttttgtgttgatgaggtttcaccatgttggccagacgtctcgaacttctgacctcaagtgatccgcccacctcggtctcccaaagtgctacgattacagccgtgagccaccatacccggtcctggagcacagtattcgatatgaaacacattacccagttaacatgtaaggccagagcagtatagagtgtaaataataattcacatttcatgggctctatgtggtatctatatgcatcatctcagtggattcttgcacatctttttgaggtaggtactattattaaacctattttgggtttatacaaattaatgacttaaccaaattcacacagccagtaaatagtagagtccacatttgaacccatagccatttgcacccagtgaactttttttttttttttctttttgaggcaaggtcttgctctgttgcctaggctggagtgcagtggcacgatcacggctcactgcagtctctacctcctaggctcaagagatcttccctaccagcctggccaacatggcgaaaccccatctctattaaaaatacaaaaataagccgggcgtggtggcatgtgcctgtaatcccagctactcaggaggctgagacaggagaagagcttgaacctgggaggtggaagttgcagggagccgagatgacaccattgcactccagcatgggcaacagagtgagattccatgttaaaaaaaaaaaaaggccggacgcattggctcgcgcctgtaaccccagcactttggaaggccaaggcgggcggatcacgaggtcaagagatcaagaccatcctggccaacatggtgaaaccctgtctctactgaaaatacaaaaattagctgggcatggtggcgcatgcctgtagtcccagctgctccggaggctgaggcaggagaatcgcttgaactcaggaggtggaggttgcagtgagctgagatcttgccactgaagtccagcctggcaacagagcgagactccatctcaaaaaagatcttcccacctcaacctcccaagtagttgggactacaggcgcccaccactatggctggctgattttttgtatttttagtagagacggggtttcaccgtgttagccagggtggtctcgatctcctgacctcgtgatcggcccgcctcggcctcccaaagtgctgggattacaggcttgagccactgggcccggcccacgcctggctaatttttaaaaatatttttgtagagatgaggtcttgctatattgcccaggctggtcttgaactcctgggctcaagctatccacatgagccaccatgcccagcccccattaaacttttttttttgagatggagtctcactctgtcacccaggctgaagtacagtggtgcaatctcagctcactacagcctctccctcctggggtcaatggattctcctgcctcagcctcctgagtagctaggattacaggcgcacgtcaccacacccagctaatttttgtatttttagtagagacagggtctcgaactcctgacctcaagtgatccacccgccttggcctcccaaattgttgggattacaggcgtgatccaccacgcctggcccccgagttttttttttttttttgagacggagtctctctctgtcgcccaggctgragtgcagtgttgccatctcggctcactgcaagctctcctcttgagtaaactcttaatggctacactattttcctggctaaaacactgcagctggaatcagaagtctgaaagttgaggcccagccctgccacttgtagctacttggcattggccaagcgaagccatgtctccaaggctgtatttcccccaaccttctttcaaatagtgacttccaggattgtgaaggccaaattaaatgtgaaaatataatgaagtaactctaaaattaatagttactagttatcaaagtagcatcctggcctccagcatgtcttcccctgactttccccaccccttggaaccctgctgaattttttatttatttatttatcctttgagacggagtctcattstcttgcccaggctggagtgcagtggcacgatctcrgctcactgcaacctccgcctcctgggttcaagcgactctcctgcctcagcctcccaagtagctaggattacaggtgcacactgccatgcctggctaattttttgtatttataatagacacagggtttcaccatcttggccagaccggtcttgaactcctgacctcaagtgatgcctgccacagcctcccaaagtgctgggattacaggtgtgagccactgaacctggactttagcacctttttatgtgcttattggccatttgtgtatcttctttagagaaaagtttatacaagtcctttgtctgttcttaaattgtgttcttttttgttctgagagtttttcatatattctagatagaacgcacttatcagatgtatgacttgcaaacattttctcccattctgtagattgtcttttcactttctttctttttttttttttttgagacggagtcttgctccatcgcccaggctggagtgcagtggcacgatctcagctcactgcaagctctgcctcccgggttcacgccattctgctgcctcagcctcccgagtagctgggactacaggcgcccgccaccacrtccggctaatttttttgtatttttagtagagatggggtttcaccatgttagccaggatggtctcgatctcctgacctcatgatccgccygcctcggcctcccaaagtgctgggattacaggcgtgagccaccgcacctgacctttactgtaccttttctgtgttgaggtatgtttagatacatcagctgaaccattatgttagaattgcctacagctggctgagcatggtggctcacgtctataatcccaggacttttggaggctgaggcagaaggatcacatgagccctggagtttgagactggcctgggcatcatagtgagacccccatctctacaaaaagttaaaaaaaaattagtagccagatgtggtggcatgcacctgtggtcctagctacttgggaggctgaggtgggaggatcatttaagcccaggttgatgctgcagtgagctgtgatggcaccactgcactccagcctaggcaacagagcgagactctgcctctcaaaaaaaaaaaaaaattgcctacagcattcagtacagtaacatgctgtacaggtttgtagcctaggagcaataggctgtatgatatagtctgggtgtgttgtaggctatagtgtctaggtttgtgtaagtacactctgtgatgttcacacaatgaaatcacccaatgacgtatttctcagaatgtatccccatcgttaagtgatgcatgattgtattttgtttgtttcatcttccaggtgaacaactttgtgatctttgaaggcttctttgcccatcaacatcgtaagtttttgcattttgttggtcacgtagtcggggtgagggaaaggaaagagctggactcttggtcctgccgrcccctcactgaggggccccgccgcttccttcctcacagggccccctgctccctctctgagggcaactcgacactctcgtgctgctgcagtcgatcccacgcccgctggtaaagcctgtattgaaggggtggaactgtagtgcagtgatggctacttactctagatgccacggggtacagtgccatctgtgggcaattttggaaaattctaaagcaacccaagtctccagcagtcatgactgtttgcctttgccctcatgggagctcagtgcattttatatttggcaagacttttaactaagcaagctcattgggagcctgtttgacagctgatatcaatggaccctcttgccagttcaggtccgtcaacataggccagagtcaggctcctttgtaaaccccasgcttctgttagccagtgagggacaggctggtgcaaacagcccttccatttgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacacacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcatcacagtgtcaggcactgagaggcacctcaactcgctttggtttccaaggcttctcccatttagcttgttcagaaccacaggctgtgagagggactgagggccaacaaggatggtgaggtctcaggcctgcaggggagggtgctgtggataaagcttaagtgaatttgctgagaagtctttcatttgccacacatacatgatggagaatctcttgagagggaaagccgggagcaagtagagaagtgaggagggggaggctgaactttggacattacatcagcctcctgcttactctgatagctccctttcagatgcccatatttattttcttttttttttttaacctaataaaacttcagtctcttcccattttcgtataggaaggagagattgtgccctccttccaaacctcccctgacctctccagagcaattcctgattaaccaagggctttgtccatctcatccagaggaacccagggtcctcgttggcccggctgggaccattccactgccccagaataccagggggccrtgacagcacccactgacagtaagagctcactycccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagargtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatgtaagaggggcaagggtsgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaagaaaaaaaaaaaaaagaaagactcagatttctctttttttctaccaaaacctttgctgtcatgactctcttccktttttcttctttttctgtcttgctcttcattctccctgtccccagttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctccccygccccccgccatttcccatctcccttcctcccatccataacatccttccacagctcccttccccgctctgaggagagtcgatactaacagctaccctmtccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttrgttagatggctcatacatttatctagagaagcacactcttgcttgctgtcaaactttagamcaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggygttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacggggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagcta

SEQ ID NO: 12499 - DNA, 34263 bp, Homo sapiens
tggtggcaggcacttgtaatcccagctacttgggaggctggagcaggagaatcgcttgaacctgggaggcagaggtggcagtaagccgagatcgcaccactaccctccagcctcggtgacagagtgagacccagtctcaaaaaaaagaaaaagacacaaattgactagcccaacgttatattgctggacggtggcagactcaggacttgggccccagttttgccactttagcacaggttcgtcggggtttataggggggactctttgctgataggaagttttcaaatagcatgtaagagaacagtgtagaagtggaatatgtgaaggaacgtctggtgggaagatatgtgaagctggcaagtagggaggttgaagagaactcacttcacagaagaattcattgccacggagcccacagaaccaggaaatccaggacacctcctctgagctgctcatcttcacgtcagctagaaaaagaacagtgtcagtaaagctcaagttctccttccctgcctctggtatcctccctcctcccacattcggccctccaaccacgggagaattcggaaccaccctttcttaaagcaacccaaactctgaagcactcctctccagctcctctaatttacatctcagccccttttctttgaagttaaacattctttggggtcccaccacttgaaagaagccaacagatactttgacccaccagcccgacccacatccctggagctcccgaaggccagggccctctctcctctgtgtcaactccggcagggacctcgactcaggctccctaccaatacaagtctctgcatgacccccacgcctttcccaagggtttccaagtttatcattctcaagcaagaaccgggctcctccttttctcacgggttgggggcgattgtcaggtccctttcaccggaatccacacatcccccctccgctcctcaggccacctctccctccttcgtgccggacctggtcgcttcctcccccgcccccacatcaaagtccggagaccccatgtgccgctcccagcgacaagggactcggagcagcgacgacttcagactcaccggctggacggggaccaggactggggtggggtagggaagttgctacttccagggaacggcggcgaccgctacagcgcaggccgcggacccgaccgcggcaggcgaagtggggtggggggagtggaaattagggagggtggggaagagggcaacacgcaagcgccaagggtcaggtgccgcggtggatgccgggacacggagtccccggtagagaaagaaactggctaaatgagagaaagcgaactaccaatcccaggatgacccgcgcacgacctggctgtcacgaaggcccggaggagggcgcttgcgggcggggcacaacgagaagccaccggaagcggaagccaggtatggcgttcggggcccgggagtctgggcaatacagttttgtgctcactgggtgaagaggctgacttagggcggggaaaggagggagccaggctggatctctttccgcagctctcctcacgttcccctctagtcccggcgcggcgctgctgcccaggggactggcctatcctcggccaatccgctgggtccttattgcctgttgggcccctagtgcgaatcagtcccgccagagacccttgacgggcatactgtttcctccgggctcctgcctcatgaggggagaggtgcggcttggctccgtgcgtagggacttgggtggggtggggtgggcggtgtgagaactggaacgtcccagtgcgctaacctgaggtggtgccagccattctgctcgtccctttgcacttctccatttccccttaggctctaagtgtgaccttcgaaccctggtcagagtaatggtgaggggcaggcgtgacgttatttcattacacggcttctcggcattccacaggtttccctccgcctcctgagggcctttcctaacccacagagtggattcctggctccagaaaatgggcttggagcgggggccacgttgaggaaggcgaagggcattgtgggggcgttatgtaaaagtaggaccccaaccgacagatcctagtgctcgcgccacctgggcgcgcggagctttgctcgtttactattgaaaaagttccagcgcgggaaactgaacccggagctttgcgcacgcccgagccctcaagtaatgtgggttgtggtttttgttgttgttgtcgccacgcatgcgtcttcgtgccgtgtggctatttgattgtgtcaactcttctgattagaatggcgccattttgcggtacggaagctacacagcaacacgtataggagactctccccgagatcttctagggagtgacccatctatttttgtttgggaagaggaaactccgaaatgggatcgcggaagacttaaagggccaggctgatttttttttcctactggtatgtcttacggggtgggaaagtggtttcagaaagaggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttccttatcctcatgtgtaggttgacagggtagtatagtcaagtggttataaacatgagctccctggatttaaagcctgattccacttacttgggcaaacaacctaatgtctacatgttccagttttctcatcttagaaatgggggtagtaagaattgttgttaggattcaatgggttaatatatgtaaaatgctagaatagtgcatgccgcatagtatgcaatacatgaatgttagctatagtcattatgactaatgtccctccccttgcccaagagtttgctaggtctggttaccatttttttctttcaactattctgctctggatcccacaatggtttaaagaaatttgtttttaagacaagtcaagtgcagtagtgagaaggaggggaaaagtggagtaaggagtttgatctgtaactgagtgaacaattaattcagataactcaccaccacctttggaccagcctggatccctcactgttaagtaggaaggaaggcaatttgtcccttttttttttttttttttttttgagacaaagtctcactcatctcactctgtcgcccaggctggtgtgcaatggtgtgatttcagctcactgcaacctccgcttcctgggctcaagcatattttttgtagaaagcaggctttgccgggacatggtggcatgtgcctgtaatcccggctacttgggaggctgaggcaggagaatcgctaaggtggaagttgcagtgagccaggatcatggcactgcactccaacctgggcagcagagcaagactccatctcaaaaaaaaaaaaaaaaaaagcaggcgttgccattttgcccaggctggtctcaaactcctgagctcaaagccatctgcccgcctctgcctcccaaagtgttgggattacaggcgtgagccactatgcctagctggcaatttgttccttagcagaaaagctgaaaagatcctattctaccctgccagccccctctgaggcctcaactcttccccttttccttcccctgcccttaatgctttttcttctttctctgcaggtctcctactccctccctccagtactgcgagaactgtgacacccacttccaagattccaaccaccgcacatccactgctcacctgctgtcactgtcgcagggtcctcagcctcccaaccttccacttggggtgcccatctccagcccgggcttcaaactgctgctgagggggggctgggagccaggaatggggctgggaccccggggtgagggccgtgccaatcccatccccactgtcctcaagagggaccaggaaggactaggctacagatcagcaccccagccccgagtgacacatttcccagcttgggatacccgagctgtggctgggagggagagaccccctcgggtggccacactgagctggagggaggagagaaggagggaggagaaagacagggcttgggagcgggatctaaggacttacatgaacctcgagttctgactttggtaaagtctgaccctagtctgctgctgaagtctgaacttgggcctctgacctgggccctttgacttccccttcctgggatctgctcagatgcagatcctgaagtttttggtcaataggctctgtcttcgtgagagacgggctgagagtcagaaataaatcaaccatttgtggtttattcacttttctggaagctattttgaggaagccaaacagaagcctgggagccacatgcaagtcccacctgagtcagaaggggcagcctctccaggtggcatgataaggtcacctccctgccaatctgggttcactttcaggtcccagaccctcctgggagtcccccacctattctttcaacccccctggaccaagaattgcccagcttcgtgcaagtctcacttcccccaggaggagttccctgactacagccaattcactgatttcacaaacataagtccatatactatgtgccaagaatacaggtaaagacattcccaaccctcaaagagttcacagctggagagggaaagtgccatgttatcaatttttttcttttttttttgagatgcagtttcgctctcattgcccaggctggagtgcaatggcatgatctcggctcaccacaacctctgccccccgagttcaagggattctcctgcctcagcctccccagtagctgggattacaggcatgccccaccacgcccagctaattttgtatttttagtagagacggggtttctccatgttggccaagctggtcttgaactcccgacctcaggtgatccgccggcctcggcttcccaaagtgctggggttgcaggcatgagccaccactcccggcccatgttatcaaatattataatgcagggtgataagggaagtcaaggcctctagagatgagaatgggtagggttttgctggaagaggccagtgtgataggaaggcccacgattatcaagcttgtacacttagttgaactgggaccagaactctagcccccaaatctaaactttaaacttctttgttccacccatttgtctacacttttctttcccacacttccccactctcccaccacccacccccttgtcttgctcatgccgggtggtaggcacaagaagagctcactgttgtgaaatccaggaattcaaatttgcagacgggcaggggagggctgttcaagtcgcaagactcctcattttttcttttctgggaaagcctttcatgaagtcttggatgcgaaatggaggagtggtgggggatgtggaaaagaacccaggggcagggggctgtagggggcgaccgagtttagggaagcatgagaaacccgggaaaatggggagctgggtttatattaaggtcctggtccttgctaatctcggtttggcggtccggcgcgcacagacagcgcggggtatacgggggcggtctattcgcagggtccgccccatgagctgcggcaccgcccccgcgggtccttccagtcctggtgcagctgcttccgggcttcgcggctcccggcggctccccaaggccgcggccccgacgctgggcccgggagcggtccccgcgcacagcgcccggacgcgtaggtcccgaagtaggcccgcgctttgcttcgtaactggggatctctgaggacatcttagttctgaccttgtggaggccgcgtctctgctgcgtgttcgcgggccagtcgggccactttgtagaaatcatagccctctaaatcaagggacgaacgctgctggctggagtttgctggacactttcattccacctcctaacaaagagaattcctattccttgaggtcccttggggcagcagttaaagactacacgatccaggagcacctaggacctggggccaccttcctgcccgctttattggatggagcactgcctccccagtttctgggacaccttggggtgtggccttggtgagtgaaacttggggtgctgcctgctgggaaggaaatccggaaacgcagagaggactctctggtggtgacccaggccttgtcagatctgagattcttggaatctcagattgtgggggtgtggatggtgaatgaatttgggtatgcccccctttaccccagaactgaagaggaagcaaactacttgccacacttgaggctgcatgactattcagagaagggaggagccacttctgaattcagagtaggactgcatcaccaggcaaatacctgttctgagccagaaagactctggcttctgaggagatcctgagagtctgagtagtgccaggaagcagcctcagaatttgggggcccattacacaccccagccatgttcctgcgacggcttggtggctggctacctcgcccttggggccgccggaaaccaatgaggcctgacccgccttacccagaacccagacgggtggacagctcctcggagaattcaggaagtgactgggatagtgccccagaaaccatggaagatgtggggcatcccaagactaaggactcgggggcattgagggtttctagggctgcttccgaaccaagcaaggaggagccccaagttgagcagctagggagcaaaagaatggattccctcaagtgggaccagcctatctctagcactcaagagtctgggagactggaggctggaggggccagtcccaaactcagatgggatcatgtggattcaggtggcaccaggagaccaggggtgtcccctgaagggggactgagcgtccctgggccaggagccccattggagaaacctggtaggcgtgagaagctgttgggctggctgcggggggaaccaggagctccctcccggtacttggggggcccagaagagtgtctgcagatctccaccaacctgaccctgcatcttctggagctgctggcctctgccctgctggccctgtgctcacgaccactgcgggcagccttggacacactgggcctgcgtggaccgctgggcctctggctacatggcctactgtccttcctggctgccctgcatgggctccatgctgttctgagcctacttactgcccaccctttgcacttcgcctgcctctttggtctcctgcaggccttggtgctggctgtcagcctccgggagcccaatggggatgaggcggccactgactgggagagtgaggggttggagagggaaggtgaggagcagaggggagacccgggaaaggggctgtgaccgtggggtgggggcaaagggtgaagagagtgtgggctttaggagaaaagtgtgaggcatgacccaaattgtaagcatagggacctcagggatggggaagaaacccgagtacgagggtgcagggccccccttcatacacaggagagaacagaactatttagggtgtttgtgtttatggacagtgagggcactgctcttggattcaccagctgttatttttgcttttacttttctcccaccttcagttttttttttttttccacctccactttttaaaagcaaaaaaaaaaaaaagtatgatggtggtgaataaagaccaaagggtcctctctacctttgaaaactctcctggggtggaggagaccagggcaggatagacagacctctgcagtaagagagtggttgggaaacccagggtgttccttggatctcaggatctgagccatcgagggaagagtggggctgctaggcaagtggattagggggtctggatagggccccacaggtgacagggagcctgcagggcggatctggtgatcatgggagccagagggagtggggacagtgcaggcagtattggcaggagggccagtgcagaagggctggtagctcaggcagtgtgggggaagcactgaagcctgtagtccccacttgggggctaggggtttgctcactcagcaataaataactgtgtcacatcaaatcctaaatataccactacaaagtgagagttactgccactctgttcttactgacaccgtccagctgggagtttaggtggtagaggatccagggggaatgttgaaatgggaggagtgggaatgacgtctggagacaaaccccagaatgagatgaggattgaaaaattatctttattatcttgagtgggagctggagctggaagtctccagcttctccctccaacaactcagctcccattgtacccatctggggacttagatgaagttacaggtcagttattggacagctcacaggcctctgtgatggggggagggaaaaagaaggacagaagggaagtccagggagaaaagcaaagttgatagtaatggggtgggggagaacgtgttctttcattccctgtgtcaaaggggagtctctaaggctcttttccctccacgtatgaccctctgccccctttatccagtgcaaactcagaaacctctcttttgagtagcccagaacccatcctgcctccctcaggtgacatcacagctcttagccacatccctctggtgacatcacacgagcctctttcaccctgtaacaccagaagacttggtgagtcctaatcctgttttatgagattttaaccccttaccttgattcctaggagtcaataagaaggctttggagtccaggcaggaagtcagggacttgaattcctccacacacttttcgggaggatgtggtgagcgatctggaagggcaaggtggggtcaggccagtcaaaacccctggaagcacctagctcttcctgggagggtgtcataggacccagagtgaggagttctcctgccctcccttgtttccctccaacccttcctgccttgtatccctactcactgtagaggagaaagcgctggtaaccctggcctgtctcattcagcatgattccacctgggcatgagctggaaaagagctcagtcttcatgtcagggcggcctgtcaaggcaggtgggagaagtatgagaacagagatgcagaaccaaactcaagggagggtgagggctgggaagaaccaaccttcagttctgagatctgtgctcccttcagtcaggtggtagatccatttccggggcacacagagcccatctttcctgcagaggtggtggtggcaaggaggaaagaatgagcatcaccccaaccatagtgtcccagcttcttttttttttttttgagacagagtctcactctgttgcccaggctggagtgcagtggcgccatctcggctcactgcaagctctgcctcccgggttcacgccattctcctgcctcaacctcgtgagtagctgggactacaggtgcccaccaccatgcccagctagttttttatatttttagtagagacggggtttcactgtgttagccaggatggtctcgatctcctgacctcgtgatctgtccgcctcagcctcccaaagtgctgggattacaggcgtgagccaccacgtctggcctgtcccggcttctatttactccattgtatttgttattgaagcccagctctccttgggtttcaagctaccaagcattggttaggcacatctttctccagagggcaattaatacagccactgaattccgtgggccaagcatagtagatataccagctaagaggccagctcttggtgggtggattctcacactttgggcagagactgaacccagtgatgcttctgcctccttaccactcacatgcggatggtagcacgaaggtggagctgcatcggggcagagccagcagccatattgaagacaatgttgtccacagggtcaaaagttgccaactcctccttggtgggagctgcccctgcgataaagtaccactggcccaagtggacctctgggaactggagagacaatgaagggagcaaaagagggtgggttccagcacaggatgggttcaacctcttcatcagtcaaaacagcaagatttaggggtagaggtgttggctgccttcctctttccaactggggattggatccatgacaaagagtcattaaatgacttttcctctttgcccctccccagtcaacctgggtaaccaccccaccccccaattctgccatgcctctgcattgatggccacagtactgatatttttcttcttgctttcattatcacaacactcacacccccttcctctcttcctttcccaagatggtctccagtcatcctaggccatccacccaagtccctcagagcctccaccataggcttcccccaatctcagtccatacctccttcccatccacgcccagagttgtcagttgactgtgctcagggcactggtagatggagttaaggataataccatagaagtagagcagagctgcccaaatttggtggaacatcttcaggcaggagggagctggtgctctgtgtgccttaactgctctctcccctactggctgctcagtccactctgctttcagctcccttgcgttcgacccttgaccctttcacctgctaatgagtaacttcaaccttgttttccaacccaaacctggattacttagtgtttgggacttcctccccctcttccggatgcaaccactccatagtacaccctggcatgtccagggtttctcaggagttatgaggagagctgagctgtccagggagaagcctgtggtctttgaacctgtatctgagctggttatttgttgcactgtgcagcactgaagggaagtagcttgactgggcctctcattcattcacttagcaaactgttttgaatcccaagtcccagttgtttcccaagaactagctaatccccggggacataaaaaaacgaataagacatagcccctgatcttgaagaagtcgttagagggaaaactagctgtgtagacaaaccattgcaatacaacttggtaaatgctttagaacaggtatgatgcaggtgctggggcacggtggattgctctctttagtttacaattagaaaaatatgtataccctggcagtgttcactgacacattcactcaacatttattactacaaagaggctatgtaatctggctgttagagaggatagatgttggtgtcaggcagaatgtgtccaaaccctaactacaggcagggcaggtagctcatgcctgtaatctcagcactttgagaggccaaggtgggcggatggcttgagcccaggagttcaaaaccagcctgggctacatggcaaaactctgtctctacaaaaaatacaaaaattagccgatgtggtggcacacgcctgtagtcccagctactagggaggctgaggagggaggattgcttgagcctgggatgtcgaggctgcaatgagccctgattgtgccactgcactccagcttgggcgacagagactctgtctccaaacaaacaaaacaccaccaacccctaactgctatgtctgttttttcatctgtaaaattggcaaatcatcaatcttataggattaaatgaaataatgcacataaagcccttagcaaagacttgcacatggtaagtccaaagtatatatttgctataattaatagtaatgtttgcaaagcacttagtttctggtgggtaataagttctcaaataataggcagtaagaattgccaaataggttgtccttggatagcaccaagtgactggagcagttaatgctgtgagagatggatcttcctcgatagattatttatttacttatttatttttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccgagggctgaggcttgcgatttagttaaaaaacaaacaaaatttgggtgaccagtatattagagtttattaatactgttctattttggtgtaatgtttgaatttttttttttttttttttgagatgggagtctcgttctgttgcccaagctggagtgcagtggcgcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctcccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagcctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggcggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgkgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttmtttttattgatccctttgttygtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgttyttaaagggtagaaatcagaacccataatggagataggtccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatycacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcmtggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggatcatctgagatcgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaarttctcccttgctctctatccagcagggcgcyggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagcttttttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctrggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagkggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatrgggacttggccagcstttctccaacctgcttrctttttctctttagctccggtctgatatacaaaaacgactrcaggaagaccccaactacagtccccagcgcttccccaatgsccagcgggcctttgctgatgatccttagctctttgctctatggcccttcctcatcaggggaccgtttcccccctcttccttcacagtatttaagaaataaaagtcggatttttctggctgctttctctctacattgtctccattaggtagtgtgtcccttaatcttgtgtgaacttttttaaattaatacttccttggaacactgttgtgttctactcagcacgctaaattgtacaagccagttttgatgtttgtttttttttttttttgagacagagtattgctgtctcccaggctggagtgcagtggcccgatctcgagctcggctcactacaacctccacctcccgggttcaagtgattctcactcatgcctcagcctcctgagtagctgggactacaggcgtccgccaccacgcccggctaatttttgtatttttagtagagacagggtttcaccatattggccaggctggtctcgaactcctgaccttgtgatccacccgccttggcctcccaaagtgctggaattacaggcgtgggccaccgcgcccagcctgatgtttgtattttttgtgcgaaagcactttatatataaataaaaaacctgtattttgagttgggagcatattccaggtgcacactagcatagagctctcaaattacccatcaaaaaaagtttctgagcagctgcagacctaagtatagtctttagcataactagcatgcagcgttaccatgtgaaatcccacttagtttgacaatgctggaattggtctatccaattcaaagagccccttaagtgtgctccaacattgaggccttaacagagatttccccttagttcatcataaagaactgaagtcccatggctgcaaattctttgctagtccctttgagatgcagttgaagtcccttctaaacccccccatcccctaccttggctagtttagtgctctatcaactaagcatggcataagcttagaaaattccagctagacctcttggaacatgagctcacggacatttaacaggcctgctggagagtccatgtgaagacactggttgataacccagtaatgttacagatgtcccaccaaggccctagatatgcaaaggaagccatattgggaccagcccaggtgtcagctgcagactgataaccagttgacctcgctcactggcacaaaaaagcagatttatccagctgagctcagcccaaattccagactcacaaaaatttaaagatccaatacgatggtcatgtttttagtttcaacagctcactggaataagtaatgaatatttccctgactgaaactacagatcactcagcaccatgctttaagacaatgcaaacaactcatcccccaaatcattgtagaagtttttttttttaaatccttttattactcttttttaacaaacagccccagggacaggggaccaggggaagggggaggaggggaagtgaggccccagccccacaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcggccctgtccgctcccaaggcttaggtatccagcgcagggcatctggtggggaggcctaggggacaggcatgtgttaaagagtgagtcacagtgagaggtcagcgatgagacggaaggacaggaaatcaggtggcaactcgaatttagagttggggccacaagggtttctccttcacctgctggtaaaggtcgacgcgctgggtgcggaagactccactgtaggtggaaggcgtggccttgagacgggaattgaggccagagaaggacctaagggaagaagggcgtctaaggcaagcctaggatccagaccctggttccaaagtaaggaagcacttggaaagtccacatccctattccgtttcaccttccagttgggggagtccgtgatgatccaggtcccccaaggttgctgctcagtttttgataatcctggaacggctttagttccactggatgcagctgaggggaaaaaaatcatgagctgcctaccttgaaatacagaatccctactcccaagtcttggcgctccctagcccctcagttcctgtaccttacctctgctcgccccaagctagcggggaagggcctggcaggtgaaggcagcacccgagtagcaggagcaggtgggggccgcacagccaggctggggggctgcagagcagggcccacaggtaacagagaaaggggaggtggggcaggaggtggtgctggcggcagggagccaaagttcaccacaggcagctgtgagtctaccatgggtagaagcatctgtaacaagaaatttgggtgtgcatgttgggggcagggaggaatgtcagaaaaccagggaaaatcaaagccagcaactggacagagaaatcaaatgaaggggaagtgtgaagatacaatatacctgctgggcaggagcccctgaagggagaaagccactttggccaccaggctgcagaggagtagaataaaaatccgaaggggatggcagatcctggcgtacctgtcgggaaacagggagaaatatatcaacccccacaaaatcattctccctaccctatcccccaatatctaatacctgcccccctcttacctgaagcaacgatgtgtcaggcaaaggactggggcagaaagccggagagtagaggaaggaaggtggagggtagagaactcctccagccggcaacttccccagctctgtagcttgcattgtggagaaatccagaaactggcccttgagagctaccccagagagcagtgctgagggaggggctgggccggggggtaggtataggggctgtgatctgaaaataaattgtggggagaaaagctgttaggaagccagagtcctagcaatgccttaagtccactagcttctagtaccctagaactgtgtcttccccttccctctccccgaaacacatctccaagtacttctgtgatccacaggcatcgagtcttacctgtaagggtgcagtgagggtgtcccagggcggaagcctccactgtttggatgtaattgagagtccatggctcccccagagatctgcaggagaggagcacggttgaaacagctttagtatctgtggtcaagaaaaaagatcaccatcccacccatagaagcaaaaagtagggagaaaaatgatgtgacaaagtggtatctcacaactctgcaacgtagaaaggcttgattataaatacataccaggcagaaaaaaattattattcactgaaggggtcatgcaatgggaagcggggcctacctgagaactggaaggcccagcactgccatagaaaacctcaggatacaggcgctggcctgaggagctgggctccgggacacagtgcccagaatccaggttcttggattgtggctcagcagaggcagcagcactgggaagcagctcccagtctcgtgatacaggaatggcctgggaaggagaggcctcgtggagagggatgtctggcatcctggacgccctggtcactcccagcaatcttccccagaaatcttgggcctttccaccaaactcttactcccacttacctcagtgactgatgctgttagctccttctctgctttcaagctgtctcctaccactaggcgtaagtctgagtcctgtgatcacaagaaggcaggagacattgtcccgtgacagacatgtgtcctctatgtcccacctttagtccttcccttctctccacccaactcaggatacccagatccagcccacacagaccttgtcactagtgccaaactggactgggggaccaggtcgatgggatggccgaatggggccaggctctgtgcctcggtctgtacgctgtgatcgttctgtgccaatggggccagggggcagaggctgctcccggggcagctcctggattgggcacacagtaaagtgcattgggggagggaaagggaaatccaaattggaatgcccagaacacacacgcagagagaaaaagcagaaaaaggtagggccaaagtcagattcctggaaacattccccttatccttttttggtcttttacctttctgtccccatcgtggggggcaggtggtggtctcctaggaggttcagagccaggtggaccctcacaaggaacagcattcaggggtgaggagcctccaggcctcttggggggtccctctgctgcccccttgagtcctccatcaggggaacttcgctggctgcagggacctgatgacacctgagaatccccactcaggtccaccccactgtcagactgactcatctgagaggagtggagaaggagctagttaagtcagggtagaaagcaccccaatacctgactgatgcacacatacaaactgcagaaaggggacagccaagtgagagaacagctccagactcaacccagagcaggtggggggtatgaccagtgctcaaaaaagtcccagctcagacacaccctcccaccctcactcacttctgtgccagccacatcctcaaaaggactcaggggctccatccaaggctccatggagctgggccggtaactctttcggctagtggctggagaagggagcaccaaccagaagagaagtgaggagatgacagttcagaagcccctctcattcttaacccttctaccatagtcctttcactcagctttactcaccagtatgtaaacggttccagatgtgaggggtcagggcctctgtgcctgtatctctggactctgcctgagggcctgggccctcaggcttagagcccaagaatccagagctatgaggaggtggcaaagattcctacagatgagaagggccagaagcaaaacatgaattgggtgggaattgggaattataggaagccaggacagagtggggtgacacagggtgtggggacaacaagggagacacatgggagactaatactgagaattctggagtaaaaacacagtgaaagaaacaggaaagaaaacagagaaaacataacccagaagaattttcacgagtaagagtgcagtgaagcacaatctcaaacccatcccttacctcctgtagcagctctggttttctgggaggccgctcccgacgtttagggggaaagggactaaccccggcagagtcccgaggagtcccacccacccctctcaccattggccccggctcctcaaagtgggggtctgggaaagagaaaaagggtcagcatctgcctggctctgccactgaccctaacttttcctctctactccacctcccaattcttctacccttgctccctgcagaaacgcacccagcagcagggcccctaggccaggttctccacccgctccctccagcacttgaccttctctggggatggagatattcccacccataacccctccagcttaccagaactgaggccgctgttgaccctctggggctcgtatcgggttgggggcctaggagaggggccctgaggggcttggggaggcccaggcttgtgccttggatgaccccctggtgcagttacactcccttgacggctactaagctgggccagagcctgttggatgccagcagggttgctgtggataacttggtccaggcggaagacagcagaactgctgggaggtgggggaggcaggggaagccccgggggacgctcctctggaggacgactggagaaaacagagcattagctccagtatccactaaatcgttactttttcccacaagttatgtttcccaacttctgcttacaacctattctcttccctattaaagtccaggtgtttttgagtccttctaagggttcctatgcatacagatgcacagactggaaagcaaagaaccagcaatgaatacataggtgggtgttcttgactctaacaccctaccaaccgctttccagttgccttagccagacatggaaatcctactgacattctagagcccatggcccctcaggccacaatctccactccacccaaacttatctttccctcaggctttttccccctcctccaattttta

SEQ ID NO: 12500 - DNA, 14361 bp, Homo sapiens
gaacaccccccgcccaaactccaactcatccttcacctggttattcactgagccttcgggtctcagttcactcaggaaacgtttccttaatccccaccttttccccgccactagtaccccctgatataaattcacacattctgtgtaattttccgtagtagcactcgtcaggttataattacattcgtgagaatcaggcaggagcagagactgtcttgtgctcttgtggatcatcataacagcaaacatttacatcatgtttactgtttttcagcctctagtctgagtgctttatatataactcatctaattcccaactcaaggacccagatattattaacatccccattttacaaaagatgaaacggaggttaagtaatttgctctaggctacacagcttgtatctggtatttagtcaatggacgatgattacttattgaagtaatcattgagagaaaataagagttgtcagagagaaacctataaagaaaaggagttaagagacacagtagcatttcagactgtgtgactttcgatgagagacacctcttcacatctctctttgtgaagggagatacaaagtcatttccctctactaaaaatagaaaaattacccaggtgtggtggcaggcacctgtaagcccagctactcaggagactgaggtaggagaatcgttttaacctggcacacggaggttgcagtgagcctagactgcaccactgcgctccatcctaggtgacatagtgagactccatctcaaaataataataataataataataatgatagcagagtattccagccttagctcctacaaggtagcccctctacctgccaatgtgtgtaccaatgtgtccagaattggttccttcccctgggttcttggtctcgctgacttcaggagtgaaaccgcagaccttcgcagtgttacagctcataaaggtagtgcggacccaaagagcgagctgcagcaagatttattgtgaagagcaaaagcacaaatctcccacagcgtggaaggggacccaaatgagttgccgctgcaggctcggtggctagcttttattcccttatttggccccacccacattctgctgattggtccattttacagagcactgattggttcattttacagagcgctgattggtccattttacagagtgcttattggtctggttttacagagtgctgattggtctggttttatagagtgctgattggtgcgtttacaaacctttagctagacacagagcactgattggtgtgtttacaatcttttagctggacggaaaagttctccaagtgcccacctgacccagaagcccagccagcttcatctctcactaagatgatgtcagagacccagaggcttgaaaaacctgccttactccatcgtagggagccacacgtactacccacatgagccttcagtaggctccggccctaaataggcacatgcgtatttccccagctccttactgggatcctcccgctaagccacgcccgatgcccttgtctacagccatgagctgcagtaagatgcccaggcccggtgccagcgtgcgcagcacgtgtgccagcaccgtggaatccttgccgcccgaggtgcccagggccaccactgcgcctggcggcagcaggtagcccacaagcaccgtgtgctgcacctccgcctcgaaggcggtgcagaagcaggaaccgcacagcacttggcccgagcatggacggcggagggaggcgcatgccacgtggcaggaggcacatgacggggcgggcattgcaagaagggacagcttctcctagaccgggagaggaggcgggttacacatgtttcattgcctttgaggagttccctagatagtgcccctgcctggaatagaccaggggcagctgtggctgctgctcttatatacgtgggttataaatgggttctggtgtaagaaggccactgcctccaggaaggcttcctggactgcacccattatgcaccaagaagagaaggaacttaagctgatttcagggggaaaaagagggagcaacaagcaggttatacccagaattagatcgtgtcctgtccaaaggggtgagggcgtctattaaggaccagttgtaacaacttccaggaggccacccatgttacagccctgatcagaaggtagatattactgactattcagagaggttgggaggggaggggtcagagactcttaaggacagagggaggtcatgctctgttcaagggaagggggctatacagaaaagaccaattggatttcactttcaggggtcggggtgggcattctgtctccaggaatgggtcctgattgtgtcttacaaggacatacacaggcaggctagatcaacctctagggagactagcaggggttgcacctatttttgaggtgagggtgtgtaggcctccagttctgaacttaaccccgctctggtatcagaatccacctaagcttctgtggcccccgaaagacacagagaggttgggaggggaggggtcagtgatggggttggctcatccttggcccccaactgttctctttcctacctcatccctccccacccagccaagactctaactgtcccatcgaacctccttcgtcccacttgtctggtgaacccataaaaactccccaggcttagtccccctcctcaagccaccaccacctccagcctgcactactgccgtcacatccttgccattcagagcaggtcacgctgcttctaggatttaccacaatgtgtggaattatttcatatgactgtgtatttaccgtctctaacttacatgcaagtaaagaccagtgccactcagatgtctaataagcatctcaaaacccaaattcctgattcctctaacctaacgggcttctcctggagtacagggcagctccatcccttccagctgctcaggccagaagctttggggtccaggaccctggactgctctttctatcactacagttgtcactctcccagtgggtggagccaaattgcaatgctaagcccggaccctttcaaactccaggtgctcaaatgaaaagtcacacatattgtttgactatagcttcaaaacagccaaacacttctgaccatctccatggcagcaccctagtcaggtctgcctctctcctagatggctgcagggggctcctcacaggtctccatgctccctgccttgcctcctccacacacactccttcatataacagccagtgggatcctgccctggatctcgtctcactttagtaactactggctgggcacagtggctcacgcctgtaatcccaggactttgggaagccgaagcgggtggatcacaaggtcaggagttcaagaccagtctggccaagatggtgaaaccctgtctctactaaaaatacaaaaaaattagctgggcatggtggtgggcacctgtaatcccagctacttgggaggctgaggcagagaattgcttgaacctgggaggcggaggttgcagtgagccgagatcgtgccattgcactccagcctgggtgacagagcgagactctgtctcaaaaaaacaaaaaacaaaatgtaactgctaatggccgacgaggccctacaggctctggctccttgtttctctgtcctcatctccttccactctccttcttgcttactggtgtctactcttgagtacccccaggaacactcttgtctctagttgttttcactggctcttctctttgcccaaagcactcttccctgtcactgagccatcaagcagccctcaggactcaactgcggtgatgtcaggtacatctgtcacagcggagcaaagtcccctttgaaatactttctcccacagcttttgatttagtcctccctctttgttcttgttttttgcctcctgcttaatatcttctggggaggcctcttcacagtcctcagatcctgcccatcacccctcttctcattctgtttgtgggtgactctgaatcgcaatgtccaccagcctggccctccaaataccccacggaagatcccatctaggcctctcatatctcagtgcccaactgaccagctctcacaccccaaggcagaaacttacctaaccaagctccccgtctcccggaagcaacaccatctttcacccagcttctctatggaagacaactcagctttttcaacctctgaatctgcagtcacctagtactggggttcacttcctgaggtccttatcagatccagttgcatccctgttttagttacctactcacctcagccagatgaacttcccattggtttttcaaccccctgcatctttggccaggctgatctcattgcccagggcacttccctaaacactgtggtagacctaactcttaccttcaagtctcagctcaaactttcattcattcatttaacaaatacccactgagtgccgcctatgtacccagcatgctctaggtactgggacacagcagtgagcaagataggaaaggttgcagctgtcagggcactgatgttctaatggaggaaccaggccatggataaggaagtaaatgactaagatgctttccaaatacgagggaattatctttggtggtatgactgggggggaacagggagggggttctttagggtggctggaggcctttgagctgaggccaacaaaatgagtagacagatattgggtcagggtgggaagaatgctccaaattgagttaatagcaaatgcaaaggacatgaagggcagggcctggctgtgttcagcccattggaaagtgtgttgtgactgaggacgaccagaaaggaccagaagcttagaggttggcaggataaggagcttggattttattctgagatgggaaccactggatgattttaagctggggggcagggtagtgactggtgacaggatctgatttatatttccacaggcttcctggcactgtgcctgaatagagggtggagtgtggcaagggaagaaacagaacagtgaggaggcccctgcagtgatgcaggtgaggagtaacggtagctcggagcagaatggagacagtggaagtggagagaagtggttagattctgggcctcttctggagatagagacgatgagactcacacaaggtttggttgcgggagggaagcggatgagagaaacagaacactggcgaccattccaagattttggcttgagcacttggatggacagttagtggggaggaggcagaaagattgtgagaggagcaggtttaggacagggaatctgggatttcgtttggatgtggtagatttgaggtcctttgctctgtaaggtctttcctgaaccctgggctgggtctagcacctcctctgtgttcccacagcctcctgagcaccccctgggccagccctgaccactctgtgttgtaaccaggacagaggagggtgcactcgcactgcacccaggttgaagggcgagagtgagaaggtgtcaggctgggccgcagaatccaaagcgggtcagcaggtacaacagctgcttagagcactcccacccggagagagggattgagagatcacggaaaagggtgccatctttccagggacgcctaccagaacgcgggggagagaaatacagagaccctcaactccgccacgtcatcgcgacaaagggccaggaccggccggccgcgggatgggcgctcacctgggcagaactggagctggaagggccaacctccaaagaaacgaggagcgggcggaaggactacgactcccggaaggctttgggcccatccgcctacgactcccaggtgcccctgcgttgcgtcgtcccgaaacacttgcggctctcggacaaactgggcctacagttcccagagatcctcgcggcagcgctgcgcattctgcgcacgcctcccagagtgtactaggccggtccggcccgcttcccgtctgcgcctgcgcaagcacaatagccgtgccagaattctctgccagctgctgtgcactgctgtcagtgcaaagatgggatggacttttttttcagattttctgctgttgtgggagtatggcaagagtttgagggggcggagaaagagattgggaatgtgaaaagggaagatagcacctgcgctaagcacatkcctaggattgggccgcgtctcggggatgcagagtgggctcttcggcgcgccctgcagccrtgggagtggacgcctgcccaggccgaagggcaaggacttgcggggtggggtctctgtgcatgcgcggagctgaaagggagcgttttgcagatctccacgcgtgcgcaactctcgggacgtggacgcggtgaacagttacgcacaatcgtctttctgacacaaacacaccctgccaggtggaagccaggatggagggcaggtgagacccgtaaggcaagatcccraaaccaaggaacggagcactctccccgcttgctccccagatccaagccctccacttccttccaatgccccccttcccgaaactgctccctcctgtatattctgagatcttatcactattcccgtgaggcccttgataaggaggattcagagtgaagggtgatgggagacacgccttgggcgtcttctgtccacctcaaggattgaactttggtaactggaactcattcatttgttaatctgtgtgctaggccctttgacccgctggccagatgcaccgggacacaggtgtattcagcctggtccagagataaggatgataaatcttaatgtaaaggtatcagatgttaagggctgcaggagcccagaggttacaagtgctgcaagccagaacatggggaaacaacagcaattaagccgttagcttgtgccttggaggggtgtttgccctgcaccccactcactacctgaagataaatggcttctccaacgtgtagtggggttgggatgatgaggatgacatcactgccaggtgggaggcaggagctgcaggtcctgacatgatgaggcaggtatgggccgccctgggctgagggggacatgggctaccctggactggagggctgggctgtggcatggggaccctgtcagagacaggtgtttggcctccatgccttcctgtgtctctggaagggtgaaactaagcgggatgctcctctcccagccccacctgcttttcagaggctaccatatgctggagggggaagatcctggccacaagcagaggccctggaggtgaatcagtgttggaagtggggtggttggttctgggtcctccctgaggctcacatggctgcccctccccatcctccaggcctcgccttctgtcccggatccgccaatcctccsatccctggatcctctgatgatggcatcaactgtctgggctacaggttgctctccaaagagtggctgcccctctacaccaacctcactgtggacataacttccaagcctcaggagacccagtgcaaagctgaggggtatcttatctggaagccagaaagagcccctgaggccaaggtcacagggaagccctcccactcaccccacctggtttcttttwaaagtagagtttattttatctcctttctgccatccctaattccttccttccatctgtccatccatcttctttcccctccctcccttcctcccttctccttctcctcctccccacacctgcttcttttctctttctttcaactatgtccagaaggtccttcttaacaaacactaattagtacagggaaaggtctctttaagtgaatgcatttaaaatagggagtccacctttgtggtaaatagtgtgcacgaggtgagtctggatcaggacttcacacttgataacggaattcaatttctcaaaatacctttatttcagatttaatgaaattccatgtttgttgaatcattaagaacgagcatttgtgttgtactcatggtggacagccaccattctaatgcttgactttacataattaacgcatgtaatctgcaaaggagccacaaggcgagatctattattattcccattgtgctgctggagaaattaaggcagagaggttaagttgcttgccaccaaactagcgaggggcagagctgggatgtgtagcatccaggtaggttggctccagagcccatgagcctaactactactgtgcccaacctttgtgccaatccccacaacagtcaaaggatggatcaagtactggttttgggggtgggggcaggggactctgggcagtatgttttctgatcacatcacatgacagtaggacattcttcatttcaccatggctttcactgcccaacaataaaaaggtcatgggcactttgggaggccgaggggggcggatcacgaggtcaggagatcgagaccatcctggctaacatggtgaaaccccgtctctactaaaaatacaaaaaattagccaggcatggtggtgggcgcctgtagtcccagctactcgggaggctgaggcaggagaatggcgtgaacccgggaggcagagcttgcagtgagctgagatcgtgccactgcactccagagcctgggcgacagagcgagactccatctcacaaaaaaaaaaaaaaaaaaggtcatgaggaggtaaagtagtacaatggttgagagttaaaacactggcatcagatagcttggttcaaatccaggcttttcttgttcctagattttcggtcttgagtttacgtcaaattctctaagcctgtttcctcatctctaaaatggggtttatgaggttagattatttcctacaatggctgtgaggaataaacgagttagttcatacaagctgcctagaatagtagcttctccctctggaaactcaaaactcttgacctctcatctcatgatgaggccattggactaacatttattcatctcttagttctctgagccaacagatcttttcacagatctgtgagcatgccctcatgtgactgaaaactttagatagctccctgggacccatcaattccaaagctaatcacccaaccaaactccagattcctccgtctattatcccacaggcattgagtacagactggcttgtcccagcgcttggtactgagaggaaagaaaaaatagtatgagacagaggctgggagggaggtgagcactctagacagagggggttgcgaggtagggaggaaactaagttgttaaagccaacaggccccggaagtggcacgaggtcagaggtgtgggatggccagggaacgagcagctttctggaagtggggaggaagggcttgccctgagggggacagttagggaggcccacgtgaggagtgaacatgtggctggagatgaggacccagagtgatccccccaggtgatgcttaggaacagggaaagcccagatctgagaagggaggcacatcctgaggggtctttggaaccagtgtgtctacactgtgggctcaagtttttaacacacttgtcctagggccctgccaccttcctccctgaaactggtcagggtgccactcccaggacccaggtgcacactatttccacccctcaccaccatggagaggcctctgcagcctttccaccccacaccagtcatctacggccggccagcccttgtacctggactccccaggtgagactcttccacctttctcaggaggtgggacatggtcactgatactacgcccctggacagggagaggccagtgagacacagaacagatttgctctccagggcccagcacaggctcctgcatgtgcagtcaccttgttttagacacagcctgaggtctgtgctggttcctgaccagctgtgtgggcccctatcaaccttgaaggggtatggagactaaagccatgggtgcccatctctaacacccttctggaaaagacttccagctgacagaaatctcccaccacagtcccacacccagcacaagggaaccaggcaggctcagggatacgaggcccgctaaaattcatcagcacttggtctgtccatgcagttccaagggtttaacacacacacacttctcacaccaaatgcatgggggtagggtactatcatcatctcccttttgtagatgagaaaaccagaatagatgagaccaaataacttgctcagcagatgcagagggtagagagtggagccaggaatcaaatgcaggaacctggctcctgggcctgtgcacttaaaagattatgctggtctgcttctcggaagtattgataacagttccctctccgttttttagcaaaaaatgtgtgtggggaggaaataagtaatcaaaactgtgggaatggctaaataaattatggcaggtcaacctcatagaatacacgtgtgtacaatccatcatggattgtagaatgaaaaaaataccatccacacacgtaagagatctgagttttataaatcaatgaaagagtacttacacaggtatatgatgatgaacatagtaatatgtgtgtatgtgtgtgtgtttgtgtgtgtatcatgtgctggcaaacattttctgtaaagagccagagagtagatattttcagtttccagcttgggggctatttgatctccgccaaaactactcaattctgccagtgcagcacaaaagaagcccagacaatacatgtccaaatgaacatggctgtgttccaataaaactttattttaaaaaaacagttgggaggccatatttggccaatggccacagtttgttgactcctggtgtaaaaatatgaacgagactaatggttggcactaattatggagaggctcactatagatggtggagatggaaagggggggcaagctgagctaatcctaaaagaagagaaaatctgtaatataaagatcagtaaacattatagaatctcatttatgcatttaccaaaaatgcacattcatgtgtatgtataataaaggagttaatcattgttgatacaacctcattatataaatattcaatagggaataatttttataaaaacaattagattagattctcttaaaaaataactcatctgcttacatctcctgctatgcagtgaattctgcagcaaaccccactgcactgagggcatacatacatacatacatacgcatacatacacatatgctgaccagaccatatacatatgtctgcatatgcatatatatacatacatagatacagaaatatacgtacatacaggttgggtattcctaatctgaaaacccaaaatctgaaactttttgaactctaacatgacgctcaaaggaaatgctaattggagcatttaatcttggattttcagattagggatgctcaaccaataaatataatgcaaatattccaaaatctgtaagtatctgaaatccaaaatgcttctgatcccaggcattttggagaagggatactcaacctgtatataataatatgcttatatattatatatatgcttatatacataaggcgcacacacacacataaaatattgtcctatcatgactgtgttggcactttaaaaatattgatatcccacaataaacagggttatcattgatataatttcccacatattttactataaataatcgagtaacaacctgtcttgtaccattctttacagaaaggcttttctcaatgcgttagtcagggtttcttcccggggagaaaatttataatccttaatgaggccagtactcagaaggacatttctgcttactcttttctctgtaattgccctcactaaaataaagcatgacttttttatcatgtgttcacacatgcagtgcatccctagagtttttctgaagcatgaattcaataacatataattagacctgattctgagaagattttctcttcttcaagaaactcggagtatatttcatttatgaatatgctgatgcactaggaattcattgcttggtaaagcctttcacagaataactgcatttgtaagatttgtctctggtatgagttgtttggtgtttattgaagtttgacctgttgttgaaggcctttccacattcagaacacacataaggtctttctcccgtgtgaattcgctgatgcaccttgagttgtggtttcttactgaacgatttcccacagtcaaggcattcatagggtttctctcccatgtgagttctttgatgggtaatcaactctgatttctggacaaaagccttcccacatttgtaacagacaaaaggcctctctctagtgtgagttatttgatgtttatggaaatttgacctgccgttgaaggccttcccacattcagtgcacacatagggtttctcacccgtgtgaattcgctgatgctctttgaattgagacttagaagtgaaggctttcccacattcactgcatttgtaaggcttctctccggtgtgaattctctgatgcatgctgagtattgacttctggttgaaggctttcccgcattcactgcatacatggtgtctttctccagtatgaattttctggtgtatattcaggtgtgacttttgggtgaaggtttttccacagtcactgcattcataaggtttctcccctgtatgaattcgatgatgtatatcaagctgtgacttggaaatgaaggatttcccacagttgtggcactgataaggtttttctcctgtgtggcttctttgatggacaatcaggtgtgccttctggatgaaggcctgcccgcattcgatacacacataggacttctgccctgagtggattctctggtgcaagctgagtgttgacttctgggtaaaggctttcccacattcactgcatgcatactgtctctcaccagtatgaattttctgatgtataatgagggttgagttttgggagaagcctttgccacattcactgcattcatagagtttttctctactgtgagttctctgatgtctgaagagagataacatctggaaaaaggcttttccacagtcatggcatttatagggcttctttctagtgtgtgttttctggtgcgtaagcaattctgatctctgaataaagaccttcccacattccttgcatatacagggtatatcacctgtatgatctgtcagatatacactgagttttagttgtggcatgaaggcttttccacatttgccacattcatggaggtttcctacactatgaattctctgttgggcaaagaggtgtgacttctgggtgaagctccccccacattcagaacatccatctggtttcttctgagtatgaatttgatgttgcttgagtgactgtttatggccacagacttttctacactggttacctttgcaaaatgtctctcctgtatgaatattcttgctgcaggcatcagaagagctatggctgaatagctgaccagacccaacaacgtcatcaagctgttctgtgtcattgctttcattctgaccgttcacttctaggttcagcttcaaactttctgtaaataagcaacatttctgaggttgtttctgtgaagaagcaaggtggggcctcgtgcgaatcattttcccagggtccttatattcacaattgctttctgtgttcaatgttttcttgttgaagaaagcactgtgactcatgggttgaatttgattttgctcatctttctttgtgcggtcagcatccagcctcagttcttctaaaatggaacaccatgaaccatctcttgtgaactcacctaccatatccttttgaaatgaagctttcttagaaatctccttttgtgggatttcaagcccaaactccctttctaaaaggagaaagagaagatgaaatagacacaatgaacaagaaagaggagaaactgcatgaagctgattgacacagaacacaaggaaattgctgagtcatgtaataatgctgctaatgatgctgacaatgagcagaaacacagagcccttattacatgatgagcatttatctacatagcacttagcatgtgccaggcagtggcctacatggtgcacacatactcatttaatctgcataataacctcaggaggtagcgatgatgggtgttcctgttttacaaagaaaaggaagcacataatggttatgtaattggccaagatcactttgctaatctgtggggattagatttcaacaacctgaggacacttatgcaagtggtctagacacccagatctagtaggatgagtaggataaaacagacaagtgttgcagggcaacatgtgtgggcagccaaggcttgaaggagggggctcagtgtgtaggtcttcattaactttcagagatgaatcctcaccaatctgcctgctttatcttacttgttagaaacaatgccaagtccatcagccctgtatatccttctgaaaactattaaagcttcacctatcttgacatggccaaccagtgaaagaatgactatgcctcaactctcctatgcctcaact

SEQ ID NO: 12501 - DNA, 13609 bp, Homo sapiens
catcagcgtttcatatcacaaattaacctcctttccaaatttctctttaagttttaatcctcttgtttaagtggctttatttcttaaggtttgaagtgcctttattcacattgtatagactcgaacattcctcaaataaatttaccaaatttctgctttctggcttgaaaatcatcacttttttagattttcacatcactcaagagcaagactagcagctggccgtttttccccccattgttgatgggtcagggagcattttttattaaacaaaatttactttaaaagagtgcctgacagtgagctgggagccttataaccttttccagatgaggacgctgttctgtctgtcagtttctcaccagctaagagcctctcacctacaaccagccttgaaggacaaaaatcatcatctgtcctcggccacagtgacagttcgccacatggcatggacttttgattgttgaaatcaaaattttaaatttaaaaaacaatttaaatttttttttaaattttgattttagaaagcatatgttggtgtacatgcatgtatgtgagatatactgtctacagacacaggtcagtaatgggcatgtatgtgtgggtgcattcatacacggctggacttctccttagaaaggttatagttgctctgctcctagtgcttgaggtctgtgttgtattattactgcttggttttatcccttccccgcctcctgctgacattgtattgtagaagccaaaggcagggcccagacaggtcatcagcaaggcacttaggggatcaaccttctaggcaaccttcctctctgatgcctgcagctttcgtctgtggacgcacctttccaacgctcttatgttcccctaaacctctcatctctcctcagcccatgaggatcagggcctttgaactgtgagagatcaggactgggaggtagacaccaggcacgagcaggtagtaaaagaacagccccttagctctcaccaggccttacctctccacccccaaagctgaacatgtctgccatcttgaggtacaccacattccccaaagttctatttttttctctcagatctgagcctttgcttacagtatgccctcaacctagaatcttcttccctctacttctttatgttaatgtttagtcatctttcaagatctgctgtcctgggatctacttaaaaggccttttgcagtccagtaaaactccccactccccacccttttgtccccactggtgtagtgggtatcacagtggctgtttccttgcctgtctttcctagtacatgaactccttctgagggcatgtgctgcttctctcagcagagcaaagtgctctaaggtgaactcaagtgtcatactgtctggattctcattccatctctactactcaatagccttgtgattttcagcaagtatctttgaaatgttcagtgccaaagcttctccaactataatatggggctagtaatagtgtctgtattgcatatggagttatgaagattaaatgagaagaacacataaaaagcaaccaaaaccataggcagcacccaataaatgatagctactgttaccattattctcagcctagcattttgctggatagctagagatgggagaaacctgcattcgtttcctgaggctcctgtaacgcataccgcaaactggatgttgtaaaatgacaaatttattctttcagtattagaagctagaggtccaaaatccagcagggttttgctccctccagaggccctgtgggaagaatctgtttcttgcctctctcagcttctggtgactccaggtgatccgtggagtggtgcagcctctgccttcatggtcatctccccactgccgccgcctctctgtgttctcagaactgcctttgcctctctctcataagtgtacgtgtgattgtatataggacccacatgaattttctgtgataatcttgtctcgggaggccaaggcgggcggatcacttgaggtctggagttcaagaccagtctgactaacatggagaaaccccatctctactaaaaatacaaaattagctgggcatggtggcgcatgcctgtaatcccagctactcgggaggctaagacaggagaatcgcttgaattcgggaggcggaggttgtggtgagccgagattgcaccattgcaccccagcctgtgcaacaagagcgaaactccttctcaaaaaaaataatctccttgtctcaagatccttaacttaattatatttacaaagaccctttttcctagtcaggtcacatttacaaattccagggatcaggactcgataactttgggtggccattattcagcctaccacagcttgtcctctgacccccaaagagtcacatccaacccacatgcaaaatatgttcacccatcccagcaacctcaaaagtctcaaacccctgtcttggccattgttttttctagtcttcagagaagatgtgagctgtcatgtactcctctccccactgtgcctaggatttcctcctccagattcacaggggagatttgggggtaatagttgttgtcagcagctctctattttttagatcaatgggttcacgctgatcgcttgcctaacattaaatatggaatcaaacttgtaaagtaggcaagactcgaggcctcctgtcccaatctgttttaggccacctgttcacaccaccactctgttgtacccaccagtctcactagccatccatacagcagcactggcatcactcccatgacccctccctgcagcacattagcctctttcctcagccaggtggaggtttccacctgtcaagttctcttttttttatttcgaaacagactcactctgttgcccaggctggaatgcagtggtgcagtcccagctcactgtaacctccaccttatgggttcaagcaattctcctgcctcagtctcccgaatagctgggattgcaggcacccgccacaatgtccagctgatttttgtatttttaatagagacggggtttcaccatgttggccaggctggtctcaaactcctgacctcaagtgatccacccatctcggcctctcaaagtgctgggattatagtcatgagccaccgaacttggcccacctgtcaagtgtgaagcctatacccctctttggttccccgacatttgtgtttctggtctcaggggcacctctgacattcagctcctttgcagagtagccatggctgacaggtcttggctctgctgatgatcacactttctatgctgatgattagccccgcccagtcccccatgctgacctttaagaaggaggtagaaggtggtttaagaaggaagtagatgttgcatttagccttggaagatgagtggaataggcaggaggaaataagcaaggcagctgatgttgagtgttttgtgagaacgagggccagagatcataacctttaatgcatctacttcacagaaggccacacttccttcattacaaagagtctgtctttccccctctcaaattccatttcatgccttcataaactcctttttctttgtttttgagacagggtcttattctgtcacccaggctggagtgcagtggcgtgatcatagctcactgcagcctccacctcacaggctcaagctatcttcccacctcagtctcctgagtagctgggactacaggtgtgcaccaccatgcccagctaatttttgtattttttgtggagacggggtttcaccatattgcccaggctggtctcaaactcctgagttatgtgatccacctgccttggcctcccaaagtgctggagactaccggcatgagccaccacacccagcccataaattcttaatacaggtttatggcttgtaagacaaaagaaaatgacaattcattattttagaatcttcggataaaaaactacgtacgtaatattttataaggccatcacttgtaagtgcctcacagagtgctgggcattgtgttgagcacttcgcatgtgttaacgtacctcattcttaaccatggttacacagagagaaaatgctattatctcaacttcggggcgcagaaaggttaagtgatttacactgtttctcacagctagtacgtcggggccaggattcacctgcagcctgtgtggctgagagccagccctcctcaccctctccacgcaccactctgtgctcgcaaaatgcaggcccactggccatttctcctcacagcagtggtttctgtgcccatgaagctgaagtgtggagaaggcgatcaacttagcatggttctcctggcaagcagcacaagctctgctggctgtgcctccttatccatctgcagcatggcaccctggtatgcagctcctgcgctgcccaggctgggagggccaccccaggctttttccctgccagaaccacaacatccacagtgcccaaaatagccccagcgttacattactgaagtcctgcttctgtgatgaatccagccatctgtctcaggagacttctaaggcaggcttttgatagcaaaacaaatagtcctgtggacagatttgggttttgtagggaatttatgatttttgaagttgcatttcattgaacctctttccttttttttttttttttttttttaaagacaacgtcttgttctgtcgcttaggctggagtacagtggcacaatcatggcttattgtagcctcaacctcccgggcccaagtgatcctcccatctcagcctcccaagtaacttgggactctgggtgcgtcacaccacacccagctgattttttaatttttgtagagacaaggtcttactatgttgcccaggctggtctcgaactcctgggctcaggtgatcctcctgccttgacctcccaaagtgctgggattacaggcgtgagcctcttcacccggtcctcctctttctttaataacctactttataacagactaacacatattttaacacaatttaaataataagaaatgaggacaaagggagaataaaggtagcaaagtaaggtgaattccaggagtgtgatttctccacaaaatgagtaacaaaaagtcacatacagtgtctggaagtgggccacggatttgaccctaagattcttacaggcaagagcaaagagagaaatacaactaattgttaggttcatggtagccttaagactgacactattctaacactcttgaattaatacctgataacaatttcccccctcccctggccctccatcctttggcatttagagaagtgtctgcagtgcacgtgggaaaccataacatgcactgaaagaacattccagaagcccaggttctgatccaggttctaccaatccctgacaaagtgacctctgggaatcacttacattcctcatctttggtcactgggagttagaattgtacttttatttaatatagagcaaataatggatgaaaaactataccaaaaattggtttactgcttatatttcaggcctgggacttccaggtaaaaaagctccatagatgaaatgtctgagacatgcatatttacttattttcttttcttttcctttgtttttttgttttttcttgttgtttgtttgttttattacatatctacttattggaagtgggactgtcattgtcccagttactgatgaggaaattaggcacagagaagtcaaatgacttgcttaagatctcaaatccaggaactgcagaagtgagatttgaacccatttccaactccaaggcctgtatagtaattcactattccagaatactcctgtagcaacctggccattcgctgctgagccaatgccccctctctttccacaaactcttctcctgtagcttcgaagctatggtaggtgaccaggagtcttggccacacttcttccattgcctgcccaggaggtatctccaactttctcttacacacatctgtatgatacactaagacctttttccaaattgcacagagagagaaaaagggattgagttgcttccatatttttgctgctcattgtcctcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgagagaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctctaccaaaaaaaaaaaaaaaaaaaaaaattagtaatgagaccttgtctctacaaaaaaaataaaaattaaaattaaccaggcatggtgggtcatgcatgtagtcctagctacttgggaggctgaggcgggaggatcatttgagcccaggagtttaaggctgcagtgagctatgattatgccactgcactcccacctgggtgacagagcaagaacttgtctcttaaaaaaaaaaaaaaaaaaggccacgtgtggtggctcacacctgtaatcctaacactttgggaggccaaggtgggaggatcagttggtctcaggagtccaagaccagcctgggcaacttagaccccatcttgaaaaaataaataaataaaaaataagaaaaaaaataaatgccctaccttgaagaacatcacagctctgaggattttatgagttaccaaagaagtccttaaatattaagttatatgggctcatgaacatatactgatggttagtttaattaaaattaaataaaactaaatttgaaagcctttggttcttctagtaatgccagtttatctcatttcttcttgtatcaatatcatagaattacagaacattctgtccaggaggtgagcaccctgccagcctctccctcttcagtaggtgcagtcagaccaggaggtgataggtgctagagtgtggtgattcacagtacagaccctggaagagggctgctggctttccatcccagctttgacccttaccagtgacctgaccttgggcaattgactttacttctctgtgtgcttcttcatatataaaatgaggggtgattatactatttatctcataagcataattactatgagtatgtagcacagtatgttgctcacagtaagtgctcagtaaacggtcgttgctgttaataatgttactatcagggcgtcttgatgggtaatgaagagcacattgatttgtggtcaggactcccaggtacaccatttccccacgggacctgcagccatttattcatttagtctcatttccttatcttatgatgccagtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctaggtagaggaggagaggaggctgctgaaagaagagaacaagagtttccagagcagtcataggaagaaaggacaaggaaatgaactagagccccagagacagggtgcccatgcagggtcccggggaatcctcctgggtgcctgcagcttggggctccacaactgccctgcactctgcccaccacaaaatggatcatagaagagccctcatttattgtcttgtgaccctctcctggacatagcacacttacctccacctgtgtgcctctggttttgctgctcacccgctagaaagttcttcacctgtccaggtgctatgtcttccccagacagcattccctactccctcttccccactcctgccagcagtcagagtttagaaactattctcctcaattgacagcaactgatgttcatctcattacacattattagtgtatttcctatgtcttaagtctcacaggccagagcataagctctgtgagagcagtgaagttttatttgtttttgtgccttctgcttcacatttatgccttgcacatagtagatgcttaataaatgttaatacttggccgggtatggtggcttatgcctgtaatcccagcactttgggaggccgaggcaggtggatcaccggaggccaggaattttagaccagcctggctaacatggtgaaaccctgtttctactaaaaatacaaaaattagctgggcgtggtggtatatgcctgtagtcccagctactcaggaggctgaggcaggagaatcacttgaacccaggaggccgatgctgcagtgagctgagattgcaccactacactccagtctaggcaacagagtgagactccatctcaaaaaaaaaaagttaatatttgaatgaatgcccctgtagtcccagctacttgggatgctggacaggaggaacacttgaactctggagttcaaggctacagtgagccatgattgcaccactgcactctagcctgggtgacagagtgagactgtctcaaaaaaaaaaaaaaaagagagaatgaatgacgagtcagtaagtgcctgagggcctggcccaacagatgaccacttatccaccaccctgctaatggtgttcacatgcacattccacttgtgagttgtgtgtttcttctgagtttggatactagagggtagtctcctagcatgaggcctcttggtgaacttgaaatttattcttctttctctaccctcaaactaaggacaagatcctgagccagtgggaacatcaccaagtttctatgctctttgaggccttgccacagagcagctgctcacctctttgatacactcctttaccagaaataaaaaaccgcaaagcccaaaacagtgctcagttttgttttggtcttaggccagaaatgcatgccgttttggcttgggtcttttaaatgccgttctggaacctgagcaatgcctgtctacaggccaaacccatgtattctcattgcatttccccatctaaagacataccttttcaccttcggttttccttgtaggtaacgatgggggtccatcctcttcaagtaagactacaaacaagtttgagggactatcccagcagtcgaggtaagccatctcagcgcttcatttcccctgttggatccattgatgcaatggacagaattctagaaatgagttttcatgaatttcccagcgctgctcaaagctgtggtcagccaagtggggctggccacaacaagaaaccagacgttcactcttggtttgcatgcacatcttgtgactggactgggcacaggtctgcagaccgttctctgagcagcaacgctgtctacccagttcacagacaggagctaacctcacttcccggtggtcgcagggttgtgcagtggtcttgaacaaaattcctgtcagaatgagtttttatttttgatattttaatcaagtaactttgttacttttccacttgactccttttgcagatttggaaatgaaaagataatccttagggaaatctgattgcctggagattttcaaacataaaaatagcactctttcaagttctgtttctaatatttttttttttaggctaggctgacagcagtgttcttttcttcccttttttcactgaaattgtatacttgaggagatctcttacgggcaatttttatccagccttaccctaaagtgttttctctggaggtgccatccaaggaaaggacagagagccacttccagacccaaacttcagggaaaaagagtcagctcttatccagagtttctgaaagatgagaaaacaaaatctctctttttttgagatagggcctttctctgtcacccagactggagtgcagtggtatgagcacagctcactgtagcctcaacctcctgggctcaagagatggtcctgcctcagcctcccgagtagctggaaccagaggcatgcatcactgtactcagctgatttttttatttttttgtagagacaaggcctcagcatgttgcccaagctggtcttgaacttctgggctcaagcaatcctcctgcttcagcctcccaaagtgctaggattacaagtgggagccaccatatccagccttttttttaataccactatcttatgtactctttataaccctgtgagataggcccaattactattatcctcagttttgcaggtgaggagagcgaggcccagagtggttaggtggtgggtgcagatgtcagagccagctctccagcctacttgttctcccaactccacattccacaccccttccttgcccttgtgccctgcctttcattcctcactcaccttccttcaaccctaatttgggggaccctgtaaaactaaagttctggtgttctttttccagagtgaggagaatatctgacactccaaaagcactcataaaaggtttttaaaggctggacacagtggctcacctgtaatcccagcactttgggaggccaaggtgtgaggattgcttgagccccgaagtttgaggccagcctgggcaacatagcaagaccttgcttcctaaaaataaaaaaaatcagccgggtatggtggtacatacctggctatacgggaggctgaggcaagaggaccgcctgagcccaggaaattgaggctgcagtgagtcatgatcgcacctctgcactccatccggggcgacagcaagaccctgtctcaaaaaaaaagttttggcagggcacagtggctctcgccactttgggagaaccaatcccagcactttgggaggccaaggcaggtggatcacttgaggtcaggagttcaggaccagcctggccaacatggtgaaaccccgtctgtacgaaaaatacaaaaattagccgggcatagtggggtgcgcctgtagtcccagctactcaggaggctaaggcaggagaatcacttgaacctgggaagtggaggttgcagtgaaccgagatcacgccactgcactccagcctaggtgacagcgagacttcgtctcaaaaaaaaaaaaaaaaagtttttaaacaaaatcaagctgattgtgaactagagcctttggcaactcgttaagtttgtttgtttgcttttgagatggagtctctttcaagagaaacaaagccctctcatgtttactgtttcttgtttagtggtggctttatctcagcaatattcccccgttgcccagagacaggaggatttcaagtgagctgaggaaagagcagtgaagatcaaggatggccaagagccaggacagaaaggagcacacacctttcatcttctctctttgactactttttgttttgttggttggtttggctttttcttttcttttaaatgcagttagctgaggcacaagaatcgcttgatcccgggaagcagaggttgcagtgagctgagatcgtgccactgcactccagcctggtgacagagcaagactgtgtctcaaaaaaaaaaaaaaaaaaaaaaaaagcagcagcagcagcaaccaactcttaggacatcaggggacagaaatggagagatgagataataaaggggttcttggcagatggggctcaggcacttggctactgctgcttctcaggcatgcaggcctcctggtgtcctctgagaatcgccaaaacctcttgttaaagaaaaatagtggcttccacctaatgtagaccactgatggcactggggtttcagttgcagaggttaacgtttgatgatttagacaatgtggtatggacctgtattccagggacttgggcctttgtcaccctcatttacctgtcctccaaaaggaaagcaaggcctaggagagcctggaggcccgagaaccaagctctttgctatagtggaggaagtgagggctctggaggcccaggggagctagggccgaatttccacttctacctctgacccacgtgagaccttctgccagccgccaacacccccattcccttccatttccttgtctggaaacacagagctgctttgtgggatcatgtgggaagagttacttctgtgcactacattggggtcaccacttagagtgtgccaggtgccttcataaatgctttgaagtggaggagttgggctttatcattaagagggacttttttttcatccttttactgtgcctcctcagccaggcaaactgaaatatggaaaatagactaatcttttgttaaagacattttgaggctgggcacagtggctcatgcctgtaatcccagcactttggaaggctgaggtgggtggatccacgagctcaggagtacaagacc

SEQ ID NO: 12502 - DNA, 12291 bp, Homo sapiens
tacttgattctcctgctgtgtgtcttctctctttctgagagccacaaaacaccacgtccccttgcctgagtctctagctagctctgtggcccctaggccacacctctgctgcctggtaactttccttgctgcgttgtgacagagcccctgtggccaggcaagtgttgccttggcgctggtcctttctgtgaatatggtggaaagttgatctcagtccttccagggaactagtcttacagtatatgctggaggctactttgtgctgatggttgtaatagccacaatttagtggacagccactgttgccaagtatcttatgtacattggtgacctcttataataatttacaaaatccatgctgtcattgccattgtaaggattaaagtggcaaatagtgaatccaggtttggtgtccaggggtgcctgatcttagagcctgtgtgtggggattgaactggcaggaggtgcagatctctcaagcaggtggggtgtctgtgggacaggggacagctgtgcagtcagcatcagactccagttaatacagaatgcttgacagctcacgctccccacatcacaaaatccaggacctggaagggagcagtgagcacccacattgaggttatttcatgactgtattcacctgacccccactgatgacctcccatgtgaggtgcacacatttgtctacatgtgaatcctcagctctggactgttgggaattttggaagtagtggctgggcagccgaggaaagaagtgaagctgggtgggcagaaatcgaggccccaggcccatcagcctgagtggttgggaggagagcttggagctggggttgtacgagaattgggctgggcaaaggcagtgtccaccttgttgggtgatgaggatgggattcaacaactacctgtcctctggagattgaaaggttaaaataaggcttgttggagcctttgccatctgaagcttctgtatggttttggggtcaaagtaggtttggggaggcaaaaatgagcccccagacactaagaagagaaggcacaggacaggccaccatccatcccctgctgtcccaaaactgacaagtctcgtacctctgacagtaaaactccccgtaagactacaagacgtgggtcttggagctgcagttggcctcaaatgcaggttcacgaactgaccagagccagctgctgcagaggctgagctcattcgcagtcttggtgtatctgaactcatgattgaaagattttgatgtacagtcgacttgccatatgcctaatgtgatatcccgttagactgtgcttccgctttagataggtagtagttacaagggctttcacgggagcccttgtgccttagtccctgtgtccgtttcccattgcagctgtacaaggttaccccagatgcagtggcttcaaacaacacacatttattctgttatagttctggaggtcagatcctaatatcaaggtgttggcagggccgcgttccttctgcaggctctagggaagaatttgtttccttgctttttccagcttctagaggctgcccacactccttggctcatggccccttcctctgtcttcaaaaccagctgtgtagcatcttccgatctcttcttccattccactccatcctgacgtccccttctccggctcctctgctttcttttttcatttgataaggacccttgtgattacgttggacccatctggataatcttgaatgatttccctgtcttaaaatccttgacttaatcacagcgacagtgcctctttatcatgtaaagtcacagttgcaggttctggggattaggacttgggcatctttggggagggtggtgtctgcccacctcagtgtccttcctctgtgtttctcctgagggctgactcttccctcactgtgggagaccctgcacacctgctgtcattggggctgagccagtcaacaccggttgagggtagggggacactggccaacccaaaggctcttggcggtctccacagacttccacttcagtttagaaagtacagtgagaaaaccagtagctgaataaagatttagggtatttggcacagatctgctaatgcacgtgtccgcaaatctagactcagcacaaggagtcttagtttgggatcacaactgattctcctggtccagtgatacctctgggctcttgttcattggctggagctctcctttttgctgggaggcagtgcttcatcttgcagttcatgagatgactggcacttttgcagccggcctcacactgctggttatgtgcatggaagaggtctcatctcactccttcctatggcttttctagctgggcagactctggttcctgtattctccccctcaactgtagtgttgaatgttcactgcccatcctttctgccctgctctgtggctgcctgtcctcatctctgcatcggtcttctcttttcatgtcctgtagctcatgagtgacccgctcccatgtcacctgccattttggccttgaaatttggtaatgattcatacatgtgtcctcgcttgtgccatatccagtgggacaagggaattgggacacctttggttctctggtagctttgcctttttttttttttttttgagacagagtcttgctgtggcacccaggctggagtgcagtggcgcgatctcggctcaatgcaacctccgcctcccgggttcaagcaattctcccgtctcagcctcccagagtagctgggattacaggcgcctgccaccacgcccagctaatttttttgtatttttagtagagacgggggtttcactgtgttggtcaggctggtctcgaactcctgaccttcgttgatccatgtgccttggcctcccaaaatgctgggattacagacgtgaacccctgcacccggcctagctttgcttttaaattgcaagctgggactccagccctgtgaagtggctgtccgcattagatcggacacctggcagacacttgtttaagttttagaattttaaaaaggaaaatacaggagaaaaagtagagttgatcacaaaaagtagattttgcaggaaatagtttaacttttaaaaaagttatcaatgtgttatatgcaaatatggaaaactataaagaagaagaaaacagttgcctataattcttctagctggaggtacctgctgttactcttggggatgctttttgtttttctacctttgtagctttttagtttttttctaagacaaagtctctctcttgcccaggctgcagtgcaacggtgtgatctcagctcactgcaacctctgcctgcccagctcaagtgatcctctcacctccacctcccaaatacctgggactgcaggcccacgccatcacacctagctaatttttgtatttttgtagagatggggtttcacccagaatggtgtcagacttgggtttaagcgatcctcctgcctcgggctcccagaatgctaggattacaggtgtgagccactgcacctgccctacctttgtgttttacgagggttgtatatgtatcacatatgcagtggtttgtccagcttttctcctacagtgacatttttctttgtcctcgccttttcataaactgtctttttaaatgtttgcttgatatttaatcatggatgtattgagatggactcatctcaaactatattaaaaacactctggatgctttaaataaaaaatggcaaaagttaatgttgtaagagaagtgaaaagaaaaccaagagctcctacctgcctcagcttaccctttgtttggtgcgtgggtgcagtgggcagtgagccgtgccattccctcctggcagccggtgcatggctggccatggtccttagcagtgactgtgaacagccgtgggctactttgttacccacccagtgctgcttttgtatgttggcaaatggggctttcgctttccttggtttgattctgtcattgatgcttcagactagtcatgcttttgtttgaagggaaaaaaaaatcaatcaatcaatatcagtaacttgctatagatttttataaaggaaaaaaccccaccacatgtatggtggggagtgagttgatgtggaatcagtcatgaccgcgttgagttaggagcatcgcggatgtggagttacagctctgctgtggatgtttttgttttaagaaaacatcttttaaaaatctaataatggttcattaaaaaccagaaatggtcaagctcactagaaaccgtcatcagccacattctgatgaaagaggttttgactttcttttttaaaaaattaatgaagatacatccaaatatttgtggcaggcaggaaatcaagcggattttaatgggaaattatgtaagaaagcttaatgactaatttttctggatcagacaagtggagaacggtcttagggaaatgtgtacatccattactcattagtttgctgtattataattactgttgtataggaagaagcatgtcagataattaggaactgggtggcattttatgctaaggatcaaaacaaagattttgcttggaatgttgagcaaaattatactctggctgagattaaacacatggcaagcatcctactccagtatttaaaatcatcaggcaggctttattctatttttttgggtctttgttctttcatgttttcctctaatgaaaaggaatgcttagaaaatagcactgggaggccagcaagaaatcagtgttgggattttctcatgtgtgaggagctgttactgctcctgtcgcctggtttcacccctcggttctgctcccaggagctggacccctccccgctggcccctctgtgctgcaagcatccattttgggcttggggataatggtcaagagagttggttggtttgggctgtgggctggacaagcgcttgctgcttaaaccatgttgattgtggcttaactgctgaaccaaaccaatacttcatccaaagaacttctccagggagggagtgggcttcaggggagccacatgggaagccccctaaccaacatttctgtagcacttgattggagcctccaaacaccgtcgctgtcgatgctacagcagtcctgtgggccgcagaaggagtactcactgtgtgttctccatgcccttctgtctctgagaagcagcgtggcgtgttcggattgtgccctcctgccgaccccggtggctcaggcaaagggcttgccagatggtcggtgttctttgccaaatgggaccgatagcgtgcgcatggtggggatgaggggaggactagggaagtaaatacagtgcctgctgccacgtcaccttcacacagtccatgtttaataagaggtcgctgctgtgatgatagggggtcggccagacatgtccactgtttaaaaagcagcatccatctgaggactcattggattaaatgtacacctaaaaaaaatacagtggcacctgcatgcagtgcccgaggatgggtgtgctgttttactagatctggtgttttttggaggtgcacatttggtagttcattgttgggttggtatttgtctccataacctgtttcagcctcaaggtcatttacctttgatcagtgcttgaagcttagcggtttgtttatatacatgttcatgtataaattatattactcagtctgatcataatatatgcccagtgcaaatcatttcattaaagcctcagggatacacggtgccaccgtttcctcattcagggacacggggatagtggtagtgtgtcttcagcacgacatggggaaattcaaaggcagccatccgtggaagagccaacggcagcccgtgcaggcgtcagcgcctggggaatagtagcagtctacatctttagctgtcagggtatctcgttgtagcctcatcctgccctctttaggggtccttggatgagttatcagttgtagtattgacattttctgtaaatagtgtcactcaagcgagtgacagtgggaagcagacaccagcccttagggagcagcccaggatgcttttttcctccaaatgcctctcacctattcccagatactcgctggagttggagcacacatgtcwgcagatgtaaaacgacctgctcccccaggtgaatggattctcgccagggccaatacttatccgcaggggtgtgtgccaggcagcccaggtcagcctccctccaccgggccacccgcaccaggttgcctcccatcgtttgcaggagcggaagacccgatggagcaggtttcacagtgccctcgctgctgcctcccgtttcatctgcacgtctctttcaatgcgggcgtgcgaacttccaggtagagccgagttcaagaaaatgaagtactgcatgcgacgagcaagtttattgaagagggtgtgaggtcgcggcgcctgaccctcattatgtcagttactactaaatgaaattagaacttcactgccctttttctttttcccatcgaggtgcaggaggaattgatcttagggtagtattttggatttaaaaaaaaaaaaacatgaaatgaaatccgtgtcctctttatcctcccctctctctgttctgcgcggcaggtagcaaggaacggtggcggggccaaaggtttcctcaaagaccctgggggccgggcggggctgtgccaggcacccgcgtcgcgctccagctccagccctttaatgctctttgccattcaagccactcactttcattttctatagaaaagcctttctgccgcctttcacaaaacttgtattttcatgcctaataagtgagcgtgtgacatgcagtgggctcagtctctgcatagcccggcaggcagcggctctgctttccagaaccttctgggagtggcagacacacattaggagtccacgcgcaggtagcctggcctttgaagctctccaggctctggccacagtggctttcctgccctccttggctggtggacgtaaggcccctcgccccatctgcttcctgctctcccagagccggcctcaccttcgagactcatgctactaagttgtctttcagttcccctggtggtgcctcctctagacccctgaggagatggagggggctgccttctttgcggctttctcacgatttcctcacagtacacacagcaggaccccggggtttgtgtgtggcatcctacacacacacacacacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacagcaggaccctggggtttgtgtgtggcatcctacacacacacacacacacacacagcaggaccccggggtttgtgtgtggcatcctacacacacacacacacacacacacacacacagcaggaccctggggtttgtttgtggcatcctacacacacacacacacacacacacacagagcaggactctggggtttgtgtgtggcatcctacacacatacacatacagcaggacccccgggtttgtgtgtggcatcctgcacacacacacatacacagcaggacccctgggtttgtgtgtcgcatccttcacacacacacacacacacacacacacacacacacacacacacacacacaccccttgcttatgtcctccacccgtccctgaaaacatgaggtctgcgaagacgtctttgagtctgtttggcatccccaagtgcagcggtgaaccagagagagagggagcattcacttgattcttcacgcgtcagtgtttttaatctctgtggctggaggacagtgtgtgtcaccttttcttagtttccagggactgcggcttccttccacctctcccttccctctgtagttggacaggccatggctccccagttctctgctgtgggcaggtgcaggagcctgaccaactcctccgtgagtccatctatctgtgcgtgcatttattcattcctccctagtgaggcaggtccctgatgagcagctcctctgcgcctgcccaggtccagcgttgggcatgcagtggtgaacaaaacagactcaaacgcatcttcacagagctcatgttttggtggacaagtggaggatataaacaataagcacaatttagtaaaacatacggtaccacagctagcaaaggtggcaaggaaaacaatgagagcgggggtggtgtgaatgtgtgtgggtgcaggggcacctcgggagcctggccgggaaggtggcatccgctgcaggcccaggtggggagatggtgggtgctgcttccaggcccaaggaagagaaaggcagaggccctgaggaagcacagagcttgagggagagggctggcgtcagctcagggaagcagggaggccaggcggggaggccaggtggtgtggggcctcatggaggctggggagtcatgaggatgtgggaggatgggggagctctggttgctcaggcagtggggagaggacagcaccatggtaacatgcacttgtgttcatgtcttggctgccccattgctgggcacgtgtaaaataggagaaatcttaaagcttgcagctctccatgtgaaaatgatctgtttgtttcttcttattactatcaatattaatattgatcctgtagtgctttcacacttaaattgttgagttccaagtcttgtctaataattatctcagcaattgcgataccattggctgaggttcatggaggttttcaggctaatgtcactgaatgatcggaaggactcactgctggcagtcacttgtgtgttttgtgtttttttttcctctgtctctcgccctccatttttctgcacggcattaagtcagccacattttagattgtgtgcttctgtcatcagaatatctggcatgctttcccctgaatagcaggcttgacatctttttctgatattttgtaccaaccgtactaagaggcttcttgttagctgttaattcatattttctgaggctgctaatatgcgtggtagagccattactgttgcatgttcaagataaaagccaaatctcagcttataccctgttctcccaggataaattcagagaaccactatgaagtctaatccatactgtgatgttgctgaaaagaaaatagggttataggcttatttggagcctttcactgtttatggttgtacaagttgggtgttactgacttataatgtaaaatctgaatttccagggcagggacaagattcgtttttggctaaggcatattgtgtctgtggggctgctgaaggaaaaagagcatcttatttttatgtgattagcattattcaatcacaaaatgcattggattctactcagactgtcggagaatatgcttgctcctctcctaggctctggaggaagaacctcagccactatgtgtgtgtgtgtgtgtgtgtgtgtgtgtgtgtgtgtgtgtgtgtgcatgcttgtacgcctgtgcacagagggtgggaagagggcttgcacctaagtcctagggtcctgttctctgcacagttctctgcataggtttccgcacgccttgctgtctcctccttgttgcaggcatggagcaaattatcacctggtggtaactccagtctccgccacggagactgcttaccctcttcctctttggttcaggctgaaccatcctcactcatcttgtagagcctcccgttcccatctcctcatcagagtttcctactttccttgaactttcctttttgaggagatttgagaagtgtgttgtccaagataggatttagtatcctggagccaggcttggaattctagtgtgggaaagcttacttactattactttattatggcattttaaaagtttttaaaagtaagtggaaaaaggatttttgaacctgttattactttcttatagcattttaaagccattttttttcctagtgggaggcagaaggaaaaactcggtcatgtttcactcactcctttcttaaagggagagttttatattgtaccttcttgttcacagccaggtggcagctacattgctaattgcaagctttcagggtgagaaagagaacccgtgcctacctgccttttcctgatttgaaatggtgatctgcgttggtctcaagaccttgtgcagcctcgcagagattgctctgcacacatgtgattgcatctaatcaggactttttctgaaactgctgccaggaaaatgtgtgctaggaaggttaccttctgcagctggacttttatgatgcactggattatcatggccttagatataccatcagggcatggagtggcaacagtgctttgctgtcttgacgcatctcaggtagaggatctcttagggagctttctgattgaatcccacgcccattttgagggaagggaatgggccatgggtctcatccctgcctagcgctgccttgtgaggggtgctggcctgtcacctccagttcttgctcctttttaggaagccatgctgcctccttccttgttgtgcgattattttttgggttgtgtctattttggtatttttttctctttcacctcctctcccatatttcccctctagggtgggaggaaggagacccaggtgtgaggtggtgcaggtggctgcagtgtcctcagagatactgagctgtggggtagaggtagctggaatctagatcaactcacctctcttttatcagccatttgttctgagaagagaggcttcgaggagagacgcttcggtaaggggttgctgtgggtcctggggtcacgggtgttagttctgggtgccactgggggacacgagagacagaaaggataggaatgaaaatgaagagcaactaagggatgtgaagatttctcttgcacttgttttcgggataggaaaacaagcccttttagtctggggcaaggaagtgtctagtgcctccacctggtcatccaccgcggtcctcctggtctccgttcaggcccacaggactctggaccgccccatccctcccagggaactgtcccatgtcctgctcaggaaggtggtggggaaggggtaggcaggatggacagatggacagtggcaggtggggacacctccatctcattttgttcctctcaatccgtttgtttttttctctccctccctctctcctcttttttttttttttttttttgagacagagtcttactctgttgcccaggctggagtgcagtggtgcagtctcagctcactgcaacctctgcctcctgagttcaggcaattctcgtgcctcagcttcccaagtagctgggattacaggcacacgccaccaacgcctggctaatttttgtatttttagtcaagacggggttttgccattgttgaccaggctggtctcaaactcctgatctcaggtgatccaactgcctcggcctcccaaaatgttgggattacaggcgtgagccatcgtacccaacctcaatccatttctttatcctaattgagagaatttgaaaagaaattaatagaatcaaaaaagagaaaagggcctggttatcagagatgcaaaataaatgatgattttaaagatgctagaaagctgtgctccctccctgggtgctttctctttggaggggaatgctggagaaaatctctacaaaatcttccccttgcagtgctgggagagagtaatggtgagcaaatccttgtagaattaaaatgggatgaagagacccttatgaagggagaaagcaggtgaagatggtggggataggggcgggacgtgcacccccttcactttccatgccgggcagtataaaaagtgagaagaaacacttcagggctggtgtgtaaacttcatgttggataaatacgtgacttctggtattttgggggcatggaatcaaaaagttgcagatttggagggatgtttgcagccactttttacccaacatggctctctatgtggtcattcagttgcttaaacaaagtctgggtagacttacaatttttttttaatacaagtaatatttgcttatagttttaaaaaagggagtataaccatcaaaagtaactctagcgaatgattttggaatattccagaaattttctatccttatataagctctaaaacagttaaacgcagtagctctatttaataatcaccattgggcacgtggactttcatcagtacacatagatttgcctcacacaaacaagaatgaacttgaatgtacagattaagggataataaaaatgccagcctggctgccatctggctgaggagacgttttacaagaacctttgaagcatcttgtgggcctc

SEQ ID NO: 12503 - DNA, 12450 bp, Homo sapiens
acctggccctggactcccatcctccgtaagtaggacaagtaaaagtctgttgtataagccactgggtcttgttagagcagccagaacgtacaaaggctgtttggcaggaaggcagcatcatcctgacaacccccagtattcattaattgacaacattatttttataagaagcactcatcaatttatggaaaactcatgtatgttaaccgtgataaatacaaaagcaaaggagtcactgtggaaactaaacttatccagacaactgagtccctgatatcctgcatcggggaccggcaagctctctgcacggggccagagagtgaatattctgggcttctcaggccgcaaagaccctcatctctgctgtcacagctggagaggggcccaaacccgctgcagcccatcgacacaaagcgtggctctgcgtcatgaaaagtctatttacagccaggcgcggtggctcatgcctataatcctagcactttgggaggccaaggtgggcagattgcctgggctcaggagtttgagaccaacttgggcaacatggtgaaaatcccatctctactaaaatgcaaaaaattagccaggtgtggcagcgtgtacctgtaattccagctactggggaggctgaggcacaagatttgcctgaacctgggaggcagaggttgcagtgagctgccatcacgccattgcactccagcctgggcaaagagctagactctgtctccaaaaaaaagaagaaaagtctatttatgaaaacaggcagctggcctcatgcacgggcctggggacccttcatctacgacgctttacttcaacattcacaggggcctcggcagcgcagcggccgacagtgaccttgctccattagggtgcacctctcagaagagctctaagggcctccctgcacagttcttccaagtctcactaacatctcactcatgttcaccagcacggcttgaaatgaggtttactccccacaggacattctcccgacagaggcagcaggaggtgcccgagatatacgttagtggagggaagaaggggctgtgggaccccagcgactttgtgctgatcctcaggggaccctgcgcttcttcagcattggcactggataaggcgagaagaaacctaagccatgaagcagtaactaggaccaacgtgctgaaaaacaggtaagtatctgagaggcagagatgcgcgggaagagacggcaggcttagaaaggaacctcactgctccaggaaagaaaatgtgaagtttgagaactgatgtcatctttgaaactgagttgaacagtgaatgtacagaatccctacaatttcatctgaagactaatttaaacatgtaatagaaaattgccccatttggaggaagtcccgggaacagtcctgcagccactgctttcaccgtgggtcttcaaggtcagagcgcggcgagtcctccatcaccttgaagcggctccagcactctctggagagcccgagtgtggctgccctgctctgcccccgacaaccccctgggcaccagagcagggggacaggtggctctgcccccatggatttaaaccagaaggggagaggaccctacaagtgacttccaccactcccaccagcaaggggaccctctgccagaaccatgcctctcccaagcttccaacttgaaaagactggctttagaagtatcagtccttatttaccccagaccctcctatccccagggtgacgccacctctcccgcccaccccacgcatctgcacaggctcctctctcatagacgacgtctggcgctatgatcatccacaagtatgtgaccctcttgcagaacctcatgctctcctaggagaattttctgtctgatttgtggctgttcctgaaggtaggtgatcaataatgaataaaataacctaaaaacaattccaaaaggctggtcctcaccctctgctgtgagtggtatcgtgtcattttattatttttttggtggggggaggtccaaacttgactctctctctcctcctttcagttctcttctcaaagcctaatatcaaatatttaaactgctttaaaggacgggactggattaagaatgggcaattacaataaagaaatgctcacaaacaagttttacagagcacatggatgagtaacagctcaagaaatgttctatcctgtacacaaaaaggccccataggagacacacagacccaacaccaggctgttctcaagccatgccttgttgtctcttctgaacacagcactgtttatatgaaacatacctgagaattgcctctggaatggactgctctcgatactaatgcccacccatcaacgacatatttccaccacccacatgcacaagtgcaggcaggactgacttcttgaagtgcctcccgtctatcatgaactgaaattaaactcccagccacgcgcatttaccgtcctggaagaccctctccacattcagcccgtatgtagcacacgtctcgtagtacgtgcaccgtttcaggtcgttggagagcttcctcgccctggcgtcatcgatgaccctcgggttagcagaacttatggcatctggaacagaagaccaaaaagtaacggcacagtgacaatgacagctctaaatacttcctacactccccacaacacggaaaaccagtaccttactcagcagaaatgtaattagtttatgaatctggaattgtagagcatcgtttgcctcccaactaagagactcaaacacaagagaaagttattcattcgtagatatttgttttacaggagcgcttctgaaactgcaattttaaaatgttcagaaagaaggaaaaagacttaaatatgggtctagaggatacatactttagaaaggaggaaaaaccacacacacagtccctatgtgcaggcccccttctgtgcaccacgcaggtggctaagcatactccctacactggcattcttcttctaggtgtggtcacttgtccaatgacgcacttaataaatgctcactgagcccccatttggggtttgtttctgttctatgcacagggataccccagtgaattgttgaaacagacacaatctgcactctcatgaaacagacattctagttggccagagaggcaagcagaaaagaaagatgaatgtgatgaatggttctgaatgtaagatggccacactgttaactgatgccgggaaggaggtcaggaggcttgggtgactctgggttttagagcaagaggtcagggaaccctcacctgcagcaggtggggcgcagtaggcactgcctggggcagaacgcctgaggcagagggcagcaggacagctggtgtatatgagggagatgtaggggtgaggcctagaggggtgggagggaggtgtgtggagaggggagcagcgagtcccctgaggttttgatggaccccctcagggtcacaggtgacctggatccccccaatctaagtcatgtgtgcacacgggggcgtttgagcagctgcacagggatgtcggcaccagtttcctaaaaaagaaactgagctttttttttttttaagctcagctgccaggattccccacccccagccctgccccatccattccattactattgagttacagtggcacgtggaacagagaaatgaggagctggaatgtgaacagccacagggcttagggaggagagaggacttttcacagacagctttttttttctttttttttaatgagatggagtctcactgtgtcgcccaggctggagtacagtggcgtgagctggctcactgcaacctctgcctcctggtttcaaatgattctcctgcctcaggctcccaagtagctgggattacaggtactcaccaccatgcccagctaattttttgtatttttagtcgacacggggtttcaccatgttggccaggctggtctcaactcctggcctcaagtgatccacccgcctgggcctcccaaagtgttgggattacaggcgtgagccactgcgcccagccttcagagacagtttcctaacctgaatctttttcatagggcttgaaggctcttatgccaaagaaaacaataaacaactctttaaacaaaaatccaccaacaggatttctccaccagtcaaagaaatagcagcaaagttatacaacagagcgaccacctttgacattttatttttgtggagaaagggcatttgagaacttcattttttgaagtatatttaaaaagtgatgtcctgaggaatttattcagttttttcttttctcttttctcatgttattttcttagccctatgaaatagggttgggctgacgtttccccgttactggaaggcaagtgaactctgcagttaagggtttcttctctgacaatcaccactacagcctccataggctgcacccccgttccagggatacggtcaaagggcacctcgtcctgccttcttgtcttgctgattagtaaatctgacttgcatttcacaacatttaagaaaagaaagttttttttttaagtataaacatttctttttaattgtaaaaagaagttacaagtccatgatgtttcaatgctctaggataattttgaaaacacaggccacatagcatccacccagcttccatgagaccctgacctgcggccgagcaatcccgcagcccctccgtcctcagcggcatgctcgcttggtttctgtcaaatttcggcttcaaaggtgcaccacgggaatctctgccactgcaccaaaacgggcttctgcactcgcatttcggttctatacctgtctcattttcattccacttttaactccgtagctttttacagatcgtgcttctccctcaaatcaatttaatttgcaagtctttaaaacagaacttgtttaacaaacattaaatgattacctcattcattcccatcttgcccaattatgaacattcgtgcagtccttggctactgcccagaaagagctcctgctggcagagctgcccctcccgccagcgggcggaggcctcaccccagcccaggaatcctttggcaatgaacctaattcctcttccgttctttcccatcccatatgctctgacctctaacgctgcctaccccaaagcagcaggaagagaaatgccaggtgccttcctagacaacctgatccctcttttgtctctggcatcccaggaagccaaacccctgaaagagcagccgagcacgggcttcacggagagcaagtctgcacgcaggaagcaagcgtcgcggcagggaccctcagagcccacgtgcatgccagcttcctgccatcaggctttctggggtgctccctgaagtctagggaaggaccaagagaatcccgcaggtgaggaatacagccctgattgcaacttttcgttctggttcatctgggggtggcccagctaagaggagtcctgcagggagggcatggggcccgcttacctgctcaccccgggagggcgtggggccagcttacctgttcaccccgggagggtgtggggctgacttacctcccaaccccagaggccaccctcgcacacgcacacactcccctggggccttcctgggcatctttccacatccgatcaacggatgttcatggaattcatgggaataaatgggggtactttcttttactcaaggacttcaacttcatcagggtttctcgagaatctaagcagccaccctggcaggaggctcgatgtgccccttggctcaggcaggagactcagagggatacgctgcctccaggggcagggacagtggggggtggggttcaggattccaggcaggaccctggaacactggtcgcagattgaaatatgaggaacaaaagcagccattgttaagatgcctatcacatacccacggatgcactgagtgtcttctgggaattcctgttgaaccccaccaaagtcccaggtgtcaaggtcacccagccagcagccagtcacacgcaggtgtgtgtggtcccaactcccgggatctcagacactcccttcctactgatggaacatggatgtgtactcagaactcagagaacagaacytgatcgcaggggatctttccaggctgggaacttcactgtcacttttcacagtgagtctaagcaaaagcccattctgagtcctaaagtcaaacctcctgagctccagcagcctgtgagtggtgtctgcacacacagccccgaaggaccctgctcaaaaatgccacggtcgggcctgcaggaaggggagcttattcggaatttctctattcgacttcaaggcagctttaagcagaatctgctgtggatgagcatccactttaaaacacgattaggcattttcaagatgccacctcaaatacggcaactctgcattctcacaagaaccaaggacttttgggtggtgcggccttgtctcctggtgaacactagagggygcattaggcctaagaatccctcctcccttctgtgttaggattaaacagagctctggctctgaaggtttcaggagtgagagcgaccacgtacgctttaaaaaaaaaaaaaaaaaaaaaaaaaaaaaaaaaagttgggggaggtgctctccaggaagcccaactctaacatctctcatctagcacactgaaaagatacttatagttttgttttttttttcccttgagatggagtctccctctgtctaccaggctggagtgcagtggcacgatcttggctcactgcaacctccatctccccagattcaaaagattctcctgcctcagcctcccaagtagctgggattacagacacccgccaacatgcccggctttttatttttttgagacagaatctcactctgtcacccaggctggagtgcaatggcgtgatctcagctcactgcaacctctgcttcctgggttcaagtgatcctcctgcctcagcctcctgagcagctggtattacaggcatgcaccaccatgcctggctaatttttctatttttagtacagacagggtttcaccatgtgggccaggctggtcaactcctgacttcaactgatcccacctgcctgggcctcccaaagtgctggaattacaggcgtgagccaccacgtctggctggaaaatgtttgtggtttatgccacactatttatctgggcttttgtaggttcgtgatcaagcagccaatcatctgcctgggcaacctcctacttagaccacacctagtgcagtatgtacagctgacgtcctaaagagaagcgtctcacatcagagcatggatgggcatgtcagataggctcattctaaaagaattcgcaaaacagtctattcatagccacaacaaaaatgaagggatatacaatttttcctgataggattatttgtatgttacccatatttctgacaaagcagttgtaaagctaacctccatctgacttttacaaacatcctacgtgacatcttagaccctagtggcagacccagcacaaccataggtctgtgatcaagagcgaggacattgtgtctcaggccatgtgacggccactccactaagagaccaagttcgaagtgaccctcagagaaaacaagaaatgtgcccagttggattctctgtctgaggggcctgtcagattaaaaataagatacagatcataagacggtgacaaacagaacttaataaacagaactgctctatgttcaaaatcagcactattttcaaggtgcactgaaagataagctttaatagattgtttataaatcattttatagaacagagaattaaaatatagcagaaaatatatatatgtatttgactatatatatacaaaacatatacacacacacatatatattttttttccagaaaacaagggaaaatagattttatttttcataaagcacctgggatatgtgtgtgtgtgttgttttcaggttgttaaatgagtggtttcaccatagaatcaaatcaggaaatgtgatcatttcagttccataatttttcccaaaaaagtgagcgttcagtaggcaatttttccttctttaaagcattttttaaactcctccatactgaaaatatgtaactgttagaaccctttcaaaacaatctgcacacgaacatcactcaccctgggttcccaccagaaccagaggaatctcgctcgtgttccgatagttggccattcgactgtagtagtggtaaacggtctggaaacttatttcatcctccaagctgaagacaaatataacagcgtccacccacatggcaaactagggagagaagaaggggaggagagcaggagctgagtgagcaggcttgattaagaacagagatgtctgcatggcggcaggcagcagggggctgcaggaatcccctcggtcacacactgggtgcttgacttttgactgtcacttttacacactgtcacggcatccacgtcctcctcctgagcacaccatgcctggtgttccccttgggaatgggcccttcatcctgttcccacccaagccactctgtcttcagaggacacaaaccacacagtgtccccgcggtcctcatgctcctggcctgtccgcccgctgccccgacctgccaaggcggccccgcagacagaaggccagacccacctcctgccagagcccctcaagccctaaggctttccactgtactctcaacctcttaaggaagccttgctggacccctcatgcctgctcagaacctccccacccctcagtccttcccactcgctaccgcagcggctggcctactctgttgaagggtaaagattcaacccaggctcatccttggctgaactcctgctgcacctctgcaaagaaatgactacttattttcagggaaattaacaaaacttagggaagaaaacttcacaatagcctcactctcgccattttgttcttgctttgccgtattcattttattcttgtcttgccagttgaacctacatcacatcctcttttgacagatacccacactgtcaggcatatactagtacctcatttagtaccaacagccatcttggaaaactggagctgagtgagtggaggctgcctgcagggcagagacttcccacactcactgcaaccagcgcagcacatctgacatcagctctatctggcaacaaagatccttctctttccaagtgcaaatttgaaaaacaaaaccgaaatccatcccgtctgctttccctaaaagaagctgtagttcctagataggtttttatggccaaggttatcacctctaatacatttggtctaagtttttaacaggttaaactctgacttctgcatgtaagtgaaaagtgcattcagttatatgtaaaacatgtacatggtaaaacttaacccaaagttctagtgataaatacaaaattaaatgagaatgaggacttgaaaacaaagaaggccgggagagacctgggaagatcgtgatagcagctcccacagagagtgccaggaccaaggctgacggaaggcatctccttttcctcttctctgccttgagaaaggctcttcctgtctcttctaagaaagcaggaggagcagactcccactgcgcccataaagagtactggctgacccggaaccagacctcagttcccgagccgggagctgaagcccatctgagcatccacccggaggaaacgtgaactgtggctctcatctcctaagggtgcattctgacttccccagcaacttgtgtggggggcacccaataaataaccccccaatctaacatgttcaccatcagaaaactgaaactatgctttggggtttgttttttgagacaaagtctcgctccatcgcccaggctggagtgcagtggtgagatctcagctcactgcaaccacctccttctgggtttaagggattctgctgcctcagcctcccaaacagctaggattacaggcacgtgccaccacgcctggctaatttttgtatttttagtagaaatggggtttcaccatgttggccaggctggtcttgaactcccgacctcaggtgatctgcctgcctcagcttcccaaagtgctgggattacaggtgtgagccgctgcacctagcctcttctgtagatttttctctatatttaagcttttgtgcttcatatactggtaagacttgctcttcagttgtggagaaaaaagcttgtttccagtcactcaaaacatttatgtgctggggaaaacggaaaatcaactcaggtgattctaaatgttacctacttctttctcctatcaccagccacaggagggaccttgcctccaagagttcctttgtagcagaacaaacacggtcctatacattcagtgggactaagaaagagctgacttttatcagcatctgactgataggatcctatcagacctctaactttgccctgccatactataaactaccagacggtcactgaacatgggctcaaactgctttgtaactaagttttcacttttaacacgtcttcaaggtctttccttgttatgatcaagttcatggtatcgttaatgctaagaaacaaaatgttacacactttaacagctttgaaatcagaatgcacctaattattgcggctgtttcatagtttaattggcagcatccttctttcgaatactggtacatcttaatggtcactgtcaatggtcagagtcaatgcaacatggcaaatctgtggcatcttctgtataaccgcacagccctccaacctgtggagtactagacctgaggcctaagaagtcctgtattcagtatctttcactttctccatcttacaatcctatgctgcccgttcacaaaaaggttaagtccaggaaataatgccaagaaaatgtctgacattccgtttgcatttgaggtcactagccgttaccagctctcggctcctttgaagtgtttaaatgggtcgggcgcggtggctcacgcctgtaatcccagcactttgggaggccgaggtgagtggatcacgaggtcaggagatcgagaccatcctggctaacatggtgaaactccatctctactaaaaatacaaaaaattagccaggcgtggtagcaggcgcccgtagtcccagctactcaggaggctgaggcaggagaatggcctgaacctgggaggtggagcttgtagtgagccgagatcacgtcactgcactccagcctgggtaacagagcgagactgtctcaaaaaaaaaaaataaataaataataaaaaataacaataataataataacaacaacaacaataataataataacaataataataaagtgcttaactggtaaattatgctgtaagtaaaacaaagcaggttaaataaaccaaaaaaagagatcttccacactcatgttttgttatttccagaatgaccatctttccaggaacttccaaagaaatcataatatgcttcataccggctttcggtggagactgccttgcttgggccaaggccagggcggcacagaggggccaatgcctgtagttaccagagacagagagaaggtgggactcccaattgcacccagcaagctctctaactctcactgctctagagatcaaaccactcaaaggaaaaggccaaaaaacaaaccaaacgacagaaatttccagatgtcatttcaactgggctccccaaccagggcagagtgtgcgtttcctgcctttttaaaaacacagaaagtgaaaagccatcacataaacccaacttccctgcaggatttagtctgggaaaaaaataaaaaaagaattagcttcttagagatgagaaaaaaatgcagtgagaggaaacattttttatggggtttccacttttttggaaaccaagtcaccgatttctagaagcacttcttgaatcaaaccttagaaaacaaagggaaaaaaagcaggcttggggcatgcatgtatactcacctgcgcctccggggggcccccttcatctctgatcagcagcagatagctctgtccatcaacgacaatctctttcttgaacctgccacctgccacacacacaaaacatctcgttacacgagaacaacagagagtgaggagggcagacagacgtgggcttcgcttgtggaaaaatacaccctaggctgtcgccctggaggcaactgagtatttaggatgttgccagcaaatgctgaattttaacagagccgaactcagatttaaatgtttgtctttaagaacccctgtgcgtttccagttggaaggcacagcttccttcgcaatgccagacactcgtggccaattagtgtggacttctcatgtgggctttctatgtaaattcaggaattctcactcactgggaaacagagaacattaaaattgtcattctcttgttgggttcacaaaactgaaacaaatttttcatgcttaacaggtgcctgatctgcaacctcttggtaaattacagggccgagaacctgtattctcctcaagagaaacccagttcttgaaagggagacatagaacatcatgagaat

SEQ ID NO: 12504 - DNA, 29778 bp, Homo sapiens
agaagattggaggaaggaataaaaagactagaaggggtacaagttaaaagttgcttagatccaaacagggtgggtttcagaaggttagtgtccttggacaacttgtgttttcagctccaccacaccaaataaagaagctgactattgaaagattggtgtgtttgcctcccagtttttctagagtgcctcctaaaatatgatttgattttgacacagcaaactttccttaaaatggccatcttttttgccatcttttgccttttacctaaaagaatgcaagagtaaggatcataatgagactatagatagaaagaagaatttctgcaggagtttgaaaatttgatacagacaaatccacgtaaggaagatgggtcactacagtcgactgtgctacagtgcgcgctcatgagtggtgtcagaagttagaccaagcagaagctagaaatcaacgaggctgccaatgacccaacaattgtttgacctaaaatatagactgagcaaagaggtcttcttccacaagttgacaaaagtataaatgtcattatgaaggttttgtagggtgcccaaggctaagttcgactaattgccttttcacataattgtcacaggtctaaggaacctctaaccatttgtcttcaagactggattagattgaagcagaaaataatcaacatatatgcatctgtctttcgtggaacactcccttatgcgatcaataaacacaagataatccaggacaaaacaaagacagttgaaataagactgcctacacacacacacacacacacacacacacacacacagcaagcagcaggagaataagcaaaggtatttactaaatcttttatccccaaaccataaggtctaatgatcttatagaaatacctagatctaattactttgattataaatcctagggtaacaaattcagcaatgaaagctcaatgaaactatcaagaactcagtgttgaggctggcttacctggcagcagatatgaaggataaatggagtttggcaaagaggcccagtgagtatacctgttggcctgagaatgccctagaatgcttctaagggagagtccttgaaacgacctcagtagaaactttggatttgccgtagaatgataagaccacccttaatatctgaactgaaaagacaaagctgaatatattgctaccaactatgtgttgtacctgctgtacaatagcagctttagaatgtttggggccattgtcttatttggataaatggcccctgattttgcaaagccaaggtaaaaacacatgaggggtgctgtggtttaaatgtgtcccccagaaacatgtattggaaatttaatctccaatgcaacagagttgggaggtgaggcctaatgagaggtgattaggccatatggcagagggaatggactaatgccattattatggaaatgatcacaggagtgggtttctcataaaagaatgagtttgaaggctgggcacagtggctgtaatcccagcactttgtgaggctgaggtgggtggattacttgaggtcaggagtttgagaccagcctggccaaacccatctctactaaaaatacaaaaaattagctaggtgtggtggcacgcaccagtaatctcagctactcaggaggctgaggcaggagaatcacttgaacccaggaggcagaggttgcagtgagctgagatcatgccattgtactccacctgggtcacagggcaagactgtctcaaaaaaaaaaaaaaagaatgagtttggctcccttttgctctctcttgccctctcttgttctcctactttacaccatgagatggcacagcaagaagaccatcgccagaggccaatcactcagaccctcaccacaggccaatcactcagtctggctgggactcaccagtcttcagatctgtgagaaataaatttctgttcattataaattacaggttcattactctcaggttttattatagcagcacaaaatgaactaagataattggccccctgtgttttctaattacatcagtaatgcaaactcataattgcacagcaaacgctcattctagaaaatgcagctatggaaaactaatattaaaaataattaatcacaccatcatccagagacggccctggaaacattctgagacgtatatactcacacttttaaaacatgtataatcatactttatattatataatatatactttttaaatgcacacataatacaggtttataacctttttgtattaaacagatcatatagaattttgatatcaataattacacttcttcaaaattcttgccaatagaacacaagtatctatcatcatttattttgccatccttctagtattggactttataaactgcttcacgaaagatcctccagctaaattcttgccagcatccttaattacttcagttagatgtgagactcatttaatcaaacaacacattttgtgagctttggctgacatctcgtggaaagtcagcttgttgcctatttcacagcctctgtgtttgcatcagctctagggcaacagaaaaaagcaaacccttttcttagcagcctaataggtggggtctgatgtttgcgataatttatcttagactgacattctcaccgttacacagcagtttctgtgtcaatgctgggaccagccaaaagctgcgcttctccaaccacagactggtggtaacatttccacacctttccaacagaaacatatttacatgacaactccatgcagaataagtctccatctcttttatttgaagcaaaattcaggcacattttataagagcagccgtaatataactttaaagagaactatttcctaggcatttaaacagcacttggagggttggaaatcccagcccggccagtagagggcactgtgcaggggcagccggagccacccgccgtcatctctggaaaccctgtgagattccaagatgctgcacccagaaacctgctgctggggaaggagctgacttgtgatccttccctgttatgtgggagtggaaagtggtggcaaaggagtttgcttagcaggtctggagtaatatggttaggctgccaagggtggtagggtgaggtattacagagaatggcattaagggaggagaccactcctcatattgccttatgctcaatttctgcctctaaagaaagaagtaaaaactaaaaggcaggaatgaaatccacaagcagacagcctggcgccacaccctgggcctggtagttaaagatcgacccctgacctactcggttatgttatctatagattacagacattgtatagaaaagcactgtgaaaatccctgtcccgttctgttccattctaattactggtgcatgcagcccccagtcacttaccccctgcttgctcaatcgatcacgaccctctcacatggacctccttagagttgtgagcccttaaaagggacaggaattgctcactcgggagagctcggttgttggagacgtgagtcttgccgaagctcccagctgaataaagcccttccttctttaactcggtgtctgaggggttttgtctgcggcttgtcctgctacagcatcacatgagaagcatgatacagggttcttctttccttagctggagcaccactttagaccatgggatggggaaagccagtcagagacgactggaagaccaccaggccagaacaataagggttaatgcatggactttggctggctcagaaggagtttggctaaagcaagtatgttttggacttcaattaaagacttgaacttgagattgagaaatctttccactgaagctgcccccaaactcctaggacagaggcagatgcttggattgtcagtgaagccagcaaaggaaatcttggaatggtttcccaggaatagagaataagccctgggagacgccagttttgaaaactggtactatcgtgcttgttagagagtcatggtgaggcaggagaatagggaactggggtagcaaagggttgaggcataagcaaaggaacagcagatgcagccagttcgcataagcaagagaacagcaggtgcagccagttttaagcaagattgggcaggacataggctacatcttcactcccgtgataacaagaaagaagtttccacttcagcccctgaatgactgcaggccaagtttccactttaggctctgattggtcacaggccaatccttcatagggtgtaaccaattggaggcctctaaagggtacccaggggtgttgccaagttcttttggctttataaaaaccctaattgaagaggctcttgagctgcgggctccagtccgctcgcactctgtgaattgtcttcaatgaatctgtgctttccttactccgttctcctgttgctttgtttttcgttgcttcattcctttgttactttgtgtgttttgttcaattctttgttcaacacaccaagaacctggacaactctatctggtaacaatggaagagtcaatcatccaaaactcaaaaagaaaaaagaaaatcttattcaaggtctcaagtctctaaatgggcccagttagatgtttgtaaagtaaattatgtgtgggaagcacagagtccaaggaagagcatgttaagtttctgaacactcctaaggaaggaggaggaagacacctcggtctgtttgtgaaaattggaaaaggtacaaattaaatgtgtagatcctgcaactggagaagactcagagaggatgtttatatagggaggaagggaaggaaagaaacaggattggtaggttaccccatccaattccgtggaattgagagctcggaagataaagtggcccagggttttcttccatcagactgaaatgatacagccttcctgttcccacctggatcagtcactggtgctgggccaccctggggcagcaggaccttgggtgagggagttctctgcaactgaatcatcccagaataggctgacaactgaaggcccctgccaactgccctcctagcagctgtggcatcttaaggggaatcaggccagcacatctctgtgtccagcacaacgcaacacgttttgtggacacacacactacatgagccctgaagttcttaccctccacccactcccacctaaatttccgcaggacatcatgatagaattgccgtgcaggctgaaaggaggtgaagagccccctctaagggacctcctggtgctcagtaatgcttttattttcaatcacatactatggtaatcatatcagcacaagcacacaaatgtggttaagtgatgaagctgaatgaaactttcctaagatgtcaatcataaattccatcaaccatactaaagactgatttatcttgctcttctctctggagaaaatattacaagattaatatcaatgaagaagcagaatatgcaatcagaaatacatagggaaaaaggtgggttaatagaagtattttcctggattttgtgatgtgtatcgcatttgtcagcatctttaaatgtgtcattcgttgagacttattttttccttctagatgaatattcgctatcctgcctccttttgggttggtaatttggggttgtctttcttaggcccctgccctggaaactgcgccgggatcccaggcggaggggtgaggaaggcggacctcgcccagcggcgacacccagagcaagtcacgcagaaatctccaggccgcacttatctccggtgcacagcgcgggagatgacacgcatcccaccggatctcgcacagcaccgctgatgaataagcacacagctgtttgtacaactaccaccggccgtggcggccggagaccctccctcccttccgccggacattggggcgtggctggaaactcgggagtggattggccggaaggtgggacgcaaatttgtttgaaaggcccaatcagtgcccggcttctccgctctagccaatagaaaaccgagaggaaggcaggaagggcggagtctcctatttgagtttgtggcgcgcgaggccctgcagtccgggttggcgcttgggtactggctgggtccgatgctgggtrcgctgcgcgccatggagggcgaggacgtggaagacgaccagctgctgcagaagctcagggccagtcgccgccgcttccagaggcgcatgcagcggctgatagagaaggtgcggcccccgccggtccgccgggaggggaggcctgcgtgtcggagtgaggctgggaggggacgtaggacgggaagggaaggsgctctgaggactcggagcgggsgttggggaagcgggactggggcttgratgcggagagaaggtggaggcggagctgggggctccggagagggaaaaaggaggcagcgccgaaggcttcggtgcggggacggggaggaaagactggggcctccggaacggggagtggggaagcaggcctggggctcgggtgcagagaggagggtttggwggggctgggggtgctcctgagtgggacgagagaggcggagttgggggctccgctgcagagaccgcgtttggggcgccccaggccagactaacggcctctcacgggctggcgccgcctcctcccgggtctggggcccctcgtggccctggaacctgacaggaagccccttcctcctccgcagtacaaccagcccttcgaggacaccccggtggtgcaaatggccacgctgacctacgaracgccacagggtaagggtcwtccccaccttctgagtattcgggtgaagagtgtgaatggagtagttgaaatgctgtccctgctctcttaagaagtaaacattgttcacctaactaataggaaccaaaacattggtgcccttaaacctgtaaattacttgaattacttattagaacaattcctgaagagacataggtgcctcctggctcacatgcctccggcttaccgkgttggcatccccgctggccacctccccaccatggcagcgtggggcagttgcttagctggactggtctcagtgtcttcatctgtgaaatgggaaggatgatgacaataatgtctcctgggcgtgggtgttgtaacagtcacgtacaatccctatgaaactgtgaacagtaccccgccccgcactgtgaatactcacattgactattgtttgccctgtttaacttggagtagtaactgtcttccttgaggctccaagtacttgaatagggaggagaaggcattccgtttaatagttaatgtaaacggactgaaatcttgtggattctttttggtaaatagctggtgacactttgcactggctggggtcaattcctcccatatagctttataactaactcagtatcacttaatgaaaacaaacctcagagcaagttctatgttgcattaaacggacacaraaggttcacaagatctgctccttgagttaaaagaaatcctacctttctgcctttatagccaatccagacacatcttgggtgaaaagtttacacaggcagaaactaaaatattccagtggcaggtctgctaccctttggtctctgtataacatgtagattgcccttagaaagcattcattcagtatatgggatgtagagattgcctgcgaaaagtgcttactccctctatatggtatatagattgccctctatatattttaaggacagtcgctgtcatatgttccttgttttcatttaactttttgggctaatgatgtaatttgatgagccgttttctagtaggtaggagagatttccatgaatgacgaatttgccttaaaaacctgaaactttacaaagaggaacaatcgcagggtatcagaaacctggcttggttttaatattgtaccttttttttgcytgtcactttggcatctggtgaacacagattgagcagaagttcagcgttcaggattatgtaaatggtcatttttgtttcttttcttcaggattgagaatttggggtggaagactaataaaggaaagaaacraaggagagatccaggtatttagtgtcaaattttattgccaaataaccttgctgtggaggagtattcatatgaataaaggtgtgggtatgcccaacctctgagcttacgcagaggccaccacggggcactttttctcatgattatactctttctgtttttaaggatttagaagcatttcttctgtagcttgtcaagtgcaaggagtcactgtgtaatatttggcctttttcatcaccctgtgtttcctgtgtcacaggctgaggggctctgataatacatgtgcagaggctgggccagttgggtaaccctccccaaggtcacgtgccagcccagcgaggcactcactttgtttgggtccttacagaaaataccaaatccagttccttctagggaagaagaatgtctctcttcctgttttgaaaggggaggaagagagatgaggrgaggtgcagcctggaggatcacacatctttccttctgcatttttctaccttcggaagaccctggcttccctgcctagttgatccgagggtgttgtcgctctgagacccgttattttagtggaaggtgctgttggcctttctacgggggcatccaggagcccttttgccacagtggcttttgccaggttatctggtattcagttaatcactgcctctcagatgccacatggttcctctctgtggtcacaggtcaaggaacctgtatgaaagaatgaaaaacatcaagatcaatgtgacgatattaacarcaaatttgaaatcaaatcttcttgattaattattctagtcataaaaatgttaaaagtacatacaactacataaatgagctgattcctctctgcaaagatggtcactaatgctattttagtacaatgtgattccctataatacatatctttataaatgcatttttttctccctcacttttccggttaatacatctggcaaactcttctcttcatcaactgttgtataattataaaattatataattatttaaaaaatcatgtttttttaactgctctcctgttgataggcaattagctatttgtggcttcctttattaataaataagggtcagcacactttttccacaaagggccggatgatacatattttaggctttgctggctstatggtctctgttgtaactactcagctctgtgttgcaggaggaaagtggccgaaaataatatgtaaatgagtgtacgtggcagtgttccaataaaactttatttataaagcctctgttagaaatggttttcagagaaaatcccggtccttgtctcttcccaatactgatagtcccccttttcgataaatgctgagaagtgggattatcgggttaaagtatatatactctttgaattatgcataatacagatgtccactcattagaccagtgcttaatatggtcctggtagcaaaaagttttcatttaaagatttatttaaggtttttgcttaaaatgtaggaggaaccctacctgggtctccagaatcttcagaccctttcttgggattaggaaactgggcgtagcctgagatttcagcggggacatctctgacttcactgtaattgctattggtgacagtgtccagatccgccttcaccttttcccagacgacttggtgctcctgccgccctggaggctgggggaggctgtgggccctggcaggccgggtgttgacctgtgctgggttggttataacacaatgcctgggttctgtttgtagctaccagagctaccacatagtttggggttggtgtagatcgtctgcttctctgtgattctcaaaccagsttctgcctcagacacagccacaaaacaaccctgtaaactccaccttacgtgacggtttcactggaagcaaaggttctgatattctggaagtgggcttcagttaccctgtagtgctcctgggtagccccaagtcctctgaaccctcagagttgacacctgaggaccatccctaacggtataggcctygccaccttctcacgccctgtttttataaggctgggtggttcctaaaatattaatatttcagccaatctggtatcctgaatgcttgaatttcattactgagaacccaccgatgccatgctctgggattattcgtggggcctgctatagagcaggctctggagagctgaagcaggcctgaccaggagtgtggccgcccgaccacctctgcccaccaggtatgagctcctggtcaggacaagcagctgcctctgtgcgttagcttgggcttaaactggctcctccccgccttaaatactccagcatattctttaaagatcacaggaagttgcccaggggccacttgcctatttctctgttctcgctgatgacctcaggacaattttgttctgtttcaatttggctttttgtttgccccagtccctgtcatccctgggccactgttaggaggtgtgagcttatctgctcgtgcctgggcccctgactttccctgctccttccaagtggctttttaagtagcagcccccgctgcaacccaggggagcctcagctccttcctacgctcttgaggcctcttataaagtggacatgcagggagaagagaagccttgtggcaggctcytgctgtctcctgtgttaacagaaggattgcagttttattattttgcggtgactttgaaatgtgctgtcactcaarcaaccatgtttttattggcttctgcacttggaggactcytccatgaagcccgcggacaggacagatggctccgtgcaagctgcagcctggggtcctgagcttccctcgcaccgcacagtcctgggagccggtgagtgttgccttcrtcagagaactgaagtcaggagggaccaggtctgacgcacctgttacaacagcttaaagcctagattcctcagtagtgaagtttttattttttctaaggtatatcttaaaaactaaaatcatgttaaagtaccctgttgattccttctgagctctgccttgcccacagttacatccggtgcctgacatatgaatggtactcaggtgttttttgagtaaataaacatgcccctccatgtgaaaagttaatatccagatttagtaagacttaagatttgcccctacagggtggtgttgtgaaccctcacttctatagggcagcttcccacttcgtcctcctaggaggctccttccttttccccaggccagtctcactgcccasccccatcctgtcctcttttctagggaatctgtccctcaccccttccttctgtcttcagtctctgtcccctggatccatccgtcggtatttagatgcgctcagactcacgttagatacatcagacccttcgtggctctcccctgtcctgggccccttccttgccacrtccctttgcccagttccctttaccaccagagtgaaataacctgctccgtttggtgccatggattccctaccccaccaaccccgtgtgttcctcctctcccgactcctttcggctccatctctaaagcccaactctgggtgaggtttctcacaaccccattgctaaatcctgttagcattctttgggttttattctttgggttttgcgctctccattgcatttaaaccttccagaagttctggcctgggcctctgtggccccctgctcctcggccccatgctcctccagttttcctccttctgtcttcgtccttccaagcctgcagtctgctcgcctcccgtccctgctggatgccctttctagagggtttgtttgagctgcctttgcccttcccccrggtggagccatggcttctctgtgtgctgactgtaacctccagccagaactcaactgggggcgttttactgcccagcagcccctctgcttcaatacttcatgtccagacttggcacagctaagactcagcccgacagacaggctccccatcttctgctctgcgcctcagtacaggcccstgccgtcttccctctagcgttagccagaaacccaggatcttcatctcagcctctgcctcattcctcatggccaaggcatccctgtcctgtgccttgtgcttcgttagctctcatgtccccgctgagcaccagcctccaaccccacccgggctccctccgccccactgacgcccctgtgaatgtggtcaagccgcttctctgatgcaacacgtggcttcccattgcttttggggtaaaaggccagaacccagaatggggcctgaagtcctgcctgaccgcatggcctccttgctgcccccgggaagcccctgtgatccccaggctggaacagacccccactcttatctgagctctttagacctgggttcctctgcttgcgaaacagttttgtcactagcctttaaacacctgtctctcctggacactggccttccgcagcctctgtccccctctgcccagtmcctttcctggcaccttgcctacaccaatagttagtgatgggtgttgagtcgctaaagggaagctggtggtctttcagagtagaattggaaagctcttcatgaggatatttacctgtggtgctatgtgtttactgctattaatccagattttaactataaatccttaggtccatgaatttccccaaccgcttgaaatcacaggaaatagttatttgatagatgtactgcccagtatggcacccaccagccctctctggatgatatttaaattagttgaaagtgaaataaaatttaaaatccatttcctcagccttactggccacatcccagctgttcagtagcccggtgtggctagtggctggcctaggacagcaggcagagaactttccatggtcaccggaagttctgtcgagcagtgctgggcttgagcgtctcaacttccaggctcagaggccatggaaagctggaggtggtgcagaatctgcctttcctcactccatggccccaggcagtttcccattctaggggttctctgggttactaagaaccacgggcagccgtagatggctcyagtgggtgcacccttgaagcaatggggatttttactgtacaacttactcgaagtgatgccaaaaccatccttgagaggaaaatgcactccttcctgaaaatcctgattgagatttacttgtttgacttttagattcaaaaagcggtgaggtcgatgccacgtcagaccaggaagagtcagttgcttgggccttagcagtaagtgctgcctttagtaatgaatggacagagggggcgcttgggggctcaggggtccrtcaaagcccatgtggcctgaggcgggcagcgctgcctgcacttttctggaagtcctctcctgaggctggcttttgctacttccargtctcggatttcctcgtgtcgattcccttcagcggtaaggccctcctctcagtctagcacctggcagccagttctacccccagtgcaagcctgattcacgatgattttcactctgcagataaagctgtcagtgtggttggcagggcgccatcygcctggatgagcacacgacaggaaagctgggctctcggtcagtctcccctacaggggcagggtaaaaagagaggtgttctagggagtatttccaggtctgtcctcaaatgccccaagtcacaaggtcgcctcattgggcagccgtcactaacccaaacagtaagtgtcatytatatgtctgtttcccagagtgccccctgggtcacagaaaccacccgttttcttatgggatgtgcttcttatcctccttggttgrgatagatgmgaatttacacagagcttaaccagctccagcatctttcctggcccccgtgtcacactctgttgcctgccagaatacctgrtgcatggttttcctctaaaattgctacttttgtgcagagggtttcccacgcacccatgtgtgactttcagtgactaagaaaaaggccgtggtcctggggaagaaagtggatgctcactgagagattgtgtagggattggaacaaaggggaagtgggtggtaccaagagtcaagaaccaaagtgccagccccactcagcagaggatagagggtgacgccctctatttccagtgtctagcaggggaggggtaggagagcctcctgagctggagcactgaatttctgtttttgtttttggttcttttgagatggagtttcactctgtcacccaggctggagtgcggtggggcratctcagctcactgcaacctctacttcctgggttcaagcgattctcctgcctcagcctcccaagtagctgggactacaggcgcccrccaccatgcccagctaatttttgtattgtagtagagatggactttcaccatgttggccaggctggtctcgaactcctggcctcaagtgatccacctgcctcagcctcctaaagtgctgggattacaggcatgacccatcacacccagccaggagcactgaatttcttataaacttaccagtttgaagttattaccagtagttgagtcctgaactcacctatgaatattcagattttttttttcctggtctagcaatgctgtcataaacttctctagacatggtttttttgtgtgtgtgtgtctttttacattcttttggattattaacatagcaggaagtgaaaaagtgactttgaataacatcatggaggtgaaagtgactttgagtaggatcatgtaaagatttgtacattaatgagcttgccagtttgttccagaagccaaaaggtcagctatactyagaagctcttaaaaattctgacttctcttttttgatcagcctgcagtgcctcaaagccctttgaaaaatgaattaagaaggaaatacttgacccaagtggatatactgctacaaggtgcagagtattttgaggtaatctgtttcccagttgtttgtttttatataattagatcataaactaaatacattgaggtacagtgttattatgctttttgttttttctacagaacccrtaaagagcatttgaagtaatgatttccaaattgttttattcacatgctgacatacttgctcttcttgaataaacactccaggtcccccagggcagcgccatcaggaaggtgggagccctggcaggggtgctctgcccactgttctggggcaactcacagaaaaatctagtggggcagccaggcacagtggctcatgtctgtaatcccagcactttgagaggccaaggcaggtgggtcacttgaggtcaggagtttgagaccagcctggccaacatggtgaaatctcatctctactaaaaatagaaaaattagctgggtgtggtggtgcgtgcttgtaatcccagctacttgggaggctaaggcaggataatcgcttgaacccaggaggcggaggttgcagtgagctgagattgtgccactgtgctccagccagggtgatagagcaagactctatctcaaaaaaaaaaaaatctattggggccacacacgggactcttaagagcagccctgacctctggaccaggatttgaagctgcatagttagggaagcaatagtccccacattccctggtgcgatcaggctagaatcagctgcaaggtgaggaggctgacccttggcacctgtcccgcctgctgagaggtcatgttgggaggggggggatgtgatggcatgagaggtgggcacactcacctgccaacccctctcttaaggtcagtgccctctgccatagaataaaggacattgcaacaccaaatacgtaggaagtacacattgcagaataagaattcatctccagaaaaaggcagcaatctcacaggggtgttatgtgttttcttactgtgctgctgaccagcggaaagcctgtrtttgtggaccaccgacttagtggatgtacctgaaatgctttttcctttaacccaaggcagcaagtggtgtcctcttggttgctgtgttgatccagggaacagattagggttaggaacgaacggatctactgggtcttctttgtccaccgtccggttggcccctaggtgttcttgtggtctgagtataatgctagacaaagaaagctaccagcgcccctggggtaagaagttactggcaggtgagtggtgactgtggctggaagctatcctggagaccacatcaactgtccagatcttagtaggacatattttcttcccactgcccgaagcctagctggccactgtcaccacattcacacgcttgtcgacatggctgtgctaagatgcacagtccgcatygtcaggggagaacccagctccttgcacccagttgacacctggcaacttttttcttgtaaccactggctctgatttcagtgtgcaggtaacagagctggaagggatgtacgtgtgactccgctgccttcactggcctcacctgccgtgcctgcccccggtgagtgtgacatagaaactgtatgaacagtgcgtgtttccttcacttttgttggagctgcgtggcccctcagagctgctcatactggccacgccatcatttcctggtgtgtttcatcaacataacttgttagagatatacttggatttcactggaagattaagatgtttcaaaatgagctgttttctcctccacgtctgctctttattccartttactagcttgaaaagttttgcatctccagaagcacaggactagtacagtgaacacccttcacttgtttcacaattaacatgttgtcatatctgcgttatcaccccctgccacacacgtgcacacacagtgtgtatttatttgcatttgtgtatgcatttatccctaaatgcctcacacatacctccaaaaatcggctaattctcctttatgactacagtacgcttaacacaggccagaaattgaacattgatgcggtactgttctacccattgtgccagtgacgtcctttgcagcctttctggtttgcctgatcgtttccggacccactcaggctggtaccaccgttgcgtttagtctccctccatcaagagcggctccttggcattttctccctcatggtcacctttcatattattgcctttcttgaatagcacaggccagtaattttgcagaatgtccctgaatttggacctgattgcttcctcrtggttaggttcacgttaaacatttttggcaaaattactacagggatgacgtgtcctctcagaacatttggtcagtctgtcccattcttggtgacttttaggctggtcattgagttaaggtaagaccttamttcgatgtttctcattgcgacaggccctttttccctggagtcatctatgtgtgattctttgagatctcctaggaaccttttctctaaaagcttctcacccagtgacttagaagccagcaatgcggatcgcctgggtggaggtccccgcccaggttgtttctgtctctgccgttccttggcacacgtcagttggcattattctgctcaaaagwgctatctcccctctggttcttttttttgcttcctgtagttccctctcatgctttgatttattttatttttattttttaggatcagtaggaattcatggagtctttttgttctttgattcacatgttataatccattgccggtatgcaatttgacgctcaagtaaccccagatttagctgtcagggagcccctttcaggctggcttttgtgtcgtgtagtgcaacgmcatgcgtttttgagcacttcttcacccctgccctgatgccatatctgcctctcccagttctcaccagccgcagtgagttaacacgtgctcatctggtcaattgtacagcataaaataactctagcattgcagcacctgctaccactcttcacaaccatctactaaataagcttgaaaatttccaagcagctctttttatccttagacaatatctctttaagaggcagacactcagagtatttggactctttttttttctctttcagttatcaatttaacatacagatttttttttgtttgtgttcaattttatggttttttcccatcactgttggtttatttttttttaaatataggaaacatttacatgatgcaaaagtcaaagctatatgaagaggtttgtttagaagtcttacaccccttcccatccatgtaggtaaacagtgttgtcatttttcagtttctaattagcttttgaaaaggcatccatcttctaaacagcctagagggaaaggaagacacctttgggaaatgtacgatggagagtagaaatcaaattttgataccaaaaaatatctctgagaagagtctactcctacacatttgtggtgtttttgtttttgctattgcttaaaaaaacatagtcctgatccaatcttaagttctgtcatctgtgcacatggatggtttagaatgrtaacacacctttactttatgtgtatcttttctcccaggatactgcagtcgtatctccrgaaagagtcctggtgacccagcgaaaccagcttcatctcccagagaatgggatcctttgcatccttcctccacagacatggccttagtacctagaaatgacagcctctccctacaagagaccagtagcagcagcttcttaagcagccagccctttgaagatgatgacatttgcaatgtgaccatcagtgacctgtacgcagggatgctgcactccatgagccggctgttgagcacaaagccatcaagcatcatctccaccaaaacgttcatcatgcaaaactggaactscaggaggaggcacagatataagagcaggatgaacaaaacatattgcaaaggagccagacgttctcagaggagctccaaggagaacttcataccctgctctgagcctgtgaaagggacaggggcattaagagattgcaagaacgtattagatgtttcttgccrtaagacaggtttaaaattggaaaaagcttttcttgaagtcaacagaccccaaatccataagttagatccaagttggaaggagcgcaaagtgacaccctcgaagtattcttccttgatttacttcgactccagtgcaacatataatcttgatgaggaaaatagatttaggacattaaaatggttaatttctcctgtaaaaatagtttccagaccaacaatacgacagggccatggagagaaccgtcagagggagattgaaatccgatttgatcagcttcatcgggaatattgcctgagtcccaggaaccagcctcgccggatgtgcctcccggactcctgggccatgaacatgtacagagggggtcctgcgagtcctggtggccttcagggcttagaaacccgcaggctgagtttaccttccagcaaagcaaaagcaaaaagtttaagtgaggcttttgaaaacytaggcaaaagatctctggaagcaggtaggtgcctgcccaagagcgattcatcttcatcacttccaaagaccaaccccacacacagcgcaactcgcccgcagcagacatctgaccttcacgttcagggaaatasttstggaatatttagaaagtcagtgtcacccagcaaaactctttcagtcccagataaagamgtgccaggccacggaaggaatcgttacgatgaaattaaagaagaatttgacaagcttcatcaaaagtattgcctcaaatctcctgggcagatgacagtgcctttatgtattggagtgtctacagataaagcaagtatggaagttcgatatcaaacagaaggcttcttaggaaaattaaatccagaccctcacttccagggtttccagaagttgccatcatcacccctggggtgcagaaaaagtctactgggctcaactgcaattgaggctccttcatctacatgtgttgctcgtgccatcacgagggatggcacgagggaccatcagttccctgcaaaaagacccaggctatcagaaccccagggctycggacgccagggcaattccctgggtgcctcagatggggtggacaacaccgtcagaccgggagaccagggcagctcttcacagccyaactcagaagrgaggtaggtgtgtttctgttggttgaatgtggtttatgtgagtgactgctctttggacagaggctttttatggtaggaatctttgcgccacgtttagtgaatctcarccgaattcttacatacgtgatcattttctgagctttctcccaaatgcttttccttcctgtaaagtcagcgtctctatcaagaatgtgtccctgtgtaagatgcatcgaggtaaagcagaaagtgctcttgcagaagtttcacactttccattagaatgcattcagaggcttttttccygcaaatcctcacttactacgctttattcrtctttgtcaaaccttcatttctaacctcttcatctgacactcagaaaatagctgttgtaaggcgaaagtgatctaaagcgaatgacttcctatttctggattcctggtagggaaagagcaagagtggccygggagagccacgagcacagtattctcacrggtgcgaggggtgccctgcagatatctcagtgctcagtgttaaaactttgcaccttgttctgcagcttaatttgtgcgaatcrtgtcagctagagttttagtctgcgtgtgcccttttctctagagacagtggggtggggtgggtcagtgggagtgagtacctttgttggcattaaaggttggattccccagcacagcttctctgtgtgtccacagtcaggatctggaggatgcgactttcttaacccacaggtggacgggacttgactgtgggtttgatttggccggttcctttgggttttgtgtgtttgtggttccagcaggtgaggccgtgtctccagtatcctcttcccttgtgccctagcctggcgatgtgcctcttctctgaggtcatttgggtggaccctgcctgccataagtgtcccattttctgtttctcccacctggacccgcctggcctgcgagcccttctcagccactggctcctgccgtgcgtccagctcagaaccaaggtctggtatgccttgttccttctgtggtgcctgccttcgaagcctgcagtcccgcctgtgcatggcagagaccacactctcagaccgccagcggcctcctgtggcttgagccccctggggcctttctcactgtcactctgtcttcccaatgcccttggactgctcagggccacctgctccagggtctgccgtaggacagcccttcccttccagggaactttcactggcattctccccctactccccagttctttgctattgcatcctcggacatcctccctagactccacccaccgctcagctgcctgctccgtgcaggtaacccccaccctcccaggggctgcacatggtgggtgctgcagtggggagctgtctggacacagaccagtctcatgggttagcggctcaggctccttggctcagttctagaagctcccaggttttgttggatgttttggttttcaaagttattttcgtgtataaagtcatactgtgtgagctaaccagaagcagatgaaacaagccttggttgtcatctgtcttcccagttgaggatggacatacgtaagtgttcaggtgatgggaaaggtttttctctgcagggccccagctagggtcaggggcactgtgtgggcagggccctcggagctcctcccctggcagtgcacggctaacagcagtctttccctcgggtcttggtctccaactgtgtgcctgatgcccactcctgtgcccacttggggctttttcagaccaaaccaccagccgggtgactttcagccacagttagtgaagccttcaagaatctcagcyacatcttcatggcagacacttcatggaggctgctttgaggcaaartttatgcgttctgttkaacagatgacctctcaagagtctccttctcagytgaaaggggagaatttcaccaaaaacaactgtccggcccagagagagatctgaggtttctcctggtctcccacacatcagagctcctctgctctgctygtcctgcttgtctaaacctaactgctttttctcagatagtgccccagctcttccttttaccatcatcctgcccctgggattttgtctcgtgccttttcccaccttgttccatgatctggcaccgtgccagtcgcctgcagacccctttccatgagtgacatctgccccagtgctccgtgcagaggctcctgccttgctttttcacctgctcagtctaaagggctttcttctggcccagccacacaggagggacctcggccttgtagagaatggtgtgaggttgcattattgtgggaccatcctgaggactcagcccttggtggccccgcagggccctcccagctaccctggaatttgatagcaagtcaaatcatgaacaccccaggtttcattttaaaccacaatataaacatgtttaactggtttcctatgtttttctgcttttcccgcttaaatgatagatttcttgaggaaagagaccaattcttcatgagctgcaactacatatggagttttcatgcctaacgtctgagtgctctctgtgtgccaggccatgctgaaccgtttttacgtcttatcttctttcatccccaccagaaccccttgattagatcgattctgtccaataggcaggctgtctctccttttaatagatatggaaaagtagcttaagtcttagaactcctaaattcactcgtgcagcagcgctagctgggccagggtgtgggatgtggacttccccaccagcttgtgctccctgggggagtgtggggagcagggtcggggggttgccattatatttttgttgtttctttaacataacttacttatttaacgtaatgccactttctataagtatttttatacatgcaatggaataagtagaaaacagttaaccttttagtggctggcattgggaattctagaattttgctaacatcattttctttgtcttttttttttcctagaggagagaacacgtcttacaggatggaagagaaaagtgatttcatgctagaaaaattggaaactaaaagtgtgtagctaggttatttcggagtgttatttatcttcccacttgctctctgtttgtatttttgttttgtttttgattcttgagactgtgaggacttggttgacttctctgcccttaaagtaaatattagtgaaattggttccatcagagataacctcgagttcttggtgtagaaattatgtgaataaagttgctcaattagaatttttagggttctctttgataggcctgtttttctgatgtgtgtgtttttttkgggggggggttatttgtttgtttgtttgtttgtttgtttgtttttgagacagtctctctctatcgcccaggctggagtgcggtggcacaatcttggctcactgcaacttccgcctcccgggttcaagcgattcttctgcctcagcctcccgagtagctgggattacaggcgcgcgccaccacgccyggctaatttttgtagttttagtagagacggggtttcaccatattgaccaggctggtctcgagctcctggcctcgtgatccatctgcctcggcctcccaaagtgctgggattataggcgtgagccactgctcccagccgtgtgttcttttttaaatttagatatgtccagagaatcctctctcctgtttcccatttcattcgagaatattgtttgcttgtgagacgtaagttcgagccctgcatgcaatgacccttgaaggaaaataaacagtcctggtggtcccagacgctcctgcagccacagcgcctgtgactcctcatgattcttactgaagctgttgatgacaggatatcatggtgacgtttttgtaatgaaatatttcacatattcagaatacattggtgaaactcatgctggagtaaatagttaatatatggccatatgagtttgggttttttttttttatgaaagatttaaaatgagattaaattacacatttttcattcccgcctgccgccccaggcgattgctctcctgatgtcaggtatcacccccataccctgccccatatctcttcccccctgcgtcttacattgggaccatgttatgtgtgtgtgtgcgtgcgcacctgcatgctcaggctgccataacaatgctggagaccaggtggcttaaacagtagaagtttattttctcacagtttttgaagactagaagtttaagacaagggagccagcatggttgggctccggtgaggactcttcctggcttgcagaaagctgtcttcttgctgtgtccccacatgctggagagagcaaggtctctggtatcttaggagggcactaatcccatcataagggcccttcactcatgacctcatctaaacctaatcacctccagaaagccccatctccaataccatcatgccaggggctaggacttaatcataattcaatccatagcctgtgagtcagtaaggagggtgcacgctgctgagagccgagaacctcgccaggtgctgcagacctcacagacggctcatttcctcaaagaacaggccggcagtgtaatgctggctcaggctcagccagggccagaatggcccctacagatctagagccttccctcaggcctgctgcttcctaaaggacaacgcgacccaccctttcctcttcaggaaaaccatcactgcaacccagaactgcttgtgcctctccttcccccacacccagcagacagctgaaaccttgctgcccgggccaggcctggctgccagaaaggccggtgttctgtcatccagtggaggaaggtgaggtggaaggatctgggcatgggtcttgccaacttacagatctgccaataagggccccataaactatatatggtatagtctctctgtttcaaactatatgagtaaattaatactgtacatatgctacagttttgtttcatcaagagactgaatatgacaagagctgatagatgtgggcatctcactttgagttctctaggtggtttattgtcctggatgtctgcggacgggtgcaaaatccacccgtgatccttgtgcataactgtcaactatctgtggcacacacacacctagaggcaaattacaggtcacggatgggtgtgccttgaacttccatagttattgccaaattgctctcccaaatggctgccccagtttgcccaatgtcccacaatataagaggtaccttttccccacattatcgctgccagttgctgccagtctgagctctggcaggtgtaagatgtgttgcttcacagtttgctttctcttgatgacttgttgagcatgtcttcctgggagtcctggttttttaaatgtcctcaggacactggttttatatttgcctcttcctgatttggatgtattctggatccaatgatatgaaacaatccagtttttaacttctatcatctatcatttgtcatttaactttgtgttattttattgtatggaagttacattttaacacaatgctatggttcggatgccatttgtcttgaaatttaattgcacatgtaattgttagggggtgggggcctagtggcaggtttttgggtcatgggagtggacaccccatgaatagatgaatgccctcttgaaggagtgagttctcactctctgtgagagcgggttgcctttgcacctgcccactcacctttctgcttttccactgtgtctcgagatagcacaaggccctcaccagaaaccaagcagatgccaacatcatgctcttggactttccagccaccagaattaggagctaaacaaaccttttctgtataaattacccagccttgggtattctgttttagcaacgctaaacatactaaggcagataacttcctccttttttctggcttctgctgttacttttaaaagaaaaactaccatactctcaggataaaaaaaatactgtactgtcttaaattttgctctctccatttaggtctataaaccatctggaaatgtttctgcacaggcatggaaggagagccaattgtacagatgtacagctgcctccttgtactctatcgaatggtgcactctccccactgcatcagtggtgttcaagcttgtttagcagcaatactctttatcactgggcaggaaatcaagtcaccatttgctccacaaaacagtttgaagaccactgttccagagaaggctttagcacgggttggattttggacagcatagcagctctctcctgttgatgggaccccggatggtgatttcctttggcagttggactgggaacagtttggaagtcctggtttacctgctctggggacacctagactattctgatggcctgagcatagcaaaagccttccccacactgcccctctcttcccctacatgttcttagacatggggctaatttctcctttttgaccagcagccaaattctgttccaggcctcactgggctccagttgcaacagtccaaacttaactttggtaactttaagtcgcaaagggaagggcctggaataaatgtcagttcctccatgcggcctttctggattgtctccagacttgcacacccaccctcctgtgccactgtagcacttgcaccctggctgcagtcctccctctgatgtgtgttgtggttaggtgcctttccctttaagaagtgtcctggcctggcacggtggctcacgcctgtaatcccaacactttggaaggccaaggtgggtggatcacgaggtcaggagtttgagaccagcctggccaacatggtgaaaccccatctctactaaaaatacaaaaattagctgggcgtggtgctgcgcacctgggctgaggcaggagaatcacttgaacccaggaggtggaggttgcaatgagccgagattgcgccactacactccagcctgggcgacagggcaagactccatctcaaaaaaaaaaaaaaaaaaaaaagaagagtccctggagacagatgggacactctaggcctcccctcaccgcttggcacagtgcctggccttaggcacgctgtcagcatgcgtgtggatgaactccgagtgaagacacaaagctagtttccgaccctttgggccagtgggctgtcagacaaacgtacttggggggaaatcggaaatgaagtggctcattaaggccaaagttccctttgcctcattgtcttggttctgggctgtcaccaccttacagtcacaagtctactccaacgacagtggaggtttatttcaacggaaggaaacaaaaggatactagttattttacaatagtgtttttcctacaaactaaacttcttacaaactaaattaaaaagggcttgcatttggcactaagaagacagtttacgtcttatgtttggaccacctaggacattccttggggtgaagccagaaacccatgctgactacagctatccaagactgtgagcgtctccagggctgccctcctgaccccgggatccgggtccagctgtagttcctggagggctgagagagaacacaaagagggaaggttcaggccccgcccagtcaggaccacatgctgcatgccctgggcagtgatggcaggcaagggccgcagaaggtgggcaggggcagacggggaaactcctgtgtgggaaagcagaggactgcaggtggagctgtttcaacacacatcatagctctcagggcttcagtaaccaccctaacagggacagaaatcacccacagaacctgatagcagcatcaggccaaaagcatttcataagaagctatgaatgggagaaacagcccagggaatgaaagggactccacccatcaatagctgtcgtcctggaaaggcctccccaggtgcatctctctgccctggttgcactcccacccccccgaaaccccacagcaaagggtcctctggctcttcccttgaagcagtttctctaagctcccctagtgagttggtgagtcgtggactcaacatctaacactctccactactcacaattccgtaatgctgggaagtccagctttttcagataatgtgtagacatctgcttcataataattcctaaaacaatagccaaagaaatgctcatcacgcgagtattaggtcagcaggcaagtcgtcctgtggtttacttactttacgttatgagagcattgatgaaagattttgttgagcccacgttggcagggaggaagccaaaatcaaaacgggatagaaagcacagtgcagggcttagacctgagctctggtctcagcttgccacatgcctcccactcatgatccacccttcccccgagtgccggggtggactagagggccttcaaagtctatcttgagtcaggagacgtctctctgctcacctgccaagttgcaagcagcgattctgattcttgacaagttatttttaacataggccattgtttctagcaagaagcggtagagaacagccggctttttccgagtctgcaaaaagtaagtgatacacactttttgctttggaggatgagaccctgacaatgggctgtcattcaccaagcgtgttcccatcaccaagatgcatcagagagggcaagcgcccatcccagcgtcacacagcaggtgagtagctggcaagtgaaggaccactggccaccagttatatttttcatatcccatctgaccagagaacctgtgctgtccaacatggtagccacaagccatgtgtaaccctgcagcacttcaagtgtggctggtctgaattaaggtaaagtgccccctgggttttaagatggtaccccaaaaattgtaaaatatcacaataatagtttttatactgattacatgttgaaatgatcatgttttagttatttgagtgaaataaaatacatgaaaattagtttcacctctgcacttttctggatgtgcctactaaaagaaacatcagacagctgaaataggcacatgacttgccttctatttctgctgcacagtgccggtctcgacatggcatgtgtggaaggtaaacatagggccccaagaaagagctgtggcaatctcgaccccccagctccaagccagcgtgtggccacctgggacgggctggttccccctttggcttcctcaccaggatggagcacatggttgtctggaaaacggtcatcttgtcatcagtagcggtatcacttggccctgagggatgctccagggacttccagccccagaagtgcacacactgaaacatggtagccatacaggcctgcagggacacaggacggcagcagagccatcagccaggccacgtggttccccagaggggtgaggctggcaggaagccagagggcagccccagaaaagcctcaccaagccaaagaaaggcagggctggtggctcctgggaggccacctgggacctgggcccctgccagcttgaacatggctgcaggtacatttatagaaagccccttgggggcagatgcagccccacccgccccctcagccagcaccttcgtgccctcagcagccctgcctgggacccagccctccatgggatcagaggcgggagccgggcttgagcaggcaagactgggcacgtgtcctcacctcccaggcccagtccaccagcatctgcctgtgaccaagcctgctggccacagcttctggagacggcagggcaggaagacaaaatgcttctgtctcggtagccctttcctcactctcggtcaccattgctgggtgcaccctggttccttccctgaagcccccccaccccactggacagttgtcgataaaacatggaagaacagtgtgggctgaagacagagggtggtgaggactggcaaggaaaaggagcctctgggcagtgacaccttgtgcccagggtggccagggatggtgtgg

SEQ ID NO: 12505 - DNA, 13363 bp, Homo sapiens
tttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctatatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacacagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctataatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaa

SEQ ID NO: 12506 - DNA, 15043 bp, Homo sapiens
tgtcctggtctaaatgttcttgactccttaatctcttcaatccctttttccctgagtggatgtgaatactacagggagctccagctcaggcctctccctgacagaattcagattccaaggactctcttaacagagttgcaagtagggatcatgccaagcccaatctaacatgccatgtctctcctgctatacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagagtctgttttccaaccagtgtggaagcaattaaatatacgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacacaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcrtttgattttttttaaggaaacttcctgtttaatggaatctgaatccaagatttgctttaatttcactctrttcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtstacattctacaaccagaccctagactttataccaggctgtgccacttcctcttcacttcactcagaggatggccccaaaactgaaaaggaaatgaaatmatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagamgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaatgcatcggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcaggaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctcttaaaaaaaaaaaaaaggaataaaaatgttctctgccttggataacatttttttttaaagattccatacaaactcattccctgaaagagaaaaacagattttctaatcaggacattgtcctgatctgcaagcgaggagtttaacaaggtaggcagagaacttccttatggaacaacagggctctgtgaccagaaaaactatgaccagcctcctctgaaaaaaggtggggggattatagggcaccagctcagccgccaagttcaggaagcagctgattcccaagactcttaggagatactgtccattcttcctcctgtccacatcactccccatttaactgcaattgctcccttgccacagggaaagcagcaagccccaggcccaggcctccatttgatttgccactccgagaactgtctgcttcattctgcttgaggagatatcttcacctaatcctagtgttaattattttaatctgagcaacgcttttatcaattagatagaaaccagcattccaaaataagtcccctaagtttgtagtttgagccaagatattttcttgagccctaagatatatgactttattagctaggatttttcttatgattaaaaacatccaaaaatgtgatatgtggtcatctctcagggaggtctaggtccttgcaggctggattttagaaatttctaagattctctacaacttttaaattttatgttatttttcaatcataatttctttcctgtggcttctatcaccattggagttagaatctgacaacctttaacttcacacttttatgagataataagttggtttcttgggcaaaggttggtttgtaagccatttacatggattgatgatttctgttcttgttttcttctaacctagaactcaggtccacagttttccacaggctaatggcactatgaaacagatataaagaaaaatagacactgttctgagtttctcttgagtgtttttgtgctatgatctgatcatctattggttacctttacacattacattcctaaatcttctatcctgcctctgggatattagaaacttgtctttacttgtgtatcacattactttgctaatgagctgggaaaattcccaaactaaagacccggatttcagtttttaaaatatttaatcacaaaatattgggactagtcacaggcacacatagcccgggaactccttaaacacctgcaacaaaaagaaaagaatagaggctacaaatgcaagcgctggaatagaaccaactgaggtccaacctgtgcaccaccagttacatgctgtgaggccctgcgttggccacttaacctaaaactcactttcttcacctttaaaatgggaacaataatagcaacaaccccgtagggtggttaggcagagtgaccaaattattgtgtatgaagagaatagcccgtgtctgtccacaataggcatctgataaatgtcaggtctcaccatcgttgtcatcattagcaccacatacaagtgcattccccaaacccaccacatctgagaaactgaatctttcagggccacatgctgagaatacactggtgggtgctccccttctgttaatgaaacacagaggacgagttgatccttaggcaagtttctaaggaaagggggatacatttaaaaagcaaaccattactatgtagctattttaaaataatgctgccactcttgcatcagaaacaagtcataattttgtttattcttcatttctcatttccatattcgtttaataacaaaatgggagaaacattagtgggagatagtaattgtaaaagtagcaataaagttaatggcaacattaaaaatactgtacacctataaacacggcaatattcaaggcaatttgaaatatcaagtaactcacaaattgatgacacatgtaagtgaaccatacatttagggtcagtggcctgttagtccattagaaaaaaggaaaaataataataattctgtttaaagaccattcctaagtggtcaataaagaatgattagttcataaaacatcaactctggacataaataaattgagaaaacctttccaggagatcgccaggggaacattcaggataccagaaggcaaaacaatgtaagactgaagccaagcactataaatccatccagaaagagggctcccatgcctcggggcactgcttccagatccccatcctctgcttctgcaggcaaaatcatgggtgtgtttaaaatcaacaataataactatagccttcatctgctgatctaaatgattctacaacacacaggaatcatagagcccagaacgttggcttaagggagagcctaggtattgattctgccagagtctatttcatatatgagggatctgacatttggaaaaactctaaaatgggttttccagaggccaagaaagtatcctgtgaacctggactgccatattaggctcctgagggtagcctcagcaaccctagcacaaccgtccaaaaaagaaggaaaaaataactgaaacacaccccaggagccttcttttgctcatgtgtccagaagactcctttgggaacctaatggaagctgtgtatcctctcccttgaaaagggtaccaaaaaatctgagtgtttacatcctccagtcccaacctgagcctgtttataacccctgcaacagtagcaggtggtatcatggaaagaccaggcataaatgagctattttcatcaaagtaattcaaagagcgagctatgacagttggatcaaactattcaggcctggaaatagaggacggaatccaggctgatttcctgccatgttggaaatactgcttgcctctgtgaccagatcagatggcttgacaatgatgggaatacagtgtggctatctgggaggtggggtggaagagaaaagggcaacttatataaatatagctcagtaaatacactggcataaggcattaggtagacctgggtacaaattctagctatgcatttaacagtgaccccagccaggttacttagcttgtaacccttgacttccttaactgtataattaggataacaagactaaccttgcatagttgtatttaggattagggattacacacatacacacacacacacacacacagagagaaagagagagagagagcgcccagcatggtgtctatcacatagctggtatgcaataaaacatgactgctattattgttgttcactcattcattgaatgtatttattaaccatttactatggtgccaagcactagggttttaataagcaagccagatgaagcagtgtccttaagttgttcacagcctaatggaagctacagataagaaaacaaaccactgcaccatggtgtaatctttgtgagggtgaggaattttcagggtactatggaagcccctaaaacaacttggggagtcagaaatggcttccagggagaactgctatttgagacaaaacctaaagaataacaagggttggctgggccataaggatggggcgaagatgtcaggtagaggtgcaggaggaggtatcttgctctagttcaagagcagatatttgagagagcttgttaaaggacaggctggagagtgaagggagagcttacaagccatttctcagagtttagccttcacaccatccctgtattggcaaacagcaatggcaagtattaaatcatggggagattaggcacagacaacacatcgataaaaccaaaccaggtttacttacctgaataaggaagaaactcaaaatacagagataactgtattatccaagaccaagatacaagcttctggccactgaattctgcatgagagggtacacagctaacagtgaaaacatgaatgagtaaaggtcacaccagaccctctggagacctgattttctcccccatttttagcctaccacagagggtctcatttaattctttcagcaacataagctccacatgtctatacccaccagtggaaggcagtcagtttgaccagccctagtgaagccttcagacgttccctgctgattctgcactgccctgagagacccaagggaccgtccgtacgatacctttcaagtttcctttaagggcatatacagctctgtaatgaacatcttcagcttcttcagaacatttctcacaggatgagccaaggaccaaaagaaatcagaccacagtctcattttctagtaagaaaatcctctgatagaatcatggccagtggttgagataaattatagaagcttgatgtatgtcatcaaagcagtctttgcttcattaaaacacaataatggtcccttaaaaataggattgtgttaataaattgatgcatgaacaatttccaggagcatatcttaaagtgaaactcacctcaaatatttgtctaaggagaagcaaactagtggctgtggtaaaactggttaaccagttctacttaaagtcctctcttgtattaagtccctttgcctgggactctatttccctgttatatttctgccccagacctatcagatcacctttcttattttccaggcatttggaaactatctttttcaatcacttttcttttgttcaatgtggtgtgcgtcataaaaataaaggagagggtctccatagatagactgtaattgtgaacagtttcaaagaagttttaaataactccctgattcttagaatcaatttaaaataagcgatgttgtatgggcatgagtgcttcttggggagattggtaatgctccctcggctagcagtggagtagctgagctaacaaggagttcctggtgccaggtgggtctttgcacactgaattcgtgtctgtagggagaagcagctgccgctcagatctgaactgggaagagatgactttaaccttgggcaataactagagttctgaatggcagctgctctgcaagattgaggaaataacagaggttctcaggcagcataattggataccagcataagttgttgttttgttttttttttaagagagggagagagaaaaaaaggtatggaaaagagaggaagaggaaggagaagaaaaagaagaaaaatggtaactggcaactttaccattatcaagcatcacaatctagtcactaagcatagaagaaaggttcttttttaattagagaaataagcaggttagtcacacactaatcaagacctatttttgcttgaattaggtcagtcttcgttaaatgcctctctagaaataggcggaggtcgaactctccatgggtggtttgcatggatgcagcagaggtgactcacgtttgccgatcttaagagctgtacagatggctgggagcggccgattaaaacctccttgacaactcctcggagactgaagaccacccacctccatcttcactgggagcaaatggactgtagagtgagcaacatggtttctgacctgatcctcaggccagggggtaaacaaaggcagcttgaccttttgctaaacagagtgtccgggaaaataatcctcagcttgttttgaatgcacgctggacagagaattactggtaattttgtgaaccggtaggtctctgcactgcaataagaagccaccgtaactgggtcctcgtggtgtgactgattcattttcagtctacccagactgtcctggttttaaaatggaaaatcctacaacctgggaatccccttagttcactgcaaaccaacaattggtcatctttgctctcctcacaaagagtaagatgcaaggccaaattttggcttgaatgatgttccaggttctccacagttggtgaaaaatcattgaatgagaaaatgtgcaggatgaaagggatattagtaactacctgatccagtagttctcaaacttcagtgtgtatcagaaccccctgggctgcttattgaaaatgtaaatgtctgggttctattgcaaaaatctgattccatccatatgtcttaggtagggtcccaaattctgcaattttataagcaccttagatgactctgattatacatggtccaagga

SEQ ID NO: 12507 - DNA, 88017 bp, Homo sapiens
  misc_feature (1)...(88017): n = A,T,C or G, or insertion/deletion polymorphism (see Tables 1-2)
ccaacagaactttctgcaatgatggaaatgttctacatctgctctggccaatatggcagccactgaaatatgactagtgtgactgagaaactagatttttaattttatttagttttaattcaaatttaaatagtcatatgtggctagtggctgccatactgaacggtgtggatctagatgaatgaaaaagtactgtttctacaaatcctgtttcaaaagtgaaaataactcttggggacattatgttatgtgtagtaaatggacttttgttacatggaggcagaaaggtaacatcctgattgtgtgttgctagctttacctatatggacagaatgtgtgttgcttgcaatggaaactggtgagtgagtggaatgagtgaagactgcaggaattacaatgttttactgcaggaattacaatgttttactgcaggaattacaatgttttactggataacggaaaaaaactataatagaaaactagctgttaagtatgagaatttgatgtactcttagttcaaaatggttgccaagagtgctccaggtaacttatgttgtagattagatttttaaatgtgaaaactatttatactggagaaatttataaccaactaacttttatttagtatacaaaatttaaaaaaattgttcaccagtttcccaaagtaaagcagaatagtgatatgcctttacctgggttccaagtgtcctactctacatagtgaaccagataaatactgctttgcatttctttcttcgtctcatcattccaccgcttttctccatttccttgccactgtgtgttggtatgcagtgaaactcacccaagggtttccatttttaataaatttatctatcctctcaaacttttctctgaacacatattgcacatgcttgctttaactgaaacctggaacttaggtaaggaagatatttgcaaacaaagccaatgttctctctttctattaaaggggctaagtcctaagtaggtggtggtggtgagggtcatcatttttcttctacaccatcttaatgtaaaaatactttctaaacttatgccatctggcccagtggttctcaactgggaggcatttggaaatgaatgggagtattttgttgtcaaagtaactgagcggtgctattgcaagacatcctcccataagtctcgattttctatgagtcttagaagcaaaggcactgattatcttttttcccagactaccttttcaagggagcttgtataccaagcacccttggaagacagaaatggtgtcacctcctggatcgcatggcagcccttattgtacagtgtaataaataaatgtctacttatggaacaaaagtcaggcaggtttgcctactacccaatttaaaaatatttgtatttcctggctggatttggtggctcacgcctataatcctagcactttgggaggctgaggcaggagtactgcttgacaccagcagttcgagaccagcctgggcaacacagcgagaaccccgtctctataaaaaaataaaaaaataagccaggtgtggtgtcgtttgcctatagtcccagctagtcatgaggctgaggtgagaggattgcttgagtccaggagttcaaggctgcagtgagctacgatcacgccactgcactccagcctgagtgacagagtgagaccctatctctttaaaaaaaaattatatttcctgagcttgggttcctcagctatgaaacaagtacattccatgtgcagcatctaccaaggcattacataccacatttcaccattcaattttactgatcaaacacttacaggttttggtttctctcttgagttacattttttcaaatgctttgctagttgatcttcatatactgtgctaaatttaaagagaaaattatttcaaatgagacttgtgccaattactgtttccagcacaaaaaaaaacccgtatctgatccacacttactgttttggatctaaaggacacaggattcttttccgagcatcttcttcctaataaattaagagatacatttatttaaataaaatatcaagtttattgcttacagataccagatataacttcagtgtctctgtaatctcaaaacaaggtaaggaaaccttacaaggacataatgaaaagttggcaaaatcaggtcccaagggtttaacaaaaactctccagtgtactggcttaaatacatatgaacaaatactgctttggacaaacaagggtctatagcttcaaacagggtatagagaaggcctacatatggtgtctgaaatctaagatagcatcaactattatatgtatgactattttatgcacaaccaagaaagaaaaaaatgctgcctatttcatgttaattgacaaatagttgtatatatttatcacatattaggtttgtacaaaagtaattgtgatttttatggcaataaaaataatatacactattatttatgtatggttttaatacaacataatgttttcaaatatgtatacattgtggaatggctaaatcaagctaattaacatgtattgcctcacatactaatcattttttggaaaatgctgcccattgacatatggattttaagatgtatcctgattttagaatgttaaaatgtaaaaataaagtttcttagaaacaatggaacatggcattttaaccatttggatgtgccatattttactggctttgcaactttttactatcagttacatcctactcattcctaagttacatcacttaatgactgggaatacattctgagaaatatatctttaggtgattttgtcattgggagaacatcatacagtatagtaacacaaacctagatagtatagcctactgtacatctagcctatatagtatagcctattgctactaggctgtaaacctgtacagcatgttaccatactaaatactgtaggcaattgtaacacaatgtaagtatttgtgtatctaaacatatctaaacatagaaaaggtacagtaaaaatacagtattataaccttatgggaccaccatcatatatgcggtctgttgttgactgaaatgtcattatgtggcacatgactatatgaactgggaaaaaagaaaggaaaattgataatgttggcaattctacccaatattccacatgaatctgtataaataggggtcatataacagttaagaacacaggccagccagactgcctaggtatgatacccagctctacctaccagctacgatccctatgaccttagttaggtaggcttactgcctcatctgaaagatgagaacaaaaatatgtcttaccttctaaggtttgaacacattaagtgagctaatagttaacaaaacaaaactgcctagcccagtgctgtacatagagtaagtggtgactaagtgtctgctattattattcttttaaaaatttatttctgttcgaatgtgcctctcagcatgtccatgaagctattcacactgaatttcatgggaaagctaagaaattttttttttgaaaatactatatattcaatagaagaaaaagaaaatactgtatataatttcttccttattgctgactttaaatcctaacctccatgtaaaagactattctaacccccagagcctaactgtagcataggaaaaaaaaagcacatttaaaatttattagttgaatttagaaacaggaattctcaatcttggcactattgacgttttgggcaggtaattcttttgagggggtgagtgcagggggctgtcctgtgatttgtaggaggtttagcagcatttctggtctctatccattagatgtcagtgatactcctcagtttgacaaccaaaatgtcttcattttgccaagtgttcactggaggcaaaatcagtcccagtcgagaaccactgggtaaaaatgagtggtgtcatcacagctatatatgacacttagaaaaaaagatggaaacacaacatccagttacatcataaattacagattcaggaggatagccacaatttaaaacgagatagtagtcaataaaagtgtttccacttgatgttttgcggtctctcttcaagtgtctaatgacaatatgtcgttcctctataggaatactaatcagcttgtaaggatttattcatattctactatcatcactatttgttttcaccttccatatatctggataaggtggagtctaaatccttctcctatcataactctcattcttcaacaagggatgtttgccagtcccctcaaaaccagtcaatagactatgggcataattcagagttcccacaacaaatcacgtctcccatattccaaaacaagaatgtccttgtttcagtatgcttcacttttggtaaatgccagtcaaaacaaaataggaagtagactacaactatgatggagagtggcagatgaagggggtcaggggactgatctgcactggatattgtctagaagaataaattccttaagaaataaaataatgcaaataatactgaacattcagaagcatgaaatctgatgctgatcgctttggtttattctttatagttctgtggaactataaggacatgctctcttcctatgagcattttgctcctctggtttttattttcccatctcatatatatcctaaagtaatatacatatatacaaatataaagtgtttgatagtacatttatatgcataattatcaaacaaaattgtatgctttgttctcaattgtaaaaggtcaattcgtatatatttaaaaatctttccttcccattccagcaaagttgcattcttaaaaactgtaagtcgaaaaaaatttttttttcttttttgagattcagtctggctgtcacccaggctggaatgcagtggtgtgatcttggattattgccacctccacctcctgggttcaagcgattctcctgcctcagcctcccgagtagctggggttacaggctcgcaccaccacgattttcttaattttagtagctcgcgccacggctgattttcttatttttagtagagagagggtttcatcatgttggccaggctggtctcgagctcctgacctcaagtgatccgcccgcctcggcctcccaaagtgctgggattacaggcgtgagccaccgcgccgggcctcaagtctaaatttttaaaagaaagtttcttccaaccgcattcacgagaagtgcttctctttcatgaaataacaattagaacacaactagtgaaacctttgggacttcaatcactactttttctaaactaccactttccagcaggaagacggagcggtagcttggggtaaaaattaaaacctagcattaccatgagttaagatcgagataaatagatcaaaataaatgggtcactgctggcgctttacttagaaaaataaaaaatttctcatcactagaactcataatcgctccgcaaggagggcaaaactgggtttattaaagtgaaagctggagaatccaggggacacaagcagaaagctgtcaaagaggggaggggccgggttccagcaccgacaggaccaggatacttatttccgactcttgagagagtagggcgataccacacctccatggctccagcgtgttcaccacaaaatcttttccctgcggccaccaccatcctgcagaaccgtttcttcttttccacatagtaaccgcatctaccctcagctggaaaaccaggcgcgtgcggcgacgtcgcggaggtcgccataattctagggctcgcttccggtgtccagcatccggcaaccagaagaaaagttagaagcttccttcgggtctccttcccttaacaaacatggctgcctcagcccccgcgccacacaggttaatacccggaactaccacaaccgtcttccctttatcctccgcagaaccggaagaatccgatggtggctggcgagggccaagtctcttacgccttcccctcgtttctccctccccgcctcctccgcagaagccgagcgccaaactcaaactttatcaggacccggacstctcaggctaatcccgagggccgggcctgttgggcttttctgcacaccagccgaggcagcgagccaacatgagccaagtgctgttccaccaactagtcccgttgcaggtgaaatgcaaagactgtgaggagaggtaaggyccgcgtcatccagtgcccgcgggtggcggttggggtcaggccaatggggaaagatggcggttctggcccgtgggatccaccttgcacctaggtgtcgagtcggcccccctaggaagcggatagggaacccagagggcccggtggttacctctctcaccaagtcggccgttgcagaggggactggaggaagggtgtgaggagttaggaagccggctcacatcaagttaatgtcaaaaaccctacctgtgcacggaatcgtgaagattatagccctactcttcccttttgacagataagaactctggcccagagaagttaaaaaaatttacgtgagggctcacagccagttcatggcagggtcaggactagaactcaggccttggctccgagcctttccccctcgttctcttttgaagtatgttggcagtaaagttcaacttttaaaaacctaccaatttggtggcgtactttggctcttcacatcagttgctttaaaaaagtaaattacatttaaccgactaaaaatgagaaaagcagaaacgtcattaattcattcaataaatattgcctccttgtaaaacaccttactgggcactgggaatacagtggtcaggaaaaacagtccttttcttcatggagtttacaatcactggaggaaataaagaccagtcgcacagagaagtgcaactttgattaaggaggtggtattattggggcgtaaatagatttgaccagaggtcaggagacttactttttttttctcagttctaacactcaatggttgtctctttttttctctgaacgttctttcctcatttgtaaaactgatataacatgcgtattcacgtgtttgtaatgaggatcaggtgtgaaatcttttgcgtattcacgtgtttgtaatgaggatcaggtgtgaaatcgtatgtgaaaactaagtggtgtacaaatgtaacataaaaaatgaagacattgccttattgagttgccagtaatgtcaaactgtagtatatatagttcagaattcggtcaaaaatcaatggcaagccggtcaaggagatggtcccaaaaccagcagctgcatatggagatctgtaggtttagttgatcattcttttaatgctgtccagtatggtagccactagccacatgtggttattagacatttgaaatggggcttatctgaattgttgtgctttacatatgaaaatgcacgttggatttttaagacttactatgaaaaaagaatgtaaaatatgtcaatttttatattatgtgttaaatggcaatatttttgggtatattgggttaaatacaatgtattattaaaattaatttcacctgcttttaaaagtctttttaaaatgtgacttctagaaaatttaaaagtaggctaggtatggtggctcacrcccgtagtcccagcactttaggaggccaagacaggaggattgcttgagcctaagcttgaggttacagtgagctaykatttgtgccactgtactccagcctgggtgatagagcgagatcctgtctctgaaaaaaaaaaaagaaaaagaaaaaaattaaaattacatacctggctcacatttgtggcttacattgtatctccattggacaacactgttttagaatgattatagaaagataaaggaggccatgactttggtttcaatatggaaactcctagatggtctctttctggttacattgccatcacagttaatctaaaaactcaatttctctgcttagaaacctttaatatattcctattatctgtataataggggtcagcaaactggagcacatgggccagttggctcactgttttcgtaaataaacttttcttggaayacagccatgctcatttgtttacatattgtagctgcttttgcacaggaagggcagagatgagtaattgtgacagagaccttatggcccgcaaagcctaaaatatttgctatctggccctttacagaataatttggtgatccttgacctataggaagaacaacccagactctctctctttctctctctcttttttttttttttttctagacagagtctcgctctgttgcccagactggagtattgtagcacgattacagctcactgcagccttgacctcctgggcccaagggttcccctcaccttagcctcctgagtagctgcaattacaggcgcataccaccacgcctggcttttttttgttgttaatttaatttaaaagagacggggtctccctgtattgcccaggctggtcttgaacacctgggctcaagtgatcctctcaccccagcctcccaaaattcggggattataggcgtgagccaccacgcccagcccagacgccttggttgagtatttgaggccagttcagctcaacaaatactggcaaatgtctgctgtgtctcaggaactgtcctaagtgtggaggatgtaaatacgcacccccctctccgtccccaacaacaacaaaagccaacaaaaacctcttttcattctgtccctcaaggaactcacattttaataggggaaataagattttccttgaacaggcaccatagcacagattaggagttcaggctctggagccagattgcctgggtttaagtcccagttcttccacttactgacagatcttgtacaatttccttctctgtgtctcatctttaagttgatggtaataacagtacctacttcatggtattatgagaatggaatgaattatacatatgaactgcttacaacagtgactagagcataataaatgttcactaaattttaggtattaatgtgtgacaaatgcataaagtaatataagtacactaaagtcagagaagaaggaaattcagttgaggacagtggtaatgatcagggaacttcatctggtggaaaattatgcaaaattttggaacccatgatttgacactaatctgccttttcagttttgtttcctaagcttatctctccaatatgaaagtcatacaagcattcttgttaccttctgaatatacctgatactcattctatactattacccctgctgttccttgtgcctcaaatgcttttttctttcataactttcaggtatgtcttaaatcctttcactataaggacccttcaaagttgcctaagttgaaatraattgccattattcagttattagatagtgtggtgtaggtgaaagatctgagttttcatttgggctctgtaatgtgaccttaaaccattatttgggccttaagttcttcttttgtaaaataaataatatttacttatcaagattattgttaaataagatgatatatgtagaatacctggcaggtactcagtagtgttggtaacccttccctcccctctcatggagccctaaaatgcaatcagaagcaaatctagcaaaaagtcattaatctcatctcaatttgaggacagagaccatggttttttttgttttgttttgtttgtgtcatcctatgttcaaaaattattatttttttttttttagagagaggctgtcactctgttgcccaggctagagtgttgtgtcataatcatggcttactgtaatctcaaactcttggtcttaagctctcctgcttcagcttccagagtacatgaaactacaggcatgcaccaccatgcctggctcattttataaattttttgtagagataggattttgctatgttgcccatgctggtcttgaactcttggcctcaggtgatccacccacctcagcctcccaaagtgctgggattacagatgtgagccactgcgccaagcccctggaccatgtttatttctgtttgtatccctagcacctggcacaatacctggcttaaagtaccttttatttgtttgattgatagtttaagagcacagctactgggtgtcagagatggcctagaatccagttgtgctaaagcaagcctgatgtttagaatactttttatttagaagaactcataactaaatctaatgtcattagtattagacatctattgagtacgacatctattgagatgagaaataacattttattgagtttttattgttttatattgctcttatgacattaaccattataagggaaaaaataagatttgtgattttagttagcgtatcctctgaaagcttgtatttttctacagcatatttctagggatgttttttaactaagcatggggaattcgtttaacttacaggccttccgttttttctttcaacatctaatgtatataggcatttggaatatatgcaacaatatcattaatatgattggtaaattgtcatagtaatataactcttccaggattatgtaaagaacactttgataagtgaattcttcttgtactttttgcaaatatatgaagtatgacaggacttttaaaaccgtaaaacaccgtctaggtgcagtggcccacgcctgtactgctatcactttgggaggctgaggtgggcagatcacttgaggtcaggagtttgagaccagtctggccaacatggtgaaaccccatctctactaaaaatacgaaaattagccaggtgtggtgttgtgcccctgtaaactcagctactcaggagactgaggcaggagaatcgtttgaacctgggaggcggaggttgcagtgagccaagatcgcaccattgcactccagactgggtgacagagcgaaactctgtctcaaaaataaataaataaataaataattaaaataaaaataaactgtaaagcaccataaaaagttaaataccaactgcagtatcataccactatggcatttatactagagaaaacttcagaagatgaaaaccaaacataatgatgtagagctaaaaaggttttcacaaaccttctagttgaatccacttatcttacaagttcggaaactgagtccccccctcccccaccccaccacgaaagcttaatcttgctgtgttgcccagactggacttgaacccctgggctcaagctatcctcctgcctcagcctctgaagtagccagcactacaggtgggaggcactgtgcccagctcaggaaagcttaaatggaattggagtaacactctaatctgtttcacatatgttgctttagatactagaaaaatagcaacagtgtattctcttgttttgaaaataattcttcctctctctggtgtaaaccagtgcttcttgttccttttcagaaaacagatacaagttatgaggtaacatttaaccttattgtacaaacggagatttagcatccaatcatagttcaacaagaaacttaactaaaatgacacattttaaacccatataaaattacaagtcagcattaaaaaatctaaacaattgaatctagccttgatcaactgtttccaagttttyctatcagtactcaattgctgtttrtactttttacttgtgtagtagataagcaatagtgtggaaaaggtttaaaagaagtccttagaagaaaaacttaaaattgaacaaattctatttgttagtttacttttttctacctgcacatcaaagaaaggccattgttatttaattctggcagaatagtttgagaagtacttgtgcataggtattttttactaatttctccctttattttctgaattatataagcatttgtgctctatttgattaaygtttatgagcactttcacctatatacctctgtccaattctggattctctaagatacagcataggatgtggaacactgtggtctctccctctcagggcttaaagttactttactcaaggataaaataggtgtaataaacttgttgataatacttctgtggttttattacataaagaatatattaagcagatttaattcgtggatgtgaaaatacgtttttgtatgaataaatgtagggaatatgttatttccttgattttaaacattcaaagcattctaatatcgcttcacatattaagtttttattttattttattttattttttgagacagggtctctgttgcccaggctggtgtgcagtggtgcagtattggctcactgcagcctctgcctaccaggttccgcatttctccaacctcagcctcccaaatagctgggactacaggtgggtgccaccacgcctggcttgtttttgtattttttgtagagatgaggttttgccgtgttaacaggctggtctccaactcttgacctcaagtgatctgcctgcttcagccacccaaagtgccaggattacaggtgtgagccactgcgacgggccacatactaagtttttaaaatgcaatcagtctctcattaatcagtttgattacatgacatggtaattttttaatgtgaaaagttgttactaaattggtggtttgtctttctagatgttattttagaatcagggcagtaagggtatatgaggttcttacctcatttaatcctcaaaacatccccattttacagttgaaaagttactaaattgatggtttgtctttcaatagatgttactttacaatcagggccgcaaagtcatatatcaggctagtgctaggcactccacagtgtttatttcatttaatcctcacgatatccccattttacaggtgagaaaaatttagttttaggttaaacactgctagattactcactagtggaacaagaagaaattaagcttcaaatccggtgtgcttttcaaacttctgttcataagttagagaacacctgtggaaagtcttgtcacttaagactgaaaacttaatacaaatgatagtgataactcatttcgtgtgaatgtttctgatggttgggtatgtcttttcctacaggagagtaagtataagaatgagcattgaactacaatcagtttctaatccagttcacagaaaggttggtatttagtccttttttgaaatatcatttcggtacattgtagacaattagttttgttctttaagaatgtgacatcttttattgcatttattttgcttttacattttaggctattttgcaactgttggaaatcaagggtggtggaatctactgagacaacaactgaaggataattatactatatatttctttttttttttttttttttgagatggagtcttgctctgtcaccaggctggagtgcagtggcacgatctcggctcactcacctcccgggttcaaacaattctcctgcctcagcctcccaagtagctgggactacaggcatgcaccaccacgcccagctaatttttgtatttttagtagagacggggtttcaccatgttggccaggatggtctcgatctcttgaccttgtgatctgcccacctcggcctcccaaagtgctgagattacaggcttgaaccactgtgcccggcctataccatatatttctaaaacatacgtgaaaaattgtggggtggggtgacattctccttagatttgcccagtgcacttagaagttgcatattatatatatataataacatatatataaaaatatattttattgctgttggtcatacacacacacacacacacacacacacacacactgctgccttgtagaattggcatttcatggtataaatgtaaaaacaataaaccgaagtactgcagggagatatttgtgaatcttttactttacgttttgaagagaggcatttagagtatcagtctcatataaccttcaaaagtgtgagtcattaacagaactaaggatatagaatagaggaggggtccccaaccccctggccacttactggtacggtctgtggcctgttaggagccaggctgcacagcaggaggtgagtggcaggcagggaagcgagtgtaacctcctacgatccacctcctgtcagatcagtggtggcattagagtctcataggagtgcaaaccctattgtgaactgtacatgcaagggatctcagctgtatgctccttatgagaatctaatggctgatctgaggtggaagtttcatcctgaaaccatccttcactccctaattcttggaaaaatgtcttctacaaaactggtttctagtgccaaaaaggttgggggccactggaacagagaactaagaaatacggcatctgtgccaagggcagtgcctcacacctgtaatcccagcactttgggaggctgaagtaggcagattgcttgagccaggagtttgaaaccagtgtaggcaacatggtgaaatcccatctctacaaaaaaatacacaaattagctgaatgtggtggcacactcctgtagttccatctacttgagaggctgaggtggaaggatcacttgagactgggaggttgaggctgcagtgagctgtgagggtgccactgcaacctagactgggcgacagagcgagaccccatgtcaaaaaacactgaaatatagcatctgttttctgtgtgccatagctttccctgaacacattcaaggacctagtagtattaatagtacctttggttttttaagtagcatcctgggtgaatttcaggaagtacttaaatagaagctgcttaagaacaaggcattctgaggcagagcaggtgcctaaattactaattttccaragtagagatgatatattatacttcttacatgttattccttatgcctgctgtacctcttcattttctagcttggtgcataagtggtttagatttttctaggatcttagcatttcctcagtagacatgagtagagattttatttcaaatgaattcttaaccttaatgcccagttctttattagttttacatcatcttgtaactaatgctgtttttctttcaccagtgttctctggtacataattttggtgtactttttgtgagctctagctgttatgatggtctcccacactatgtacacgtagctacctggaaagtgatctttatgaaaggtacttacttcatttgagactgaaaacagttgggcttccatatcagtggccacctggcctaggagagaataggctctttggaagaagcctggcaacgtgttacctgataccctggtcttctgagagacagaagctcttttttctagtgtggattattgtcagttctgctgatatatttgccacttttgaaatgccataccagttaactttaaggaaactaaaaataaaattgaatgtggtatgttcagtggtaaagaaaattttcatcatgttatggtgtagcaaggactgggtctaaatttccccaagcctctgataggaggatattcctaaactttcaactcctagcacttgcttaacttttacagacctccatgtggcttttaaagagcggaatgtctacccctatttaagattctaactctctaaagactaataaaaaaccagcagcactagaaaacaaagctgtctgcaatataactatgatacactgatgttgttggatttctttacttctgagaagaaattactcaaamggccagatctagtaaaaacatttaaaaacaacaaactttcttttaggacttagttattcgtctgactgatgacacggatccattttttttatataaccttgttatatctgaggaagattttcaaaggtaactaaatttttttctgatcttatatttagtgaaaaaataagtttctaagttttattggtactgttctctttcaaacacatacctacatattagatttagttactttgggaatattgggctatttgtactrtctttacttagggtgttttggaaaataaatattttgtgggttattagaattctgcttaaaacacctgtgaagtttgaagcttttgctgaatttattgatttttttttcccattgaatacgttctataaaaatcagagttccttagcttagttcttgattataacaagcgttagtaaatttgaaaaaagaatccttcaggatgctaattataattaaagatagtrattggccaggcacggtggctcaygcctgtaatcccagcactttgggcggccgaagagggcggatcatgaggtcagaagttcgagactagtctgaccaacatggtgaaaccctgtcttaactaaaaatacaaaaattagccaggtatggtggcatgtgcctgtaatcccagctactcaggaggctgaggaaggagaatctcttgaacctgggaggcagaggttgcagtgagccaagattgcaccactgcactccagcctgggtgatggagtgagcctctatctcaaaaaaaaaaaaaaaaaaaaaaggcaccaaaacaaaacaaagttaattaaaatttttaaaaaatttcttttcctttcttctgtatagtttaaaattccagcaaggtcttctggtagacttcttagctttcccacaaaaatttatagatctccttcagcaatgtactcaagaacatgccaaagaaattccaaggtaagttgcatgagaatgctacattattaaatttaattcaagacagactcttctttgaaacacaagttgatggcaaaatcttttccgtttattatgactatccctgtttatttttagaactggggttaggcctccattaaatctcagactttaaggcatcttgattaaaatcagaaatatttcttaattttcatgtcttgacaaaggcactaaagtcatccgaaatatttagcagcatcaaatatttggttttataatgatattggaaaaagggaagactaagattgtatgtgtgtatggtgctaacgcctgattcttttactgtaaagttcaccatcaaccttttatttattggttttatcagttgacgattgttgttgaatcagttatttcattaggaagaacaaaatgatgcttctgtataattttttctatattaagtataattcttctataaagaagaacttttcctcagcaattagggctatttgattactcagaaaattcataaaggataaatgcttaattcttgcatttaaattgtcaatttttagagtaaagagctggtagtctacttttgtggcactcagtgaatttttgtttctagtttttgctttttctctcatttgtttctcatgaactcatggacttttatgtagtcactgtgtttcagtcaatcttttctkttttttgcccaatttatcttttaccattgggagtcctcaatgtgctccctttsctgagctttcttaagtagagaagcttctgattcagtgagagattttcactrtctcttaagtgtgttataatgtaacattttcttttcaaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggtaagatttaaatttaagttattcttttaacaaaataagtatcaatggtctttgataaattattgaagagatacattgccataagtttttgttttctaaataaagttttatgaaatataacgaatttattttactgtttcttatttagtcaaggtatagtcgggatggatctggaccaggaattgagaagcttaggtctcagggtttttaccaatcgtgtgattttggacaggtcacttaaactcttctgtcatggtttcatcaactggtagacatgtatggaaatagctaccctatctagcccatctttttttttttttttttttttgagacggagtctcgctctgtcgcccaggctggagtgcagtggcgggatctcggctcactgcaagctccgcctcccgggttcacgccattctcctgcctcagcctcccaastagctgggactacaggcgcccgccactacgcccggctaattttttgtatttttagtagagacggggtttcaccgttttagccaggatggtctcaatctcctgacctcgtgatccgcccgcctcggcctcccaaagtgctgggactacaggcgtgagccaccgcgcccggccctagcccatctttaatgagataagatatatggaaatgtcttgaaaattataaagtgctatatggcacaaggaaacaacatagggatgctgcttgagtttttagagtctttctagtcaaatgctatagatcagtgcatgtcaaactttaaattatctggggatcttgttaaaatgatttagatttgagatggascctaagaatctgcatttctaacaggcttccaggatgatgctgatgctatactttgagtagcatggctatagatgattacattgtaaactgtgtaattttattatttttatgaataggaagaaaaattatcattgatgcaatcactagatgatgctactaagcaactggactttacacgaaaggtaattcaaatttcattttgyctttgtaagtcatccagacattggcactgaattgcttccttgactcagttccaagcttttatgtattttctttcaaagcatgcttccgttgaatttccattcctctttgccacccttcaactaccacttaattatcttaatttgatactttctcttgtacatacttgattttacacaaacatttctgtatccccaatatataacatgttccctcgagtcttcattaaataagatatgtatgtttctgtcatatattagttctccactccccacttgttcgcctcattcctctggcctaaatggcttttcagttcctatgctctaaacctttccctttctttgctatgtttagaattaattcctctgataggcttagcatcatttcagtcatagctacaacatttctgccctagttcatgaaattgaaggccagagtatctgttttagcttgttcttgctttgctttaaagaactatctgaagctgggtaatttataaagaaaagagatttaattggttcattgttctgtaggctgtacaagcatggcaccaacatctgcttggcttctagtggggacctgaggaagtttacagtcatggctgaaggcaaaggggagcaggagtgtcacatggtgagggtgggaggaaggaggtaccacatgcttttaaacatccagatctcatatgaactaactgaatgagaacttgcttaacaccaagggaatggcactaaaccattcccatgatccaatcacctaccacaggccctgcctcctctgttggggattacatttgaacatgagacttggaggggacagacatcctaactatatcggtatctgataatctgcatggcctcatgcagaaaatacccctgcacaatgtggcccacagggccatgttactgggttttatatgtaagtgaactattccttataatcgacttgcttccccttacccctctttattgggtggtaaagagccagatttaattaaaagctttaattaaaagatagttaatcttgacctgtgggccgttttgggtctaagattgttcttattctaatgttgatttcctaaaattaaaaaattttgtgtaggaaaaggctttgaacatgtcctgaaaagctataattttgttttctttaatatccttgtaaatattgctatattctaatcaaaaktattacatattaaggagcctatcttaatattttgtgttaaactctaatgtagacattagcagaaaaaaaacaagaattagataagttacggaatgaatgggcgtcacatacagcagccttgacaaacaagcattctcaggaactgacaaatgaaaaggaaaaagccttgcaggtaagaacattaaaggaaactgaaaaaatatcttttattgctgttagtcattttgttaattttaaaagtaatatatgcttgctttaaattttccaaacgttacagaagtatataaaataaaaataaaaatcctctctttcaaagtcttactacctagagataatctataaacattttgatgtatttttttcagacttttctctaygtatatgtaaataatatgtaatttataaatatttgtttataaacttataactgtaaattatgtcatttatatatgtacccatataatgggtttttggttttgttctatactaatggggtcttattggatatattgattgtaactttcttcgcttaatgtgataccattctgtatcagttaagatattcctttttagtgactgcagagtattcattttttgggtttaacttaaattatttaactacttgcctaaatggtggtcatttaaatgcttcgaarttttggttattttaagcaatactgcaagaagcactcttagtttctagaagtgaaactgcaacatatctgtataaaatattgatggatactgcaaatttgccacccaaaaagactaaaccaaatggaatcccaaagataaggtagtgtataaggatacttatttccccatattcttgacattgtttttaaccttcttaattcttctttttttttttgagacaaagttttgcttttgttgcccaggctggagtgcggtggcacaatctcggctcactgtaacctctgcctcccgggttcaagcaattctcctgcctcagcctcccaagtagctgggattacaggcatgtgccaccatgcccagctaattttgtatttttagtagagatggggtttctccatgtcggtcaggctggtcttgaactcccaaccttaggtgatctgccttggcctcccaaagtgctgggattacaggcatgagccactgtgccctgccacgttcttaattcttaatatatgccacctgatcttaaggtagtactagttttattttatatttcttgtattttttgtgaagataagcatcttttaatacaactttttatcatttttatttcttctatggattattttttattttcttttcatccctttttctgtgtggttattttttttttttcactgtgccctgccaccttcttaattcttaatatttgccacctgatcttagtactagttttagtttatatttcttatatgttttgtgaagataagcatcttttaatataactttttatcatttcatttcttctgtggattattttttattgtcttttcatccctttttctgtgtggttgttttttttttcattttttatttttagatggagtctcgctctgtcgctcagactggagtgcagtggcactatctcggctcactgcaacctctgtctcctgggttcaagcaattctcctgcctcagcctcctaagtaattgggattacaggcgcatgccaccaccatgcctggctaattttagtatttttagtagagatgagtttaaccctgttggtcaggctggtcttgaactcctgacctcgtggtccacccaccttggcctcccaaagtgctgggattacaggcatgagccaccatgcccagctgtggttgttattttctactgctttgtagtatgaattccttttctacctttcgtactatagcttctttttttttttttttgagacagaatttcgctcttgttgcccaggctggagtgcartggcatgatttggctcattgcaacctttgcctcccaggttcaagcaattctcctacctcagcctcccaagtagctggaattacacatgtgccaccatgcccggctaaattttgtatttttagtgaagacggggtttcaccatgttggccaggatggtctcgaactcctgaccttaggtgatctgccctcctcagcctcccaaagtgctaggattacaggtgtgagccactgtgcccagccttatagcttctttaatattacattttattgttgtttttatgtactttactagatgcttgctcttaagagtacagcttgatgatttttttaaatgtgtaactttcacccaaattaagataaagaaattggaccacccctctaggttcccttgtatggcttcctagtcctaacagtagtccataggaggttatcatacttctgacttacatcatcattcattagttttgccaattcttgaactttgtgtaaatggaatcatatatgtttgcatatgtctttcttcactcagcataatatttctgaaattcacctattttctattgtttccttttattgttatatgaatctgccataatttattttcctattggtaggcatttgagttgtttctggtattttgctattattagttaaactgctattaacattcttgtacttatctttttgtggacacatgcactcatttttcttggatatttatctattattggaatggctaggttgtagtatatataggcatatgtttagctttggcagaaactaccagtttcccaaagtaggtaggtataccggtttacattgccattctatgggtatgtaatactatctgataataatgaacacttcttcatatacatatttatcacttgaatattctcttttcaagtgcccattcaagttgttagcatgtttaatttgcctattattagtattattatagatttgtaggaatttgtatattctagacatgagtcctttgtcagatgtatgcattgtgaatattttcattgtctatagcttgccttttcactttttattggtataaattaaggatatacaccttatctatcatgtacattataaacatttctcccagcctgtcatttgccagcatcttttgccgtatatagtttttttaatttgaatgtcatcaaatctgtcagtcattgcctttatggcttaagatttcatttcacatttggaaagtgtttcccacccgaggactatgaaaaaattctcctatattctaatatttgtttaattttcttgttatatttagctttttaatctacttggaatataattttgtggagtataatataaggtagaatttttttgacatatagtcagtcattgttccccaatgatttaaaatactacctctattattttatttcatttttattttttagaggtagggtcttgctctgttgcccaggctggagtgcagtgacacgatcatggctcactacagcctcaacctccagcgatccttctgcctctgcttccaaagtagctgggactgcaggcatgtgtcaccacaccggctgattttaaaatttttttgtggagatggggtttcactatgttgcccacgctggtcttgaactcctggcctcaagtgatcctccttccttggcttcccaaagtgctgagattaccaacatgagccactgtgcctggtactacctttatcacatactaaatttctttatgtacttgggcttgtctttggactgttgttaagaactgatctcattttctcgttcagtggagagatgtatctcttcatttattaaggtcttatttgttgaaacagacttatttactctctctctctctccctttttctctgttctctttttcttttgcagtcttgttaaacagtgtttttggctagggactttacagatttttactgcataaatgagaccatccactccctaccagtaccactgtggttaaatttataattgtttatcagtagtgtatgttaatgtcatatccagccaccttactaaatttacatactgtttctaagagttttggaattgattctcttaggttttccaggtagatatgtaaactataaaaattagtaattttttctcttcctatgattagtgtccttttttttcttgcacagaaaaataatagtggaatttttatctttttccagtcttttttggtaaataactaaaatatctcactgttaaatatgatatttgctttgcatttgagagaaagggttttcttctcttccttgctacctgagaattttaattcaaagagtgctaagtcagataaaatgagttttgggatctaaccaaataattacgtcatttttcccctttaatagtgtagtaaattataacaatagatttccaaaggtggaatcatctttgcattcatagaataatacttaaatagtcatagcgatttttaataaactattgtatcaatttgctattatttaacttgggatttttgtatttttatttatttaattttagagacagagtcttgctctgttgcccaggctggagtgcagtggtgtggtcccggctcactgcatcctcagccttccgggctcaagtgaccctcccacctcagtctttggagtagctgggaccacagatacagaccaccaggcctagataattttttttatttttatttttattttatttttatttatttattttttttttagagatggagtctcactatgttggtcaggctggactcaatcttctggcctcaaatgatccatctgccttggcctcctgaagtgctgggattacaggcatgaaccaccatgcctggcccaggatgtttgtatttatattcataagtgacattggtctgagattgtctttttcctgcacatcatagttcgcttattgcaaatgtgggttatagactatggtattagaattatgctagcctcatgagatgaataaggacatttttcagttttctttattctttgaaacagtgaaataacagggaattaatctgtaccttgagggcctgatacaattagccttttaacaccatttggatcactcacctagttgaagcatttatctttttcttttccagttttctccatgattattggtctgtttaaattttctcttcttgagttttgctaatttatattttcttaaaaagccatgtgtttcatctatgtgtttttatttttaaaatttattatttttttttatttttgaagatgaggtgttgctatgttgcccaggctggactcagactcctaggtttaggcaatcctcctgcctcagctcctctagagtagcagggactactggtgtgtgccattgtatgtggctgttatctgtgtgtttaaatatattagtacaatatcgtgcatattgtcttgtgatttttaaaatctccatattatttctcttatgttcttaatttgttttgtttaaygcgactagrtggtttttctattgtttagtgttttcgaagaactagtttttcatttcattaattagttctacactgtttctccccctatttcgttaatttctatttactaccttttcttttttttttggcttgattttctttttttttttgagaccgagtctcactcttgtcacccaggctggagtgcagtggcatgatctcaactcactgaaagctctgcctcccgggttcacgccattctcctgcctcagcctcctgagtagctgggactacaggcacctgccaccacgcctggctgatttttttgtacttttttttgtctttttagtagagacagggtttcaccgtgttagccaggatggtctcgatctcctgacctcgtgatccgcccgcctcagcctcccaaagtgctgggattacaggcgtgagccaccgggcccggccttttttttggcttgattttcaagcaagttgtgttcttcttgacgttgttgttcgattcaggggtacatgtgcaagtttgttactggatatattgcttaatactgaagtttgggcttctgttgaactaatcacccaaatagtaaacatagtactcaataagtagtttttcaatctctacctcactctattcctccctcattttggagtactscttgtctattgtccatggaaacaagttagatctgaaagtttcttcataagggcatttgtttaaaactccagagtgactgaaggatttgtttgtatttctgtattgcactttctgataggattgttaggcagcccttcgggactttaaaaccaggtcaacacttctcttcctgctaatagataatgtaaaactttagtgtgcgtgagaatcatttgaagggtgcattagaatgcagattgctgggcttcatccccagagtctttgatacagttagtcgggggtggagtccaggaacttgatttcctgataggttcttagctgataccgattattctgttcagaggaccgtactttgataaccactgccatagtgtgctctttctcaaattaggccaattttgtgactatatagaaatctgctgaggcaggtaaactgccttctattattactgatggtttctacaaatgttatagggaataatggctgtattatctatatttgtcacttatctattcaagtggacattaaacctgtgttatctttaaggcattttaatagggcaaatttgattcttgcattttttatttctctttatgtttacacttatttctcatgttttctttatacctccatttaaaaaaatatactgagtaatctgaattgtttctacactaatttctttgtagaagctttttttctgtgaggaaagtcctagcaacacgtagaatcacccatcttccttctatttattgtattattttcttaattctgacttctatatttcatcacttcttcatagaattttttattaatttttgttttcccattcatatcattattattccattcccaaaacatttttctcatctaatattcttccaaaactactgtgtgcttttctgatttaagcctctatagaatattcatttgaaaaatattgcttccacctctacaaattctcccttttctgttagactctattattttgaaactgtccttccaatgattattttttttcctccagaatggaaaatttttaatgtatttttttctaaaaataatgaaatgattcagaagggaacaaagtagaaaatgtgaactttataatgctagttctcacactttttttttaaacaaaaatctccaaggttctgatgagcactggaataaaaaccagttctttattttcactgcttttggcctctattgtctttagtgtctttgattactctcttagacagttacagttagcatctttaccagtttgctctgatttttcttcttggttgcttcttcaatgttttcttccaagatggcattttcaattttatatggactgcttcctgttttatctctttttgctccttctcctctccttttcagctttctgaaaatgaggaaattcctgaagtagtaatgtaaaattcctaaggtattttatgagagagacactcccctgtactagtgctaagacttttgaatgggtataacttctctgggatacagttttggaacttgcatcaagctttatatttgtttatattctttattctataattgatcataaagaaataatctgaattttagatgtatgtctgtgcaaaaaaaatcatcattttatttataattgtgaaaaattgggaactaaatgtccgtaatagggcagaagttaaatgaattatggagtaaccatggatggaatgttgtgtagctattaaagactttacaaagaattttttaatgatgtgagaaggtgcaaatgctaagggattaaaaagtgtgattaaattgtataaatagtttgatattcattcattaaatttaatatgtatattgtgtgtttatgtggatgtcaatataagtatataaacgagtggaagagagtactcctaaatattaggagtgatttttctggatgggattatgggttatttgtgtttcctttttgcctgtaagagcatgtataactttgataaccacaaaaatatgctttattttcaaaagatatttaggatttcatagtgttcgttaacaaaagttactaagataggtttgtgatacgattcagacaggcactaaatattgcacagttataaccatgttcaaattttattgttggtaaaaatgactataagattggactaatgaaccaaccttgctcgttttacaattttaggtgtttttccattataaagcatatatacgagtatttattattaaaaactgaaacactgtgatggtgtttaaagcaaaaatctgctttttttttaatacacaagtaggttcatcctgtatacagtatttgcagtttgcttttttaacttatatagcatcttcccttaacttgaagactgttgcacctaaacatatatggatttagaagaagcaaaaattatgaacaagatcatggtggtaaatttgcttttgttgaccttgctttctccgtcatgaaattcataattgaaaatagacccttttcagaatggggatctaaagaaagatgacaaaattaagacaaaaaagaaaaagaaaaaataagaaattacaatttttttttgttcaaatctttctgtatttgtatttctgatttttttctttgaattttggtactgtatttttattgtatcataggcacaggttcaatatcaacagcagcatgaacaacagaaaaaagatttagaaatcctccatcaacaaaacatccaccagctacaaaacagactgtctgagttagaagyggctaataaagacttaaccgaaagaaaatataaaggagactccactattagagaacttaaagcaaaactttctggtgttgaagaggtattgaatgttgttttttttcctcccccaatttaagagaacgttttgatttggttattttaatgtggttacttgtgtgggtggtgttcctctggatgctcttgtggtgttagggtatccattcagacaatgcaaagaaaattgagaatttgaaatttgataaaaagcataattcataacagaactgaggtaagcttgaatatttttagttagggtcttgagagcagattactggcacagctgtcagatttatcaatatgtttttaatagtaacacagcacctgtatttcatagggtactgtgttgacagggctggggttttttttcctcaacctgcttaacatatatcaaacaattatgtgaatttagtatctagtaataataatgataatggtaatagtaaagataatagttaatgcttactgagcattttctatgtgataggtactgtttgaagtgctttacatatattaactcattttattgttacaacagttatttaaggtaggaactattattagccctattttacagatgatgaaactaaggcacagaaaggttaaataagttgcctaaggtcacatagtcaaggagtggaagaacaaggattagaactcatctattatttgactatctttaatactaccttgttctttcaggcaacagagaaatttttattttttattttatttattttatttaagttccaggatacatgtacagaatgtgcaggtttgttgcataggtaaacatgtgccatggtggtttgctgcacctatcaactcatcacctgggtattaagccccacagaaatttttaaaatcttgctatagtgccacatttgttgttgctttgrcattgattacaggcttctttgtagcattatatattattgtcatatgaattattagaaaatatatgtagattttgtctatatttaaataccaaagttaccagtgttattctagctcacaagacttcaaactctattttaccagtctcatgcttagaagctctaaagcctgaccaattttgtgttcagatcctcatattgttttgccccaataatagatgtcttctgtttttcctgcatacactcttcatactggttgtaaagcatttgaaccttcatggtacattggtagtctaaatgcttcagtataatgctctgatttcattattctcagccctggaactggtcattatataaacaacctcattgcattgatttttatatgatctaatgaaaatatttcctccaagattttcataagacttgcaaattgttagttcttggagcttttttttttaactgctgagtattcagttacctattttaagtaacaatttttaggcattagtgtcctaaaaataacaattgctaccatttattgagttttactgtgtgccagccaaaatgctaggcaatttacgtaaggatttttatgaaggttaaatgaaataatttattaagtatttgttatttctgttttacaaatgagggaactgagatttaatttagggagtttcagtaattaccaagatcacacagtagaagagccaggatttgaattttgtttgatactaaagtttgtgctcctaaaaccactatagtcacaatactgtataattatttttggaaactttggttaagaactaaaactatctaggaatattgtatcctgggctttcatataccagcagcatttgggttgatattagctgattgggaagagatctattgtagattttttaaaaatctatttttaatgaacaattattgtttattttgcttgaaagagtgaacagagagatctggaaatgttaacatttattgacatagaaagatatttgtaatacgtgaagaaggtagattataaactgcagagtatcaacctttaaaaaacaatctgtacatgtaagcaacaaagaaaaatgttaagtctacattgtggcrgctctcacccgtggttacccttggaatcagttgtggagacatcagaaaattattgttaaaagttttaaagttactgtaatttattcataaattagaattattttcccttgatatgattgaatcagatagtagaatattttacaattatattccagatatatgctactataccattagaaagacatttatgcttttaaaaaaaaatctgtactaaaactttaaaattattaaagacttttttttaatatgttagacatcttaattataaataaccagatgaggcagcttccttttttcataatgcttaatttctttcttttcccattctaggagctacagcgsactaagcaagaagtcctctctttgcgaagagagaattctacactagatgttgaatgccaygagaaagaaaagcacgttaatcagctacaaacaaaagtggcagttttagaacaggaaatcaaggataaggaccagcttgttttaagaacaaaagaggcatttgatacaatccaggaacaaaaggtctacttttaaatttttctcagaaattgataatcatatttataagtaaacacaamtgccctaattattcatgtttttaaaaaatatatcaggtggttttagaagaaaatggtgagaaaaatcaagtacaactaggaaagcttgaagctacaataaaatcattatctgcagaacttctgaaggtttgttttaaaaattttatagactagtatttcattaaattacatagaaatatacatatgaagctcttttataggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtagttaatattttaaatttttatgttgtaactaaattttttcctcgttttaaaaatttatgctttgttacattaacaaatggctttggtcttgtttttttttttaacaaaagaacatgactagattgagtagatggtaataacctgtttcagtttggaaagttagttatcatgattcagataccttgattgctcatgtatgtctatgtttgtatacacatgtaaatattttattacataattgagctaattcctttattctcatttaataatagtagtagtaaccatttatgtaattatttagttaataataatacattcttcagtttttatttaacctttattttgcttgacttattgtgatgattgatatatttcaggtatgcaaattacaagaacaattagaagctacagttaaaaaacttgaagaaagcaaacaacttctaaaaaataatgaaaagtgtaagtatgttacgtgttaatgtaaatgaggtttgtagttttattcttttatttttttgagacacggtctcactctgtcaccgaggctggagtgcagtggcatgatctcagctcactgcagcctccaccactttggttcaagttatcctcccgcctcagccccccaagtagctgggactaaggtgtgcaccaccacactcagctaattttgtgggttttttttgtagagacgagattttatcatgttgcccaggctggtcttgaactcctgagctcaagtgatccacccgccttggcctcccagattgctgcgtttaggtttacaggtgttagccatcgtgctcggctgtagttttattcttaacctgaaaattttattcgaattcataaaagtagacattggccaatatataagtaatttctgctttaaatatactgtcttaatgccttttctataataaatttatatcatctgcccagtaaaagagttatcatctttataaagaaaaccatatcccataggtcagtaacccacaattaaaactgttgaaaatgttgactgtaatttattgtttaaattcttcattattcctttttttaatagctgtgtttacctaataataacaatatgaattgtttgaaaacaaaacataaaaataagattttaactaacattttctcagtttatactactgggtatcatacataagattgtgaattttaagtaaactgtaagatattctagaagtgaaatctttcraagagttgcttgactagcagaaatatgtgcttcggaaagtaatacaataaggagtcctatgtggcagcttctaaaataagaaactttaatgacaaaaatttaggtgaacctatattgctctcctgtgatgtcaggtagttgtaaaaacttataatttaaaaatcttaatataatttttaaatgtttaagatgattagaaaaataaacagtcaatattctttaccttgcttcttgttcttttatttaagtaatcacgtggttaaataaagaactaaatgaaaatcagctagtgagaaagcaagatgtattgggaccttctactactccgcctgcacattccagcagcaacacaatcagaagtggaatttctcctaacctgaatgtggtaagatttaaaacaagatgtgagtgatcttagtgaatttcctgaamcaaaagtatttccagattgttaggaagtttccatgatttaaggtgctgataccaatacaaagtggagtcctacaattgcactgaaatagagtttaagttgcccctggaagtggaacaaaggcacacttgctctgaacagaggctgagtttcaagagcacatttcttttttttgttttgttttgttttttttttgagatggagtctcgctctgtcgctcaggctggagtgcagtggcgcgatctcggctcactgcaagctccgcctcccgggttcacaccattctcctgcctcagcttcccaagtagctgggactataggcgcccaccaccacgcccagctaattttttgtatttttagtagaaacagatttcaccctgttagccaggatggtcttgatytcctgacctcatgatctgcctgcctcggcctcccaaagtgttgggattacaggcgtgagccaccgcacccagccaagagcacacttctttataagtcttgactggatattgaaatctttcaatgctaactaaagtaataccaaatatactgaaaaacttgaaaacacataacgtaaaacatttaggagacttgaagaagagagaattcagggtttaggcttaagcctaaactgaattctatcagaaaaagaaaagaaagtaaaaaagaaaaaagtcctattagcaggcttgtcacctttagattctacaagaaactggttatgagatataaactttctagctcccaggaccagatttttttctcttttgagacaagacctcactctgttgccgaggctggagtgcagtggtgggatcatggctcatggcagccttgacctcctgggctcaggcaatcctcccacctcggcctctcaaagtgccgggattatagctgtgagccactgtgcccagccctgcttttttttttttttttttaacctgagaaaaaagggaggctgggcacgatggctcatgcctgtaatcccagcactttgggtgggaggctgaggtgggtggatcacctgaggtcaggagttcaagaggtcagcctgggcaacgtggtgaaaccctgtctctactaaaaatacataattcagttgggtgcaatggtgcatgcctataatcccagctactcgggagactgaggcaggggaactgcttgaacccaggaggtggaggttgccatgagccaagatcgcaccactgtactccagcctgggcaacagagtgagactctatctcaaacagaaaaaaggcagaataggaaaagcagcttcttacattcagaggtggtttggtactatctgatagttaggcctaggtgctgctaggagcttacctagcatccgcacataggcctggggctctcctgttgaacacaacaatttcatggaatattaacatcaggcaaggttactctgtgactctgtcaatacaaaaacaagactgtttcataatcatgcctgaatacagacaaaaatatgaacattgctaaatcacagatatggcccataagcatcctcatatcctggctaacatgaatggctgctgctgctttaattacagctttgaccttaatacattcctcttgctttattagataggatttattcagatacccagtcatacatttatccccatttcccagtagcttccaatccacagcaaagcaccacttaaactttttcttaaatcacctaacatgtgcctaaatccaataaataagtcccttttaatacccacttttggagatacccatgtttgttcatggtgtgcagtttcccttgttgcaaggagcaataaatctagctcgtatatctatacatgggttcctggtggtccttggctacaggacattggcagaaggtttaaaattcagattcctaattgaatttttaacctaatctactctggtaagtcagagtacgggatgtctaaagaaggggaaagattgctgttaaattggagaagggtgcagaaagaagtgcctggggctgaattacaaacttaaaaaagattttttgtccggcttaaaatttgaatgactgatgatagctgtgtgaaaggtgtttttttgtgtgcatccattagtgtgcacaaatgcttctcaagatttctgttacaactggtctcagtataaaaataaactttttcataacgttggttaatgtgtggtgccagtatattgaaaattagtggcaaaaccaattactgtctcaattagtccatttaagaacactgatcttgtttttatgcagtctgacagaaaattagttttattttatctctgattggcctattgatctccagactcccccattccccccttttttaggagacttagagtgaaacaagttggttcagaagcttggctttaacttagtacaaaggcaggcccagtagtttgttttatccaagcttgcacacctaccttgaaaagccctctagttcaaagttatcctagccccatggtagataataaagcagagttgtgtggcatgataaacaagactggcstctgagatagtgctctcttaattattagttattataacagatgctaatgccacctgatcaacaaatactatttagaattaatttatcatctttaatcatctttatgtttttatttttaggttgatggtagactgacttacccaacctgtgggattggttatcctgtctcctctgcatttgcattccagaataccttccctcattcgatatctgccaaaaataccagccaccctggttcaggaacaaaggtagccaaattaactaatacttgttctgggaaaaaatatagcaacctattagcatacaaacatttcacatcttttaaaagttcatttattctttggtcagttgttaagtagtaggtagtgtattagataaatacattactgaatatctagtatctatgtgtacaggaaatatatgcactatatatttcttgagtcactgtaatttctaaaatcttgacatcagtctgtttaaacctcacttatttctactcaacctctcctttttttttttttttttttgagacagtcttgctcggttgtccaggctggagtgcagtggtgtaatctcagctcactgcagcctctgcctcctgggttcagtgattctcgtgcctcagcctcctgagtagctgggattacaggcatgtgccactacacccagctaatttttttgcaattttagtagaggtgaggtttcgccatgttggccaggctggtctcgaactcctggcctcaagtgatccgcctgccttggcctcccaaggtgctgggattgcaggcctgagccaccacgcccggccagcctttccgtttttattcattcttctacttgtgtctcctacgctctcaggcctggctaggatttctgacttcatactgttggagtctgagctatgatttggagtccattgctagaatttaaaggtctggtagggcaggcttaaatcaaattctaaaatttagttctgacagcattatctcagataagatatgactagcaatccccccaacccttgatatatttgttaaggctttcttctacctacttctttttcctcatttttattattatcttagatttatgtattttttatgtattataattttgttttcacaatagtttaatccacccagaccagtcactgcttttattttcattgctaacttcagatccaggtttattttttcttaaataatgagacaaataaacatttatgaaaaaatattgtataaaagataaaattgaggactttgaaactggtattacaaactctatcaaattaggtctgggctactctaaaaataagttggctgtgttgcttaggcatgtgctctttttagccatagccttattattgccagtagctatggagaattctcagttaaatgaaaattaagcctgagtttttatgcctggaatactgttatgtaaagagtacttagatgcatataactggctcttcttgcattgcttattaaggagaattagatatgtgcattcgaaggaatgtctattgttttattatcagtttcagtatactcaagtgtcgttgtatcttgggatcattttttttctttagaattataagtgaattcacagttgttttttatttaaacaactttccaggaatatatatataatgtccaaaatgaggacaagtactactagagacagttgcctacttggtaggactaaagatggcttataaaataatactatcattcttataggtcttgtggaatcagaggaatcattataataattatgttcttaaatacaggagcaagactttcagtgtttcctgtatcggtgatctccatattcttttaattatgtatccctaacagggaaaaaaaaaaaccctaaaacagaacaatttgcgctctcatctcaaatacattaatgtgtatttatttgtgaatttatgcatatactactgaaatactatatgccgtataattattggttaagaaggcggaatctgatgttaggatttaaaacctgcctctatcaacctgaagttgatcaagccactgaaaaacaaacaacattcaactcttacacttcagttttcccacttataaaatggagtgataattttctctaccttactggattattgagttaagtgaattaatgcatttgcttagaatagtacctggttcatgataagtgctctgtaaatgttatattattaataataaaatatattcaaaaatagaaattaaagaatcagactaaaaatggatgtaaatgaaagttgtaagattttcttctcagacctcagtgaatggtcctaattactgcctactttgtcctccccgactcaaagacccactttaaagcaccaaataccacctactttggtgatcattgatctaggtagttttgtgctagcagctatgttgattaaaacatgtacttttgaattacagtttttaaaaatgacgyttttatttttgacgttgaacctgtgatcttcctgatgtcttaaaatgttactgtcaagattgaatacattcaaggatgtttaactgtgggaatgtaaaataacatgagaaatttggcaagaaacaaaataatgctgaaagaatatgtgagaatatttaacaagattgtgctgttctgacaaatagaacaaatacttgataattttaaagcaagatacacaaaactacgtgttttttctcttttatttttggatacaatgatagccaaagattcattcattgaacaagtatttaatgaatgtctgttatctgctgtggccaggcatagttttagttgcaggagatgacagcagtgaacaagacaaatgccctgacactatggtgcttacattttgtggtgaaacaccagtagatagtaaattgtaatgtctttcaaactaaactgtttattcattcattcatttattcatttatttttgtgacagagtctcactctgtcaccaaggctagagtgcagtggcatgatcttagctcactgcaacctccacctcccaggttcaagcgattctcatgcctcagcctcccgagtagctgagattacaggtgtgcagcaccacacctggctaatttttgtatttttagtagagacggggtttcaccatgttggtcaggctgatctctaactcctgacctcaagtgatccacctgcctcggcctcccaagtggtgggattacaggcatgagcctctgtgcctggcttgggttacattcttgatcttcaaggtcaaactttcatcaaggagattatgaagtatgtgagggattttctgcagtgaggaacgggccagatgattgatttatcttttttcttttaatctggttgaaaggcttagggagacaattctgtttactgttaaggaccaaaaaacaaagtctggaaatgccgtacacaatggtcatgaactacaaaatagtagtggagtggagaggagacacagtaatacacagcattattttgagtgagctccagcttttcattctaacccttgaaccgaggagaaacagctgtcctttttcattgagtctgcaacagaatggaaatgtgactcagtttatcagctcccacagagcaggcagagtaagagactattttaagctggtttggggagcccctatcccaagcatagagtggatgttgaaggttgttcccggcatccactggtggtggcttgtggctagtcctgggctccctgggtcctaggcatctcttgattctcagtaatgaacttgtcagttggccaatgtggacctgttgacaaattactctgaattactgtaaggtctcttttggctttattctctagggtttgagtttctacaggaacgtttacatttttattttctcggaaggaatctcttatcctcctgacactgtaattgtaggtgctgaaatgcttgttttctgtcagtgtcatccagtacagatctctaacatttgtgtgtgactggaggygccccaaggccctgttgcctcaatttctttatcttgrtagtgtttggcccacagtgtgtattcagagacagattttgtgtacagatagcattattcagttgggttaaccatctgattcacctagatggtttaaattaatttttcatttatttggtattaactttttaaaaataatgtgtaartatgggaagctttgaaaggtacaagaggatgtactatctaaaagtccctactgtggtccccagtcctcttagagaaaaatactgttaggaatttcttatgatatattccagaaatattcagagcatgtattagaccatatgtatgtgcatgtatatgtatatgtgttcaaatatatgagtgtttttatatataaacataaatagtacttgccaattgttctgcgccttgcttttttcatttaatggtattatggaataggtaactgcagtgtatcagaatataagtttttgtttctttttaatgacttcatagtattccagtatacggatgtactataattaactaatactctatttatggatgagtaggtttttttcaatccagatgctcatacagtgctccagcaaatatttttgtgcatacatctcggtggcctggtactaatagatttataggttacattgttagaagtaactgtgtcaaaggcatttttgcataactggtgactaaaatagtatcttattgtaatgttaattaacattttcttgattaaagtgagaaacatctttttatatatttgtaggttatgtttcctgttctgtaaaactcctgtttattcattttttgttttccatttgtttgttttagagatggaaatctccctgtgttgcccaggctggcttcgaatttctgggctcacctgatcctcctggctcagcctcctgagtagctgagactacaggcatgcaccattgtgcctggctctttcttttattcgtttttttttgtttgggaggtttaacatttataaaatggttttataagtgttctttacatattctggacgctagtttgccgttgtttttaatgtgttattttgtaatttttggtttgtttttattcttcattatacttcctttttaaaaatttaaaggttattaaggtagaatttacataccataaaatccttccactttaagattagttcaataattttagtcagcttatagagttgtgaagctataccacagttcaatattagaacatttacattaccctaaaagtaccctagtgcctgtttgcagtttatccttactcctccttctagccctaggcaactactgatcagctgtcactataaaatttgcttttccaagtttcatatgagtagaatcatacaacatgtagtttttttgtgtgtctttcttctttttttttgagataaaatctcattctgtcatccaggatagagtgcagtggcacgatcatggctyattgcagcctcgacctccctgggctcaggtgatcctcctatcttagcctcctgagtagctgggactacaggtgtgtgccaycatgcccaggtacctttttttgcatttttttgtagagatggagtttcaccatgttgctcaggstgatttcgaattcctgggctcaaggtatctgcctgcctcagcctcccaaagtgctggaattacaggcgtgagccaccatgcctggcccatatctttccttttcactcagtatactgtgtttgaggttcatccaggctgtaatgtgtgtcagtagttcttttcttttaattgctcagtagtatttcrttgtattgatatgccacaatttgttcattcatcagttgatggacatttgagttgttttaagtttttggatgttacagattaagctgctgtgaacatatgtgtacaagtctttgtatttattgtgggtgagtacccaggaatggaatggctggtggcatatgtttgatttttaagaaattaccaaacttttccaaagtgtttttacaatttaccaccagcagtctgagagttcaagttgttctgcatccttccaacagttggtatagtcagttgtatagccattctaatacatgcatagaagtacctcattgtgattttatttatttattgagacagtgtcttgctctgttgcccaggctggagtgcagtggtgcaatctcagctcactacaacctccaccttcagggttcaagcaattctcatgcctcagcctcccgagtagctggggttacaagtgcacgccaccacgtccagctaatttttgtattttttagtagagacagggttcaccatgttggccaggctggttttgaactcctgacttcaagtgatcccctacctcggcctctcaaagtgctgggattacaggcatcagccaccacacctggcccctcattgtgattttagtttgcatttccctaaaacctaatgaggttgagtatctctattcatgtgcttatttaacatcaatattaaaataccactttggtgatatttctatttgaatcttttgaccattgctaaacaaggttgtcttkttattgaattataagttctttgtatattctggatacaagtcctttatcaagtatatgattagcaaatattttctcccagtggcttcccttttcattttctcaatgtgtcttttgaaatacaaaagtttttaatatttgatggagtgcaatttatcaaacttttttcttttgtggatcttgcttttggagttgtatataagaactctgtccaaccacaggttgaaaacattttctcctttgttttcttctacaacttttatagttttagttgttacatttagatctgtgatccattttgaaataatttgtgtgcatggcttgaagtaaggatctaagttcatttttcccccctgctctgaatatccagttcttagtaccatttatgaaaagtctttttctctgttgaattgtctaagcacctttgttgaaaatcagttgaccatgtaaggatttatttcaggattctcaattctgtttcattgatttttatgcctatcctgtgccagtgtcacagcatcttaatcactatgactttatattaaaagttttgaaagtcagtagtataaatctacagactctattcttccttttcaaaattgttttagatcttttacagtttcatgaaaatggtcaccttctcaatttctacaaaatggtttgtttggattttgataggtatataaggaatttataggtcagttttcaaagaaatgctgttttggyagtattgtgtcttccaatccatgaatattaagagtctttccatttatttagagctttactttctctcagtaatgttttgcagttttcaatatataagtcttgaatttcttctgttgaatttattcttaagtgttttattcttttagatgctattgtgggtataattattttatttttcagaatattcattgatgtgtagaaatgtatgtcatttttgtatgttgatcttgtatcttgaaaccttgctaaactcatttattatactcattagtggtttttggtaaattctgttggattttccacatagacagttatgtcatctgaaaataatgacagcttcctttccaatgtggttgctttttatttatttttcttgccttattgtaatggctagaaccgatagtacaatttatttttatttatttattttttgagacagagtcttagtgtcacctagcctggagtgcagtggcacattcttggctcactgcaacttctgtctcccaggctcaggtgatcatcctacctcagcctccctagtaactgggaccacargtgcatgccaccatacccccagctaattttttgtaattttggtagagacagggttttgccatgttgcccaggctggtcttgagctcctgagctcaagtgatccacctgccacagcctccaaaaaagtgctgggattacaggtgtaggccactgcacccagcctatagtgcagtttaaataaatgtgagagcagacattctggccttgttcctgagcttcagggcagagcattcagtctttcatcataagcatattagctgtaggtttttgctaggtggccatttttcagaataagggagttttattctattcctagtttgctaagagcttttatcatgaatggttgttaaattttgtcaaatgctttttcaattgatatggtcatgtggcttatcttttatcagttaacagattgtattgattgtttaagattatattagcctttcattcttgggataaacttcacttggtcatggtgtattctttttatatatcgctggagttaatttactttttgtttctttttcttttttttttttttggagacagagtctctctctgttgccctggctggagtgcagtagtgtgatctcggctccctgcaacctctgcctcctgggttccagcgattcttctgccgcagcctcccgagtagctgggactacaggtgcctgtcactgcaccagctaatttttgtatttttaatagagacacggtttcgccctgttggctaggctagtcttgaacttctgagctcaaggtcagaggtgggtgatccgcccacctcggcctcccaaagtgctgggattacaggcgtgtgagccccaacacccagcttggagttaattttctgatagtttgattttgtgtccatgttcataaagcatattggcctgtagtttacttttcatgtactgtctttaacaaatttaaatcaggacaatactggcctcataaaatgaacaggaaactgtcttttctcttttattttctggcatatattgtatagagttgctttatattttctttaaatgtttggtagaattttccagtgaaatcatctgggtctggaaatttttttgccggaggcttttttcagctgtgaattaatttttttcaatacctatagaatgtttgggttatttatttcttcttaggccagtttcgatagtttgtgactttcacaggattaaatcatttaatctaaattttaagctatgtgcgaagagttgtttttagtattccattatttttaatgtctatagactctgctgtaacatcctctctttcattacttataatggtgatttttgccttgtctctttgaaaaatcagtttggtaagagttaccagtttcatggatcttttcaaggaaccggcttatggtttcattggtttttcaatttactgatttctccattttaatattttttcccttctaactgccttgagtttgtttggctccttttcttactttcttaaggtagaagattatgttctgatttaagagttctatgttaatctaaacatttaatgctatacatgttgttcagtcttgctttaactgcatttcacaaattttggtatttgtattttcattttcattaagtttaaaatatttttttttctttttcttttcttgtttttgagacagggtcacactgtgtcccccagactggagtrcagtggcatgatcgcagctccttgcagcctcacctcctgggtttatgtgattctcccaccttagcctcctgagtagctgggactacaggtgcacaccaccacacctgcctaattttcgtatttttttgtagagacagggttttgccatgtttcccaggccaatctcaaactcctgggctcaagtgatctgcctgccttggcctcccaaagtgtggggattacaggcatgagccaccaygcccagccctattcttttcaagtacacatggaacactaaccaagatagactacgtcctaagtcctaaaccagtctggaattaaactagaaatctataacagaaagatatgtggaagatttgagggaaattagaaaatattttggccaggtgtggtcacacacacctgtggtcccagctgttggggaggctgaggtgggaggatcacctgagcccaggatgtggaggtggcagtgagctgtgtttgcaccactctgctctgtcctgggcaatagagtgagaggtctcacaaaaaaaaaaaaaaaaaaaaaaaagaaaacaataggtattctgtttttgttgggataatgttctttaaatatatctctttgtattatttttattttagtggttgctccaggcattataatatacatacttttcgtagtgtgtagaattaatatcttaccacttaaagtacaatatacataccttgccaccatacagtccctttgccttttccccccttatgttttcatatttcgtatgtattgtatctgcatacattggagacattatcagacaatctataatttttgctatcctccattatacatatttaaaactctggagtgggctgggtgtggtcccttacgcctgtaatccaagcactttgggaggccgaggcacgtggatcacaaggtcaggagatcgagaccatcctggctaaagcagtgaaaccctgtctctactaaaaatacaaaaaattagctgggcatggtggtgggcgcctgtagtgtcagctactcgggaggctaaggcagaagaatcacttgaactcgggaggcggaggttgcagcgagccgagattgcgcctctgcactctagcctgggtgacagagcgagactccatctcaaaaacaaacaaacaaaaaaacacaaaaaaactctggagtggagaagactagttcgttatattacccagtgtttaccatttctgttcttcttgttcttttccttcattcctggtattctaagttcttctacagtataatttccctgaatgatagaacattcattagcatttcttttagaggaagtcttctgtcaattctttttcttcccctgggaatgcctttcttttacctttcccaaatgatattttctcttgatacataattctgtattcataatccttttccttaagcattttaaaactgttgttctgcctcttttaggattccatgatttccaatgagaaattagcagtaaatttgaatcgttctcctataactagtgcatcattttctctgcctgcttttaatatatatatatatttttagtttttcacagtttaacaatgatgtgtctgggcatggattttgaacttatttgactttatccttttgggggtttactaagcttggtgaaccttttcccaaatttttgaagtattcagccattatttcttcaattttttttttttttttttttttttttttgagacagggtctcgctttgtagctcaggctggagtacagtggtgtgaacagaacttgtggcagccttgacctcccaggatcaagcattcctcccacctcagcctcccatgtagtcaaatatttttttctgcaraacactcttctttcttttaggactcaaaagacatgaatataaatctttattttcctaaaggtccacaaccttctgttcttttcttccattcttattttttctgtttttcaratttgattatttctattgatccgccttcaagtttactsttttctctgtccattctactrtcaagcccattcagcggtttttttctgttctaaaatttccatttcgttttctttccttttttttttttttttttaatgaracttttttacattcatttgaacagtgttattaragcacggttataatgggtgatttgaagtggtttttctgataattccagtatttgtgtcatcttggggttgacttcttctggtttaacttttcccttatgagttgcttacatttccctagtactctattgagtgattttggattgtatcctggacattagaatattatgagatcccagattttgtttaaatcctgaggagaatgtgatttttttttaagcaaacaatcagtcttgttaggttcaagttctgattagccttctttaggttgtgattcttaagtcagttcaatttttttcaaaagagtttcactctgttgcccaggctggaggatagtggtgcaatctcagctcactgcaattctgggttcaagcaattcttgtgcctcagccttccgaatagctgggattacagatgtgcaccaccacccccagttaatttttgtatttttagtagagatggggtttcaccatgttggtcaggctggtctcaaacttckggcctcatgtgattgacccacctcagcctcccaaaatgctgggatcacatgcgtgagccaccatgcctggctgtcagttcaaattttaaagactttgtcatgtcrtgctgtttggatctgtctcaagtgtgctattctgtgaccttggcagtagtttaccccatagttcggttcccaaagcctttggtatgctgattagggtcagattcgtacagctcataagtgagcctaagagtttatataccactttataggatttctcccttgagttttctctccatgatttcctcagaattttctgtgcccttagggtcccccttcctggtcttctggctagaaaatataggcctaggtttcctttccgtgctatgcagttcctgtaattgtatctccatctgttatcaagcagcaagaggacaaagagagtagaaaagtagggaagatgtttcccctgttaatgaggccacagtgcctttggtaggaaaatatgattcccctccttcaaagttttagttatcgcctcgccactgttgctgtcaccattacctctggcacttctgcttccatatagtagcctgggagttggagcaggaaagaacacagggaaaaatgaaaagaaagggattttcctccctctctttgacgcttaggagtttcttttttcatatctcagcagaaaaataaatctaccttgatattaatattatattctggctctcttatgcctagtatttacatgaagtatcattttctatttttttattttccagcctgtgtctttaaatgtgatttcttttagatatttataattgactcatttgaatccattctgacattctggcttaaataatttaaaatgtaatgcatataataagttttaccatattatgatttgttttctatatgtcctgtttcttgcctcccttttctgtttttcctgccttctttccagttagttttgtgcattttatttcatttttcattttatatttactcttggctttcttttattttctttgtgtttactctagtttataatatacaatttcatcatctactttcaaatattattatactacttcccatgtaaaataagactgttacaataatatacttccatttcttcccttctttttgctactgttgtcaaaattttacttgtatctttgttataagctctactttttttttttctttaaacaatcaagtatatttaaaagacattaagcaatgaagaaaaatctccttggttaacccatacattactatttacacacttttttcctttatgtagatctaaattttcatctggtattattttcctttctcctcaataactaagatctcttatagtacaggtttttaaggcttcttacaatgcaggtctgtgaggaattaattcttcttttgtcttataatgttgttattttgacttcattttctctgaatatagaactttaggttggcaagtttttttcctatctrtattttgaagatgttattccgttgttgcctggattgaatactttctggcaagatgtcagtagtcatgtttatatataatgtttcctttatataaagtgacctttttctctgggtgcttttaaattttctctttatcattcattttcaacaagttaattatgccttggtgtggagtttgtgtattattgtttaattggggttttcatgaagtttttaaataggtgggtttgtagtttttatcagtttaggaaattctagtcattattcacatttctttttctgttttgttctcttttttggtgttcctccttggtactccaattatacgtggttgattacatgatactttcccagggagacttagtttatttcattattatttatttcattttatgtagattctgatgctgtgtcttaaagtttattagtcttttcttactgcagtgtataatttgctgttaatttattcagtgagaaattttcattttatatattgactattttatgtctggaattttcttttcactcttttttatatcttcaattttctcrtactttttatttccattaagttcttacacaattacatttgtgtccctggtctataatttctaccatttctgaatctgtttctgttggctaatttttcttctgagtatgacatcttattgttgtctttgtaatttttgataagtggagcattgtgagtgttacattgttgattgtctggattttatatttctttaaagcatggcaggctttttttttttttttatagacagggtcttgctctgttgcccagtctagagtgcagtgatgtgatcataactcactgtaaccccaaactccagggcttaagtgatcctcctacctctcatatatctgggactacaggtgtgcactaccacactgctggaattacaggcgtgagccaccacacttagccaaagcctgtatttttatggtgtagatttatcagaaaacaaatttaaccacccatctcaatatagaactaattcaccccggtaatggtggctcatccctgtaatcccatgattttgggaggctgagacgggaggatcacttgagccgaggagtttgagaccagcgtgggcaacacagtgaaaccccgtctctacaagaaataaaaaattagccagacttcgtggcgtgtacctgtagtctcagctagttggaaggatgaggtgggaggatcgcttgagcccaggagattgggactgcagtgaaccgtgattatgccactttactccagcttaagcaacagagcaaggctctgtttaaaatcccccctctgcccaaaactgtctacttctatataactcagttacatgagatgtttttccttctcacaggttcagtttaatttgcagtttacaaaaccaaatgcatcactaggagatgttcagtcaggagcaactattagtatgccttgctcaactgataaggaaaagtaagtgcttaatgacataaaatttaatgtttgcaattttgaaggccatcttacagaatttttatcagtgcttgagagctgtgatgcccacctgtttacctgagacatttcaagttactgatcattggaatttaagttgaattactcttagctataaaaaagagatttctcatacttttttctgtttcctcctccaacaatctactcattattttttaatgtgggatgtgcttagatagtaaaatttcgtttgttgaaagagattttcctacataactgaagactgggctttcaaatattctcagacatattcatagaaatttttaaaaattcctcatggtcagctgtttttgttttcttatatggctatgtctgtccctggaagctctccatttttctgatttattgctttcagtataatctaatctaaaataccagctagttaatatgctagaaatatacagagaatgagtaaaaaggtttgtgagattttcccatagataacaaaaataagctttaatgccattttgcgacttccattccctgttttttaaacagggtttacatagtgaagtctgttgattcaatgacttgtggttaaatcaaaccactcatacaggcaaacttttctctctggatagacttcatgtttgtaatttattactactaatatagttatttattaaatttaatggctttaaggcctgtctgctgatactcattatcatgagctatcaccatcctagttctacattacaaactaaattactaacatagctcaaagagggttcttatccccagctctctagcttttattcattggatcatgatgtgttaaaataattaaaatgtttgtggctggtcacagtggctcatgcctgtaatcccaacactttgggaggccaaggtgggtggatcacttgaggccgggagttccaagaccagcctggccaacatggtgaaactccatctctacgaaaaatacaaaaattaaccgggcgtggtgggcacgtgtaatctcagttactcaggaggctgaagcatgagaatcgcttcaacccaggaggcaagaagttgcagtgagccgatattgtgccactgtgctccagcctgggcgataagagcaagactctgtctcaaataaaataaatagaaaaaataatgtaaaaaagttaatatttgtgagcctccatttttaaaaaagatcaaaattcacttgttcacaagggagagcaccttgaattcctgttaatggtagaatatcataatgtttgatatatttaattcatcataggccaggcatagtgacatacacctgtagtcccagctacatgggaggctgaggcaggaggatcacttgagtctgggaggtcaagactgcagtgagccatgatcctgccactgcactccagcctgggtgatagagtggggccctgcctcaaaaggaaaaaaaccaaaaaaaaagccagacatggtggtacatgcttgtagttccagctgcttgggaggctgagggatcacttgagcctgggagttggagtctgtagtaagctatgatcagtcacatcactgcactccaaactgggcctcaaaacgagaacctgtctcaaaaaaaaaaaaaaaaatcaaatcattatagacagagcaattttactagcagaaaatatgacaatcgtatttgtagtatgaagtcaaacatatccatctgtccataaaattaggactgttcagtgattttgagttttttctggttcttttatttgtcagctagcaaaaagtggcaccgggtatcaaactttaaagaaaaaaataaaatagaaaaaaagtctgttcacccacttatttctgaaaattgggtcaagagcaaccatcatttaattttaaggattgatttattctcattgttttgcaagagcctttaacttcttattacaagtaatactagggaaaccgttaacactggatgtatttagaaaggatggcagtggtagaaaggggaaacacagaaatgcccttctttctcccccagattttctcatttgtattaatttgatcagaatttattgtgtaatgtgtgttaatacttgatcatgactactttgaagcactagaaaatttcgaagagcttttggtcaaaggaaaaagaaatcttattttaaatatgagttagaaattaatagtgttactctcaaggcacgtatttttctgtcatgtatcacttatgtgctagtatttaaatttttatagcacttgtagaattttcatttttcccaccatccttatcccagctcttaaaattttattataatctactctttactgaggatactttggtttatgtataaaattaccatttgcttaagaaaccagtgaagaatgtgttctgaacaaagctaagctataaatagaacttagttacattatcttatatatatgtatacatatgagataaaccttcaaagttaataaagactttgttaaataagttattaccattttctttttaagtggtgaaaatgtagggttggaatccaaatacctgaagaaaagggaagatagcattcctttacgcggactcagccagaacctatttagtaattcaggtaagcagggatttctggatttttgtactttatagttgaattaaatttaatgtatgaagacttaatgaataccagtaacctttttttgtcctcatttgcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaacaaatttgtacttggggattggtaaagattgtgagtaaatgacattttttggtttgtgaacatggcgttttatagaataatatgaattttattaagctattctttagaaattcagttctaaggaaagagttgatccttatgagggagattctgatcatattaaaaatctgggtaaactaaaacctgctcataacctcatagtatgcaaccaaagaatactaattcattttatcactttcattggtaaaacttttaaattcaacacctgaaaatyatgagggaaaatgattacctcttgagatatattattgatgacatttaaagggaaaagtcctaaatttaccttaaataactgaaatgaattaagccttcatagcgtattttccttgaagcatttaaatttgctagtgatgaatcaaataaatttgatatacttaaaataatttggacagtttttatgtgaccagattaagtgcttttgtcatttgagctgacaagtttttaaaacttcagtgcttcctaaatgtttatactcatctagtttttctcaatttgtagttttattatgcagttaaatctgtatcagtggacttttaaaacttggtactactactaaatctactatatcatgaatattcatttatttttatagtatsagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaattttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttctgtaaactttgagctttgttaataaactattatgcagcatctacactttgaaaatcaagtacttcaaaacgcatactgcatttttgtttctttcctcttgtcttccttgaagagcattttttagtgagggaaaagaaatggatgcaaagaaagaatgaataatgctttgatttgttactgtaaaaatatggtaacaaagccaaaacagaccctgtaggaactcacagatcaagacttttttaaaaaaaaaatcattaaaatatttaactttattaacagaatatttacatttcttttaagaccttatttaaccatagtgagtgttccaagtttaaaaagcattaagcaataaccacacacaagatgaaaacagtgtaaactatacagttctttatatacaatttttacaaagtaacacttttttaaataatataactggacacaaaaatatacactttagagaaattcacatcggtaattgtataaagctctcctctagggtcctgaaaatttaggacaaacattagctctgtaaataaagtgttactgtgacagtcctgaaaggccactatatatatttatctacataatagatatcacactgacattttcaaggctaccagctttactatataatttttagattatgtattcaagtgttgaggtgcttatgattatgcaaacattaaaagaatagtggtataagaagtagctggggaataaatttgagccagcatttagattacaggctctaaataccccaacttaaatgctaaatggctgatactttctcacttcaaaaacagtagtgaataatgtttaaaagtactgcaaacaagctcaaaacatgattcagatttagtacagttttcttaagagtttttttttttaaatgcaaacaattcatttaccatttctttgttttagtgcatctgcattaaggctttgaattatttgacccaagattttacaatattaaaatctgactcaaaattttacaatgttaaaacaaataggtccacaaccatactacctactgtgtctcactgagtcagcatagagttaaagctcaacaccttaaggaaatggtagcagagacatttgctaatatctaagaagttacatatatagtttttaattaaaggatgtataataaaacaaatagcttagtggcragaaattggtgctaataaacaaaaggtttttcaaaagaaattgtaacatctttggaaaactgtctggttctaagttcccacttcctttagttcccacggagttcatgcagatacatttcttaagacaatcttaaagtacactgtggatggaaatggaatgtacatccagaactagaggtgaaaactaagacctgggtgctgatagaaaaatcttcctgatttcagtcgtcacacatttgtgtcctggagtaaaggttctttggcctctcctggcgcttgtgtattatgaggatggctgtgactgccacagtgctttctccaactgctggaccttaagcttaaattggtatgttccggaataaacaaggcaacaagcagagccagcagtactgaacaggctccaaataggaagggagggccagggatgatggaattctgaggaagaataaagtaattaggatttttacacaaatacttttactcataaggagaaactacataccttttagtattaacttatgaattacaagctaattgctcttctctttattaaagccataattataaaaggcattccctttttaggagaaaagagatactatcacattctctataaaattctgggaataacaactggcaaaacagcctatgcgaaaatattacatcattactttcagcacaaaatgtgaacacagctattctatgattaatttgttagtccaaggggaaaacgtttatagaaagatctcaaaaataaaatcaggctgcacgtgttggctcaagcctgtaatcccagcactttgggaggctgaggcaggcagatcacttgaggtcaggagttcgagaccagcctggccaacatggtgaaacctcgtctctactaaaaatacaaaaaaaattagccggtcatggtggcatatgcctgtaatcccagctacccgggaggctgatgttaaaagaatcgcttgaacttgggagatagaggttgcagagagccaagattgtgccactgcattccagcctgtgtgacagagtaagactgtctcagaaacaacaaaaaacaaaataaaatcaggtagcatacagtatttactacagtagcaaaataaattaccatttctttgtttcaagaaggtaattataatttcaagtgactggaagtgagaaaaacacaggttaccaagaaaaagagacctttgttttagcccaaaattacattcattcttagcagaagcttgcactgccagttttgtgtatagcccacaaacattcttttatttaaaagtagtcttagtgggttggaagataagtacagaactctgctaaataagccaggaaactgatgagctgctaatattggccaaaatgatcagcattgtttggcattaattttcagttgaaargagggaaatatagcaaacagtgaacaaaggttatttaccataagcctgccttttgtatgaaaagttagttaacatacacaactgtgatattagaaaagtttcaaaagagactagtagtaaagagaaatggtttgttacatatgccattgacaaactaggtacttaaaatttttcattctcaagtggaaaaaaaatatgcacagccaattttcacaaggtggtatgtagaagaacacagtcccttaaactctggtttttaagcattttatccaatctcaaatagaatctcacataaaagctttcatgaccaaaaaccagtagcctttaatctagccaaatgaaccayacaatttgatcatgttgaatgagaattacctgttcaaagtggtgctgagggcttgtgtttgttcccaagtctgttcctgttaytggcagttctttaagttccacatggaatatgtagaaaatgaatccatagagggccggtcccagaccattgcataatcctcgaattcctgttatcattccttgaacgacacctacattgtttaaacaaattatcacttagtaaactacctggttttttttccctaccttagaaccagtacaaatatgaaatcacttaatctaaaatcaagcttcttatcagacactagcaatttatagcaatgtcattaaaaactattaatatttagaagctatcagctctacaaagtgtagtaagctgtcctatgcaaacatgagctctgatgtacccatatataggtctcacatagaaacaagtgggcaaaactactttatttccctagattacagccttcaaaacatggctggttaaaaatcagtcacaatttcacaactacaaatgttaaaatttatctgtccccaagcaagtacttaagaccccttttagtcaaaaataaagtgggggggtcaactggcgggagtgcagtggcgcaaacttggctcactgcagcctcaacttcctgggctcaaatacctggctaatttttgtactttttgtagagatggggtctcactttgttgcctagggtggtgttgaactcaactcaagtgatcctcctgcctcagcctaccaaagtgctgtgattacaggcattgagccactgtgcccagccaaaatcacacttttttttttgagacggagtttcactcttgttgcccaggctggagtgcagtggcacgatctcggctcactgcaaactccgcttccagggttcaagtgattctcctgcctcagcctcccgagtagctgggattacaggtgtgcaccacgacgcctggttgatttttttagtagagacagggtttcaccatgttggccaggctgatctcgaactcctgaccttaggtgatccaccagccttggcctcccaaagcactgagattacaggcatgagccactgcgcccggccaataacactgttttaacagcatttgatttttgtttctctcttttggatctttaatttaaaatgcaacttgctttggccataggcctttccttcctcatttatcaaccaagtgacaactgccactgttttgcagtgccccttttatccttatgactagacaaaacatatccttttcaaagaagtatttgtcatctgttagcatcccaagaattaaatgttcccaccaaaaaaaaaaaagagagcatatgacattaaagatgttgctgtgttacatatcttcagatgactgaaactatatgatttctttttttttttttattagagatgggagtcttgctgtgttgcctaagctagcttcaaactcttgagctcaagtaatcctcctgcctcagcttcccaagtggctgggacaacattcataaaaggtctatgaatatatcccacaaggtgtctagcacaacacagcaaaaacttaatgcttagttaatattctgtggccaacattcatcagtaaatttttttgagacaggtctctcaaggtctctcactgtgtcgcccaggttggagttcactggcctgattttggctcastgcaacctccgcctctgagactcaagtgatcctccaacctcagcctcccaagtaactgggactacaagcatgcgccaccctgcccagctaatttttgcattttagtgatggggtttccccatgttgcccaggctggtctccaactcctgaactcaagcaatctgcctgcctcggcctctcaaagtgttgggattacaggtgtgagccaccatgcccagcctcatcagtaaattttctatgaacagaacagataagccacatattctaagtgagagaaaagggaatatgtatctacctaaggataaataccctagaatctgcttttcctgtttatatcaaaagcaattttaaaagtctctaccctgaagatatacttatgtttcagtacataggagacagaacacaggattagaacattctgtacttttaaataattatcgctagttcctatcaactcaccctgttgatcagcatcagcagttcgtgaaacaagtgcactgacagcaggaaaggtgatgctagacatggctgctactgccccagcagcccacatcatcctataaggagagcagcaaaacaaaaacagtaaattcttctccacygtacctgaaagtcaaactacataattaagtaattcttactgtgaaatggctgtagagaaaaggagaactgaacttgcttactaggtgactatgggcaagtcgcttaacaatctgaccctgtatacaaagacagcaacttaattcacaagagtgctgtgagggtgtaatgtaaaatagggatatcatgttccaaactgtaaaatgtgctgggtattatttctacaggcaattgagaggttatattgaggataatgtataatatagatgacgaaacatcatcaaatatttccaaacacatgaagccaacaagtctttggcaaagttcttatggatggatttgtgaagatatcgctgatttgatctaatccttaaattgtaaagaacaagtaacttggatgttmctggcttgatgtttaaaagaaatgttttaggtaatttcaattgtgagcacctctttgcaaaggctagtttggagaacaaatcatcaccctcttgatgcttgcttatatccaagtccaaacagagacgaggcagtcagttgtttgaaatattagtgcaaaccatggagttcagtgccataatgcctgagcacaataatactatctacgtgggcagcctgacaacaagcgtcactactcaagtcccctgcaggaaacccgactggtcagaaaagctgagacacagcatgaagctggcaccaaaataactggattgttttcacttctggtttgctatcagtaatgatcactggttatacaactttctttttcctgaccagaaaaacaaaaaatgtaaataactttcagggccttgttgctatgggattacatactttttcctagtaacggactgatttagattaaatgctccttaaagattcaaaagctgtataatctcattcaaaaattcagcctgtcatttagctataaaaggtcacctttttaatcctcaagccattctaggagaacatataaatrtacaagtggcagacttatattagacacattttgaaagataaaaagcatagtatgagacagattacagtctacccctcagttgagaagcaaataaaaacacaagggctaacaccaaaattaaaaatattaacattaaaatatttatacttaccaaggttytgaaccaaagccataccatgccaactgtaatatttgaaatcctagacccagtaaaatggtgttyttatttccaattgacctcataagtaaactcaagactatggtytgaaaaaaaaaaaaaaagatttatcagaataaagttttaaaaagtgacttctttcaatctacactataaaaggactattggcacttttctacaatttggctgattttcagcaataattgccctgaatatgtctgagatcactagtccaggtcacataagcagatgaaaagtccctctgctgacatagatccagactgagagttagaaaactgaaagataaaacttcctattcagtacatttctactgaggaccacttaaatcagtagttgaaaatggaagggtcaaaagttctaactaatgatttggagatccccattacataatagccttaaagcttgtttaggtccaagttagtctaaaatgcttatttccacaactaaagaaaaactaacagaacaatgattacccatatattatttacctaagttaatctgttgttgaaaccatgatgccttttataaacagtaaattaataagcttgatttgggataaatgcagtatactatacagcagactttagaaaaacagcctggatcataatcttggctttgtgtggctctcagcaagtcacttcactttgagcctcacttttgtctctttgcaaatggggataacagcacctatttcaaaaccttgtcatgggaattaaatgagatatatttacataaagttcttagaattgtgcctggcaataatcagcggttaataaacaatattatcagtgggtgggttttcttgtgcctcctttttctttcaaagtcaacaaagttcagcagtgatttgggaacattagaaaatttttttttgctattctaactaacgtttttaatatactacataagatagctagtaagtccatagacaagtaaaaataattcaggaaatcactattttatgatgggctgacactttaaaactcataaaatataagttttgaattctttaaattgagatggccacttaagaatttaatcacaaatatgccagtgaaaagcaaatgattcattcaaggatttttgagcaattagaactcacagctttcttgtctaagactttcacttaaatcacgtgagtataagactgagttccatgtagaattatattcttcggcaaccaaaccagaaaaggaaacttgcccagagccagcagttagctgagaaaaacttcaactgaaagaaacatttaggccaggcacagtgactcatatctgtaatcccagcactttggggaactgagatggaaggactgcttgaacccaggagtttgagaccagcctggacaacataaagagaccacatctctacaaaaaattgaaaaattagccaggctggtggcacacacctgtggtcccagctactcaggaggctgagtccagaggatcactcgagcccaggaggtcgaggctgcagtaagccatgatcacaccactgcactccagcctgggtgacagagaccatctcaagtcacccatgacttgtgggtgggaactggtggccaatattataaaaaataatcagaaagattagaaatgattaggattctaattagggttagaaataattaaaaatgattttatttgtggactatatcagagactggctttcaattaattatgaaaaaggaaactgtaagtatacccaaagctctgtggcctccaactgtctgagaagaacagggaactataatgcaaagttgaagaacttctgggaaactacttttaagaacatcccggaaggtagcactttcatctaaaaagctgtgattctttatatggctctaggaactcacagagcagaaaacatttgttctcatcattcattgagatgatgataagcattacaaggaagaaatgctgttaaaaaatagatttcacttaatgatgaaatccctggcacttcagccaagagacaggacagtgaagaaggctgagcatcaactcccagctcagtgggaacaggatggcatgggccagccatgtaccctggagcacgtgttctttcaggaatgctagtctaagaaagctgacacttctcaagcagagatcattaatattaccagaaagtacttataaaatgcggtcatctcatagcccttcaaccaacccatctagccagtaagtacttatctgcagaaatgactatcttcccctttgtggaaagctgttctcaaagaataaatcccaattcaataaaaaaggcttagaatgcattattagcctcatttcctttttatagataagattaactggagaatatattttctttttcttttgggtttttttttcttttgagacggagtctcgctctgttgccaaggctagagtgcagtgtcacaatcttggctcactgccacctctgcctccggggttcaagcgatttttctgcctcagcctcccgagtagctgggactcaggtgcccaccaccatgccygctaatttttgtatttttagtaaagacagggttccaccatattggccaggctggtttcgaacttctgaccttgtgatccagctgcctcggcctcccaaagtgctggtatctcaggcgtgagccaccacgtgcccagcctttctttttccccccgagatggagtttcgctcttgttgcccaggctggagtgctgtggcgcaatgctggctcactgcaacctccacctcccaggttcaagtgattctcctgcctcagcctcccgagtagctgggattacaggcacgtgccaccatgcccagctaaattttttttgcatttttagtagagatgaggtttcaccatgttggccaggctggtctcgaactcctgacctcaggtgattcacccaccttggcctcccaaagtgctaaggttataggtgtgggccaccgtgcccggccaagaatatattttcttaaggccatgagatgagtcattaaaattggaaacaatgagatacaccaatccccctttcctggggtaacgtcctatgtgcagaattactgcagcaggcccactgctgtgagaacctcctcttggactccttcccctacagcctatcttgtgacccaaagccctaaaagacaccgatacttacaacactgtaactgggaacactgattttcttcttgaaggcaggaacttttctcttatttacatttatatccccagcacccagtaagttcttaataagtgtttatggaaagcatgcataattctaaatgttataatattctcaataatattaataataatggaacaaaatacttaatatataagtgttcttgaacggaaaaaatttttggtgtcccttaatttaactctcattttgaagatgacagcactgagtcccaaaggttaaatgacttaagcaagatggcatagctgatgaacagctaagctaacactaacatcagctttggttagtctgtcaacaaatatttgccaaattcctaataagaccaactcttattcttggcctgaagacgcatgggtgagtaagtcaaagtatccatcaacacacggactaccttctcatggaggaaagatgcatatgagcctgcttatttaacaagatattccaggttgtagctgctatgaacaaaataaaacagggcagtgtgatggagatgctgcttaaaccaggatccagggaaggccttttgaagtgagagctcactaaggggagagacctagttatgcaaagatctggggaaagagaacaccccaagcaaggctgacagcaagtgcaaaggccctggactgaaacagaacatactcaaccatgtggagagtggaggaaaatgacataataaggagtctagattttattctggttgcaaaggaaagtgagttataggtaagatgcgattaaatttccattttacaaaaattactctgccaagtgcagaatgaactatagtgaggcaagatggaagcagagagaccagatggaagatatggccacggctcagattgggttcctactaatggagaatatcagaaacgctctgattcaagatatattttggagagagaggtgataggaagtatcatttgatgggctgaatgtaaggttagggagaaaggattcatgaatgtcgctaaggcttctggcccccaaaaccwggcggtggygaagccactgaatgagatgaggagcataggggtggcgggcaagggatggaacccagattttaattttggccatgttaaggctgagatacccagccaatgtgtcatataggagctcagggactggactggaagagtaagtgtgggagtcacccccacagagagggctggataggaaaacactgagaaaaaagaaatgtgtagaactatattgatgttctcatgtaaacacttacttagtgcaagtgttaggaactcttatacgtaccggtgcccaggaagtaatggggctgatgataaaccaaaaagaaaaggttccaaaggggacagcaactacttggctctcgctggaaggttggcccacacccggttaccagatctaatcattttgggggagaagctacataactataatttcacgtaacacttcccaattttaaagtgcttactactaattttttaagttttttttttttttaacattatggaaaaaaaccaatgacctttagtttagcacctcctggcagttcagggtgctagggtgacaaaaatgaatatgatataatcctgacctcatcatctactcagaggtccgctagagctcacaaactaaggcaataaacagagataaaatctctactacactgtattctgtacaatgatggagatatgcgcacatgagcatggggacccagaaaagggctacttagggtggaggaaggggaggcagaaagaatagcaggaacaaaagcacgtgggtaagaaataaagcaaacatgcattaatggagagctattagcagctccgtgctgctggagaggagggagaaatacactggtctttcagtggtatggaaggtcaacaggggacaagtcattctcaattgtatatttctgcataaatgagaatacaagatcattcttctacctttgaggctatacatgtaataatgtagtagctcatatatgatayaaagtgttaattcttacttctacataagcaccaaaacctaaatggtcacttaaggaccttgttcctcatggactgtgtgtgtcatgctgtgtcagcaatggtgtttggagggttgcttgcacctttgcggtcttactgccttcagggctctgctgctgcactgatctttccaatacaaatccaactacattcctctcctttacctgtctgccctgccagattctgcactctcagagactgtttttcatcttgtaacctagtgccagatgccatctgctaaacagaggaaaaataccctcaaaagcaccctccactcatcactgggtctgcagtgtcactgactacatttattagatgcatacagctcccatggtcatttaagtaagaaacagaacttaagaccttatagctatcaatcttttatgtgtcattacagtattagtctgctctcttcatctaaatcttaaacaaaatgttagcaaatctaatgttggcaatgtatgaaaaagatactcatgcccaggttgatcacatctattgcaaggttgggttaatctttgataattcatcaagttctacacatactaactgtgtattttccttacactttttttttgagacagggtctcattctgttgcccatactggagtaccatgggacaactgtggctcactgcaccctcgacctcccaggatcaagcaatcctcccatctcagcttcctgagtagctgggactacaggcacacaccaccacaccgggctttctttcytttttttttttttttttttttttttggtagagatggggttttgccaagttgcttgagctggtcttgaactcctgggctcaagcggtccctgaccttgkccacccaaagtgctgggaatacagacatgaaccaccgcacctggcctcaaaaactttttttaaagccatttttatataaaggctacagtatattttcctccaaagttaaaaagcacttttctcatggctaggaatgaatatttaaatgcattgtttttccagactgatgatttttaggacaaacctgaagctagaaatagtactaatactcaacaccaagtatatgtatgtgcagaggcttggggaggcatataggatttaaatttgaaatttgttgctaaactcaccaaaacagaatgaatcatgagacctgcagaaggaatcctactcgagaaatggtgaaccatccaagagtcaattaaaaataccctagaataaaactaagttgtaatctagtagattacatctaaggtgagaaaaagtattaacttagactagattgtcttcatagtgtcttagaaacagaaagccaaatagcaagaaagggggtggggctttttcacaggaaggaggacaatgttctgtgatgtgagagaattatggtggtcactggaaaaaagatagtattcttattgttaaacagaaacagtttggaagccaggatgaaatatctcctcagaaaatccaaattcctgtgttgattaatatcttattcatcacacaacaactgtttaccaactgggctgccaagatacacactttcatgtcattctgctgctcaaaacccaccaatgacttcctatcttactcaagtcttatgaggacctgtaagccccgcacgatctggtccctcactacctcttggacttcagtttctaagatgctctcaactgttcactcaactggagccgcactggccccctgttgtttcttacacaagccagctacagtctctcctgagaattttgtttgtactgtttaaaattctcttcttccagataatcctacagcttgttcctcatacctttgcgtctctgctgaaatgtcaccttgcattagcaaggtcttctcaaccatgccccctgtgcccttaagaccattctcccaagtcactctccatatgacccttagctttttctctgtagttctcaatacatctgatatgtttacattggtgtttttattttctgtcttatcccaccagaatgtaaactctacaaaagcaagaatttagttaagttcactgctgtatccccagtgcctgacacacggtaggtattcaataaatatttgttgaatgagtgaataaataggacaaggactacaagacatgaaacttctaacttcatccagacatatatcctagtatacatcaataaactagcttttacgtttatatatcctatattaaatgtgtcagtcccaaaaatctgatcaacactagctacacaaacaaattgaatttctgaacctatcaacctcagactcctgactttgttgattccaccaagataccatcactagatgaggccccagtttggatggccagccagggtcactgacatcactctaactaaaaaaagaaactcacctgtgcaataatggaaagaatgccaaggactgctataaacgctgcaacactttctggtgaaaatttcattatctagaagggtttccagaaaaggtaacattaatgaatacaaatgtataccagayagaaaaccactgcagctacttgtatattaacatttaatgggccagaaaaaaataaatgtaattcatttataaacaaagaattcctcagaggaaatacaacatatcttaacatactaaaaatgcctacttatccatggtgggtccctcaatgtggatatactaaattggagatacttatcaagaactcagaatcattttacaaataaatattgcagtattttgtgcattttacatgtattggttaaaggcttgatctccgtctagtgagactagtgtcaaggaggaaaatacttgtttttgctctcattttggctagctgctctacttacatatgctctaaatcacaaagaagctggagcaggtgaaggggttaaatcatcccatcaattctatagccaacaaactcaaaccacctatatggacagggaaaactatctttctccctaagccaaatatcttaatataccaaataacccccattagaaatgcataaggaacatcagccacacagaataggaggtaaagtctagtagaccaaataatattctttttatttatttatttatttatttaattttgagacggagtttcgctcttgttacccaggctggagtgaatggcgcaatcttggctcactgcagcctccgcctcctgggttcaagtgattctcctgcctcagcctcccaagtagctgggattacaggtgcccgccactacgcctggctagttgttgtatttttagtaagcataggattttgccatgttggccaggctggtcttgatctcctgacctcagctgatccacccaccttggcctaccaaagtgctgagattacaggcgtgagccactataccaagtccaatgatattcatttttaaaggccacttctattacagttctctcaagattaaatatttttattaaagcactagacaatgaaagaaaagtccaccttagtggaagaggattttacctgtctgaggtataaaaaaaagctggaatattggcctgcctcyggtaggtaggagagaaacactgtaatgcagatcagcagcactatggaatcttggccgactttttttaaggactagaacaagaaaaagactgattgatataaggttttctatcaaaaccactgaactattcttaagaataygcagagattccttttggcagtgtactcatggacaactagttgtcctttttatttatttcatattccccaaactattctgaaaagtatttcaaaatgttaaaagaaaaacccaagatgttttccctaaagaaatatccacaacaaaatattaatgctgcactgaatcatgcacttttttatcaaggagaaggaaaaagtataaacttaccgcaaaagggtcagcttgttcccaggaaatgggtgctccccaggatgctggccgcattttctcaggcaacgactctggcacagcaacaaggataaaacaaatatctagcaaagctattgctgtagctaagaccaccaccaagctgtccccatatactcgtccaagataagctccaattgcaggactggtgactaaacttgcagcaaatgttgctgaaacctgcartaaattaaggatagacagagattagtcaggctacttttttcctcaacaccacataactcctttcataatcttgatttatgtcaggccttctgttgcacaccctcccttttctcttcctacctgtgccatttatctttttytcttgtgggggcgagagtgggggaactgggtcttgctctgtcgcccaggctggagtgcagtggtgccatcacggctcactgtagtcttgacctctcaggctcaagagatcttcctgcctgaagatctcctgatggggctacaggcacacaccaccacgcccagctaattttgtttattttttatagaggtggaagtcacgctatgttgcctaggctagtctcgaactcctgagctcaagcgatcctcccacctcagcctcccgaagggctgggagtacaggtatgagacaccaagcctggccccacttttcttatactctctcctttggcaggaaaagtaaagaattagattcttgccttaaaaacagcctggacaacatggagaaaccctgtctgtatcaaaaaagaaaaaagaaaaattagctgggcatgctggtgtgcacctgtagtctcagctacttcagaggctgaggtggcagaattcctttgagccagaaaggcggaggttgcagtgagccatgacagcaccactgcactccagccagggtgacagagtgagaccgcatctcaaaaataaaataaaataaatgatagcctctcaggacactgtcttcaaactttctaagccttggagccctctgttccaataaatcctactggcaaattcataggtaaaagagatttttttaagaagactgggtgtgatggttcatgcctgtaatctcagcacttggggaggccaaggtgggaggactgcgtgaagccagaagtttgtgaccagcctgggcaacacagcaagaccctgcctctatttaaattttttttttttttttttttttttttgagacggagtctcgctctgtcgcccaggctggagtgcagtggcgcgatctcggctcactgcaggctccgcccccggggtttacgccattctcctgcctcagcctcccgaatagctgggactacaggcgcccgccacctcgcccggctaattttttgtatttttagtagagatggggtttcacygtgttagccaagatggtctcgatctcctgacctcgtgatccgcccgcctcggcctcccaaagtgctgggattacaggcgtgagccaccatgcccggcctatttaaattttttaactcttttagttgaggaagggttgagagcctgggcactgtacaaacacccctccttgactgccagtcatgctggtccttaggggaggggtgtctaatcttttggcttccctgggccacgctggaagaacggtcttgggccacacataaaatacactaacaatagctgatgagcttaaagaaaaaaaaactgcataatgttttaagaaactttatgaatttctgttgggccatgtgtgcagcctgtggaccatnnnnnnnnnnnnnnnnnnnnatgaagtctgatgtctttgttcctatactgctcccctccactgcccccaggccccagctcagtcacctccaggtcgaattcccaagtgtgttgcgcactccagaactctaaattatcttgagactgaaatgaaagaaacggagaggcctagttctcccagcaagaagcagagggcacagaaaggctgaaaaatggattgaggattgagcactaccctggaatgttccagaattttttttttgagatggatccttgctctgttgcccaggctggaatgcagtggcacaatttcggctcactgtagcttctacctctcgagttcaagcaattctcctgcctccacctcccgagtagctgacactacagacacctgccaccatacccgtctaattttttgtatttttagtagagacagggtttcaccatgttggccaggctggtctcaaactcctgacctcaagtgatccacctgcctcggcctcccaaagtgctgggattacaggcatgagccaccgtgcctggcccagaaaatattttttttttttttttttttttgagatggagtctcgctgtcgcccgggctggagtgcagtggcgcaatctcggctcactgcagcctccgccccctggggttcacgccattctcctgcctcagcctcccgaatagctgggactacaggcgcccgccaccttgcccgggtaattttttgtatttttagtagagatggggtttcaccgtgttagccaagatggtctcgatctcctgacctcgtgatccgcccgcctcggcctcccaaagtgctgggattacaggcgtgagccaccaygcccggcctatttaaattttttaactcttttagttgaggaagggttgagagcctgggcactgtacaaacacccctccttgactgccagtcatgctggtccttaggggaggggtgtctaatcttttggcttccctgggccacgctggaagaacggtcttgggccacacataaaatacactaacaatagctgatgagcttaaagaaaaaaaaactgcataatgttttaagaaactttatgaatttctgttgggccatgtgtgcagcctgtggaccatgggttggacaagcttggttaagggcatctccataaacccttaagtgctctctgtgaaaggagtctaaaatccactgctctaaggaaatccaatttcactgtgacttttccaatattaaaattaaatgaacgtttatcttgatacatactgaagggctagctgaaataaagcttaaagacttggaggttcctgttctcatgaataatatgttaagccctggaacaaaactgagcttggtaatctttttagttggcagggttaggaagaatgaaatcacagataaattaagaacatctctaaaactctgaggaagtctatttttttaagcctggtgaagatgaagattaaagttgaaaaggacacgagtagagcaaacctgttaaccgcagacatttctagcctactggacaacagcctacaaattagcagatgtgacagcaggaaacacttcataaaaatagcactcttagtcaggtgaggtggcacctgcctatagtcccagctactcaggaggctgaggtgggagatcacttgatcccaagagtgagtccagtctgggcaacaccctgtctggaaaggaaagaggaaaggaaagcaaagggaaaaggaatggagaaaggggaaagaagaggagaggagagaagagaagaggaaaggaaaggagaggaggagaaaggaaaaggggaaaggggaagagaaaaggggaaggaaagggttaaaaaagggaaaaggcttarggaaaaggcttaaggaaaaggggaaaggggaagggaaaggaaaaggaaagaaaaagaaaaaagaagggaaagggaaaaggggaggggaaaggaaagggaaaaggggaagggaagggaagggaagggaaaagagaaaaggaaaggaaaggagaaaggtgaaagcgaaaaggaaaggggaaagtgaaagtgaaaagtggaaaggggaggggaggggagggggaagagaagggcaaaggaaaggaaaggggaagggaaggaaaggaaaaggaccatattctttcaaagcatagagattaatgttggaattttattctgtttctatgccatttttgacttttggatggagaacttaaacttcacaagaatgcttacttgcaactctattgcttaaggcaagcaattcaattttcaaaggtcaattatttgaacaagtacataaaattctagtaatttcaaacatctagctatcaatcaaatgtccatcaactgatggataagaatacactacacagcaatcaaaaaaaactactggccaggtgcagtgtctcatgcctgtaattccagcactttgggaggctgagacaggcagatcacttgagtttaagagtttgagaccatcctgggcaacatggtgaaactccatcactacaaaacatacaaaaattagtagtcccagctactcgggaggctgaggtggaaggatcacttgaggcagggaggtagaggggagacagaggctgcagtgagctgtaacggcaccactgcactccagcctgggcaatagagtgagaccctgtctcaaaaagaaaaaaattagctgggcatggtggatcatgcctgtggtcccaactgctttggaggctgaggcagaaggatcgcttgagcccaggaagccaaggcttcagtgagccatgatcatgccactgcactccagcctgggggatagagcaggaccctgtctcaaaaaaaaaaaaaaggaaaagagacaaaaatagaacctattgatctatagtatcaacatggatcaatctcaaaagattatgccaagtgaaagaagttagacacaaaagatgttttgtattatttaatttmtatgaagtttctagaaaaggcaaaaccatggtgacagaagctaaattgttggttgcttggggtcacaggtggagcatggggacagatggcaaacagggctgagggaacattttgggctgatggaaatgttctataactgggttgtggtggttttttaaatggtatttaatatattcacatgggggccaggcgccatggctcacgcctataatcccaacactttgggaggccgaggcaggcggaccaaaggtcaggagttcaagacaagactggccaatatggtgaaaccccgtctctactaaaaatacaaaaattagctgggcatggtggtgggcatagctactggggaggctgaggcagcagaatcgtttgaacccaggaggcggaggttgcagtaagccaagatcacacctctgcactccagcctgggtgacagagcgagactccgtctcaacaaaaaacaaactatatatatatacacacacayacatacacacacacacatacatataaatatatattttcaaatgtagtggttattttgttattgcagccctaggtgtggtttcagaggsacccagatctcwgcagggctctggcacaagtgtggggaaagggaaaatggttctcactatgagggtcactgaagacatttgagggcatttacagagatcacatttgtgacacagtgagcaagtcagtacagttgtttcatgtcatttcccttctcctcagttctctccacttggtagccatttctttctgctcagaaaaaagatcacaggggtcaccccgcaccccccaacccccttttttggagacaggtctcgctctgtggctcatgttggagcgcagtggtgcgatcacggctcactgcagcctcaacctctcaggcccaagtgatcctctcacctaagcctcccaggtagctgggactacaggcacacaccaccacacctggctaatttttaaagttcctgtatagatggggtctcactatgttgcccaggctagtctcaaactcctgggctcaaacaatcctcctgcctcagcctcccaaagtgctgggattataagccactgcacctggcccctccaacttttttttttaagagacagggtctcactctgtaccctagactggagtgtagtggcatgatcatagctgcagcctcaaactcctggcctcaagcaatccccctgccttggcctcccaaactggtggtattacaggcacatgccactgtgcctggccacttccccaccttttttctgcatccatattatttctagaagatttcagtgttttttgttttgttttgttttgttttgttttgttttgttttttgccagaacatggcttaatacacagaacctccagattgaaaattgttaatttcaaaactttggctatgggaaaataaattacgtcaaaaaaaccaaaccaacgaaccaaccaaccaaccgaccaaccccaaattgggttatggtggtgtttgcataacagtataaatttactaaaattcactgaactatactcataaaaaggataaattttatggtatgtaaactatagcttaattagactattttttaaatatcctggctatcatcagccttgtatcatttaatgttccaagtttacaactgaaatcattagttctttttcttttcactttttttttttttttttttttaaatagagacaaggtttcaccatgttggccaggctggtcgtgaactcctgatctcaagtgatccgcctgcctcaacctcccaaagtgctgagattacaggtgtgagccactgaacaggccagaaattattagttctttttctaactttctctctataggtgtttcctccccaaaaatcttatgattcttcactataacgtcctttgaatcagaaatcagtcccttttaaaactaattcagcccaacacaatattcagtccttatttatcamaaggtatttgtctcacatttaccgaaatgcatcactgtcctatttctggctattcagtagtgatctattattgtgcctatagtagtcattctattactaggcttttttcctttaattcctagatttgatagatgacacattatactgccataatttagtttaccaaaacagtgtccaggagttggcgacctaccactatggctcaaatctggctgtttcttacatttttaaagagtttataaacataaatacacatgcaaaaacaaaagaatgagacagagactgtacgtggcccacaaagccacaaaaaaggtttgctgatccctgagctagatgttagcctgttgtattttagattagacattaaatgagtagtgattttttttaactcttgacatactaaataattcttatttttaggattctgttaaaaagaactctacaaggtaaaatatactataatttcaattctgacatgtgacttatgaatatctactaaatgaaaagaatcaaaacttacatagcctcataccgcaaaaaaattttaaatgtagtctaatgaatgattttattacaaaatatattttacgcaaaaatcttgtaatgcaaaggtttgcactccttataataatatttatcttaaaaacaaggcatttctcagcagatacaaaaggtatagaataaacatacataccagtccataagccatacttctttcatgctcttgggttatatctgctacgtatgcaaataccacagaaaaagtcactgcaaaaaccccagaaacagagataacagcaaagtaccacctaggaatgaaagataacaagaaatggttagagcaattaccattgttttaatcttctttcatttttataagttaattaagcgtaagagcagctcatttcagtcaacagcttactaggatagttcatggattaactattccataaatataagccacagatattatgaaaacatagggctagaaggagcccttcaatagcagctcagctactatacaggaatacttaaaattagatcatgtattcaggcaaatcttttgaccaactgttgaactgttaagtgattttgctttttctgccaaaaacagcaacaaactaaagtctattataatccatccattactgtttttcaccacaacactagataaaaaacaaaatccagtaaacaagactgaggaacaagtttcttcatatttattttgagcctctatatagtaactaaatgttttccataagttatctttagcttttcaaatgctggcaaaacaaataactcagttttacacacaaaaaacctatatggcaggattcagtgttcataaaactgagaatagacagttactataaacagtgaacaaaatatttaaagagtaaactatattttgctataaataattccaaaatagctgggaataagaagtttctattgtaatactgatgtttagtttctgaaaatcacatataatcataatgagctttcaaaatatcattccaccaagactatcactactaaaatttttctaacacactgcttaacacagcaaattctttgttcattccatgttcaatttttggtaagatttcatgtgcatgagtggccttcatcaaaggcttggtctattagaattgtatctcatctacaagaagaagatcctgccccatataaacctttgggcctttgtagataacaccatggaaataaagcccatccgtgatgtagaactaacattaatactcagtggagtaaaaagaacattagtcagaataaatctataaatctacaaccaaattgggctctgactttaggacaattattccctttttgttagctttccttcccttgcctcctgagtggaaaaaaaaaaaatactgattttaatcaaggtggccttgagtccagactcttgtaactaggagcagcatatccctgaaatctgaccaaagaaatgcaagcagaggtgggatgggaattctgtaaagtttccttaaaagaaggtgatgtgctcttcttagcaactccttccaccttgctatcagtagtatgacttgatggctagagctcaagaagccactttgttcagtgaggtgagagatgaggatggaagaacagcaagatagaaaaagtctgctccactggaactgccataccagctccagactgctcaacttgcagaccctttttcacatgaaaagagaaatttgatttttaagcaactcttattttgggttttgatatatagcaaaacctattcctaactaatatagataatgacaaattttgtgtctgtttttaacattctatacaagaaaaaaagttagcaatcctatccagtccccaaaatattgttttgaaatttgggttctggaatccaaaattaagttagccagaagtctagatgcctccaacagtgtcaactatttctaaaatctttatgaactattacctactgtatttttagaggccttcttatctgtgtgaaagaataaatgtattagaaaaataaaattaaaacctcataaccaagatggcacaagtgaaagaaataaaggaacattaagaaaacaatagctgaaagtgatatttagttgctataatctaaatgtgcacataccatgggctgatcttcattaaaggaattggggcacatgtgaaaaacaccgttagcagcaagaaggattttcggccccaaacatcagaaagagcaccaataagcggggcactaaggaatgacaacaaaccctaaaaaaattaaatgaaaaaaatgaataccacacatctatgagcatgaaccaaaaataaatcrttttactcctatagaaaaattttcaacaactttgtttctaaagtaaatatatcacaaacttttaaataaacaattgcttatctatatataaatttaaaatttcccaagatagtttagaatcatctgtggggctccaggtaggtattaaatatgaactgctctaataaattctcaatcacaataaatccacaatagcaattccatatgctaattacctgtttgtgtatgtgtgtgtatatgtatgtgtgtgtgtatatatatatataaaacataaaacatatatttatatatatataaaacaggctaattacctatttcgaaaacttgtttgtcaaactgaatcaagagtaaagaatttgagctgggcacagtacttgcaccaataatctcaacactttgggaggtcgagggcagatcacttaggtcaggagttcgagaccagcctggccaacatggcaaaaccctgtctctactaaaaatacaaaaaattagccgggtgtggtggcacatgtctgtggtcccagctacttaggaggctgaggcagaagaatcgcttgaacctgggaggcagaggttctcagcagtgagctgagatcatgccacttgcactccagcctgggtgacagtgcaagactctgtctcaaaaaaaaaaaaaaaaaaaaaaaaaaacacgaaaaaraaagagcaaagaattcatwtaataaccaactytttaccctactgatacagttttatattgatgggggttttttagtatagttttttcctcttcaatctgtagtcttacaaaatcattgagatctctggaattaaaatgccaacataaaaacagggaatctgttatgatgtggtttattattatgcatgattggctatattgtagttagatcatatttaaaactcaagtctagaaagtattaagttatctctcaaaatatactccatctaattataaaaattaagttattaatcagtaaacaaacatatattcgcatagttatatatatgtatttatgtatgttcatccgtgtgcgtgtatgtgtatgtatgtatatatacacatatatatgtatgactgatcctacctttactccttgaattaagccgttcatcagaaatgtatgtttaggaaaggtttcatgtaatacctaaagaataaaaaccaaaataaaaatcacatgctatatttcagtcttaataaaatttctacatttacctttttgaacatccattcatactacaatctgatttattttacatattcagatttgtatgacatgcatatgaccattaataaccaaatatttatatggtacttaatatgtcacagggcactacattgggcactttacatatattatctcatttaatccctcataacagccctatcagaaaactgatatgcagaggttaaacatcttgtctaagattacagtcagtaagtaaatggcaaagctgaagctgaacctaagagatcagacttgaaagcctatgtttttactcactatgctatgctgcttccccaaaataactgacttataattctctttcagatggatatattatctaggataggagattgggaaaattaataagtaatttttaattgccacgaagtagatctagaaagattctataaagaaaaaaaatcccaacctatgaaaatgtataacaagttattctatcctttccaaggcttgttctcaaatcatgtggtatcaattttttgcagtgggcagcaagagaaccgctggaatgcatcaaatgaaaaggcaattccaggcaactggaaaaataaacagcagctaccatttttacagcctatatgtactcctgtttaatcccaacactgtgaattagataatattatcactttacatatgaggcaactgagttcctgtttgacttagaaactaatgcttctattatccaatgctatcgctcagtaataacaacagagaatgggaatgtgggtaataaggaaggtagggaaggtcttccctttaagaagaaacattatgctaaatatactttctgacatgttgcaagaagaacctttagaaggatcagaattgctcccctttcttcagttattcttctcctgccaatagcgagaaatttaacaaaaatgtgctcattgtaagtaaaaatcaatttagaggccaggtgtggtggctcacacctgtaatcccaacactttggaaggaagaggcggatggatcacctgaggtgggagttcaagaccagcctggccaacatgtcgaaacctcatctctactaaaaatacaaaaattagccaggcgtggtggcaggcgcctgcaatccaagctactcaggaggctgaggcagaagaatcgcttaaacccggagggcagaggttgcagtgagctgagatcgtgccaccacactccatcctcagcaacagagtaatagcctgtcttaaaaaaaaaaaaaaagaaagaaaaaggaaaaaaaaaaacagtcgcagactgtatgtaaatgaatgggtttgactgtgttccaataaaattttatttataaaaatagtatgtgatctccaggacactggactgggcaaagatttcttgataatactccacaagcacaggcagccaaagccaaagtgagaatggacaaatgagatcacatcaagtttaaagctgcacagcaaagcaaacaacaaagtgaagagacaacccacagaataggagaaaatatctgcaaactatccatctgacaagggattaataacaaaaatgtataaggggctcaaacaattctgtaagaaaagaatctcataatctgatttttaaaaaacgggcaaaagatctgaatagacatttctcaaagtgaccaataggtatatgaaaaaatgctcaaccatcactgatcatcggggaaatgcaaatcaaaactacagtgaaatatcatctcaccccagttaaaaacagcttttatccaaaagataggcaaggatgtggagaaaagggaacactcatacactgttggtgggaatgtaaattagtacaatcactaaggaaaacagttggaaggctcctcaaaaaacctaaaaatggagctaccatatgatccagcaatctcactactaggtatatacccctccaaaaaaaggaaatcagtatattgaagagatagctgtactcctacatttactgcagcactattcctttttttgtttgtttgagacggagttgggctcttgtcgcccaggctggagtgcgatggtgcaatcttggctcactgcaacctccgcctcccaggttcaagcaattctcctgcctcagcctcctgagtagctgggattacggtgtgcaccaccatgcctggctaatttttgtatgcagcactattcttaatagctaagatttggaagcaacctaaatgtccatcaacagatgaatgaaaggataaagaaaatgtatttatacacacagaaaaagaatgagatcctgtcatttgcaacaacatggatggaactggaggtcattatgttaagtgaaataagccaggcacaaaaggagaaacttcacatgttctcaattatttgtgagagctaaaaattacaacaactgaactcatggagacagagcagaatgatggttaccagaggccgggaagggtagtgggagagaggatggttagtgggcacaaaaaaatagaataaataagatctagtacttgataggcacaacaggttgactacagccaacatttattctacatttgaaaataactaaaatttggccaggcgtggtggctcacgcctgtaatcccagcaccttgggaggctgaggcgggcagagcacaaggtcaagagattgagaccatcctggccaatacggtgaaaccccatctctactaaaaatacaaaaattagctgggtatggtggcaggtgcctgtagtcccagctacttgggaggctgaggcaggagaattgcttgaatccaggaagcagagattgcagtaagctgagatcgcgccactgcactccagcctggtgacagagcaagactccgtctcaaaaaaacaaaaaacaaaacaaaacaaaacctaaaattggattgtttataacacaaagaaaggataaatgcttgaaatgatggataccccatttaccctgacgtaattattacatactgtatgcctgtatcaaaatatctcatgtacccccataaatatatacacctatgtacccacaaaaataaaaaataaaatattatttaaaaataaaaaaggaaaaatggcatgccctctctaattgaaaagaattactgggaggtctttgagaaactcctagaagttctttttagagttctactgcatgcattaactaagtagctaagtgataattaggaaaaagttcaattcaacatacttgtgaaaaggaatataaacacacacacaaagagaaagttgccagaagcaactacaaaaaaaaaaaaaaaattgcaaaaaagatctagtcctctagccatattttcccagtccttgtgctaaaggataagatttaaactccttaaactagtatctcaaaactttttacgggactcaaatgtattatgcttttctttcaataatcacatagggcctactgcaagccaaatctttctaggtatgaagaacaggtttggtgttagaaagaatgaaaaacattatgaatgtctataagaagttttatactatgctagatcttatcactaatgattcactttgccaagctgtattccattccaatcaatctgttcgcttcactgtttctgaaatattctatgctttccaatattcatattttatacacggcatcctttcaattttgaatgtttcttccctttctttatctggccaacccccaacccttccaaactgttcctctgctacctaacttttttctccaaagcaatttctcctttggggccatacaatttctaacaaaattttaacagacaaatataacaagtaattcgaatgttgtaaagatttttgatgtcaggatcctttagcactggtctttagaggtgaacagagaaaatgtaacacttttccaaaaaattttatggatcttaacttttttttaactttaaaaatgttgaaagtaaataatccttaaaatgttaaacgctttggggctgtttctgtagccaaggacacgaaaccatctaggtagaagagatgctagtggattttgagtgttccgtaacatggactgtgtatctaggagcttgaaccatcaaacactggcctattatttccagagccataggtctgtcaaaagggtaaagccggccaggaacagtggctcacgcctgtaatcccagcactttgggaggcttaggtgggtggatcacaaggtaaggagttcaagaccagcctgaccaagatggtaaaaccccgcctctactagaaataaaaaaattagccaggcatggtggcaggtgcctgtaatcccacatacttgggaggctgaggcagagaactgcttgaacctgggaggcgaaggttgcagtgagccgagatagtgccactgaattccagcctagacgacagagtgaaactctgtctcaaaaaaaataataaaaaaaaaaattagctgggcgtggtgacatgcacctgtaattccagctactggggaggctgaggcaggagaatctcttgaaccttggcggtggaggttgcagtgagccgagatcacgccactgcactccaacctggatgccagattaagactccgtctcaatgaaaaaaaaaaaaaaggaaagaaaaaaaaaaaccggtaaattccactccttggcattacagatccttatacctactgttattctcatcacttagctaatatgttacataatcaagcaataatcactgattctgactgaactatctactatgaccaaccatatattcataacctctcaaaagtgttagacctcaatctttaaaaatatttgtcagtacaaaatccttctttttagctaaatccccttgttggtagaggctcaccatcttcccctgggcagatcttccacaaaacacagcttttgttttttgactgttctatgagggcttaaaagtgaaagataattgcaacacacagtttttttggtcttaaaatgtcacattagttttaaaaattaagaaattaaggctatcataaatcccaaaccagacattcaaaattaatatgtctaaaactggttatctgattaaaaaaatacttcaaagaatatctttgaaatctgaaatgctgaaacaaactatgatataactgttgagggagggacagggaaatgaaagatactgacttaaaatataaattaaattatgtcttcatcctcattttccttttaaaatgaatgttaaaaactttgactcttgtggcatgcaccatttataatcagtttcaaaacacataaaacagaaatgaaatgtttaaagattaacagacttttaagaggagagccttcttttacccagaaacccacctctttacacacctctcacacacaatgctggggaggagtgggaggagtactggggcccaaaacaaagactgccaacaaagccaacaacaaaaaaacaaaatttgtaagcaaaaagccttgaaatgagtaaaacctttttaaaaagcccatattgaattaatatattgttcttaattagtgacatatactgaatatataacagggtcacttctaaaaagtagatatgccaggctgggcatggtggcttatgcctgtaatcccaacactctgggaggccgaggcaggcggatcacctgaggtcaggagttcaagaccagcctggccaatgtggtgaaaccccgtctctattaaaaatacaaaaattagcctggtatgttggcacgtgcctatagtcccagctactcgggaggctgaggcaggagaattgcttgaacctgggaggtggaggttgcagtgagccaaggttgcaccactgcactccagcctgggcaacagagtgagactccatctcaaaatacacaaacaaacaaaataaaaaaaaaaagaaaaagaaaacaaaaattaaagataataagaatatattggccaggcacagtggctcacacctgtaatcccagcactttgggaggccaaggcgggcggatcacgaggttaagagatcgagaccattctggtcaacatggtgaaaccccatctctactaaaagtacaaaaattagctgggcatggtggcatgtgcctgtagtcccagctacttgggaggctgaggcaggaaaatcacttgaacctgggaggtgggggatgcagtgagccaagatcgtgcctctgcactccagcctggggacagacagagcgagactccgtctcaaaaaaaaaaaaaaaaaaaaaaggaatatattaagcacattagtctatgaaaaatgaataaacaagcctttctaattaaggggactccttccttgttcttaaaaaagatagcctccctttgtccaactaggaaaaaaatgtaccaaaataacacgaaagataacatacctaaaaaaatttaaacaagaagcaaattttaaaaatagctatacacacttgaaatactgataacaaattatggaaacatcacaaaatgctttttttcatagcttgctaacagctcatccacattttgatcaccctacttagctagtggttgggctgcctgacaacctcaactatctaaaacatgggtacaaacaagttactacctgcattccccaaaagactgagcactggaggagtcaaggaagcctgggtgcaaataccaacactgcagcttactgtcagagtagcaa

SEQ ID NO: 12508 - DNA, 12621 bp, Homo sapiens
aaaaaaaaaaaaaaatcaaggtggcaatgttatgctggtggttaaggacagagcctctcctaccacagtgccactgacttgctatgtgaccctgggcaagtcacttaactctaatatgcctcagttttcttctgttaaaatggggataataatactgagctacctcaaagggcagttttgaggcatgactaatgctttttataaagcattttgggatccttcagcaaaggaattctcaagacctgagtattttttataataacaatgtccaccatgaacttgatctgtctgtgtgtcccggaagctatcattagtctatatggttctctaagagactgaatgaatccattggagaagtggtggataactagccggagaaaatttgagaatgcttaaactcattcccatggaaacatacacaggacaccttttctttgatgaggtgggatttttccctttttatgtggcatactagtaatttgtgacctaagaataattttggaataatttctattaatatcaactctgaagttagttatactgatctgagattgtgtttgttcataacaaaagtgaaatgaatctggaaaaaaaaaaaaaaaaaaagacagcacctctgtgcacatttcattggctaaagcaagtcacgtggctatgcctacctgcagagggagtggggaaggcaagcctactacatgtccaagagaaggagtaactaagtactcctttgtgagaagtcctaaggcttatcatacccacaaattgacttcatgaccactaatgattcatggttgtgagcgataattcagaaaacactcattgaaaggtttcgtatgctaacctacagtctggctcactacaacttccttctactggtcccagctctgcccctggggatactcaaaacacatctgcttcccctgcctcagaacagtcctagttggagacaacatctctcttccctaagtctgtctttctcctggcgaaatactcccaattcccccagttctccccagaatgagactttcagtttcctctccatcccagtcaccctcttcagccagtacacctcctaaagtgtcacctcaaaatatggtctgaacagcttggagctcaaaagttcccatttactcagagagataaggctgagtaaacttaaggacaggactgactttcagaagcaatttctgtagagccagttatttaacttcctcattcagtaaattctgataatcatattcccactggggggcccatgaaatctgatcagatcattttccaccttaaaactccgacaatggcttccagttactcaggatggaatacctattccttcaagtggcccagaaagccctgttgtaggttggcttctgcctgcttctccagccttgtgtttcacaaccattcctttctccttacactgcaggatactggacctctttcagaatctagaatgtcctctttcctgacttcacattcacacgaactgttccctctgctagggcactcccaacatcctcctctgcctcactaatttaactcctctttatcttcagctctgtttaaacatctcttcctccaggcgaggttaggtccctcaggtatatgcactttacatttctctcagtacttggctcactcataatttacttataactaattgtaattgcttgtaatttacttgtaattacttgtctatcttgcccactagattgtacatcccatgagaacaaggacttttttctgctctgttcaccactctagcgtctacagttaagcctagcacataggaggtactcaaatatatactaactaccaaataggtactaagcatgttggtacttgggggttagggatgcaaaaataaataccagcttactgtccctaacaattcctagtttggagatgggtaaagaagaaaaagtggccatggaaagtgctatattcattgtattatagagaaggttggggagcacagaagaggatcaacccagctttagaaggattagagaaagcttccagaggggtggacatttgagctagcaagaaagcacaagggaaaaggcatttagacagaggagacaatttgtcctgacccagaagcattggggtatgctatgcatggatagacaaagaatttgtgcaaaaggggagcagcaaggcatgacagacacagataaaacagcatcaacaaccagggatcagggcaaaagtctggacttgatcctgctggcaatggagagagaacaaaggatctttctgtaaaaatgggttctccctatgttgctcaggctggtctcaaacttctggcttcaagcgaccctcctgccttggcctccaaaagtgccgggattacaggcatgaaccaccatgcccagcctaaagaacaaagaattataagcagatgaatgacactcagatttgtgttacttactaacacaaatgacatatgttaaaattttatttaaatttacttaaccatttccaaaacttactggcttaaaacaaccactactttatttgttcatgattctggaggtcagcgatttaggttggtcttggctggggtcactcatgctgtttgggtcacctaaccgtttaactgagcttaggaggtctaagacagcttccagcacatgtctccagcaggttggtccaggcttcttcacagagccgcagaagagctccaaaatgagcgtggaagttgcgaggcttcttgaggcctacatgcagaagttgcacagcatcccttccaccagactttactggtcaaaacaaatcataagatcagcccagattcaagaggtggggaaacagactccatctcttaatgacagaagcagcaaagtcacattgtactgggacaggatgggaggaattattgtgatcggcgatcacacaacagataaggggtggcatgagaggatgggggagaatggaagaatttagggctgattggagtaatagaaatgagttttgaggctactgcctttgatcagtgagaaatgataaggccctacctaaggtaggaatgctaggaaggagagaaatataagcgacatttcaagaaaggaatttcagattgtggctgggcgcagtggctcatgcctgtaatcctagcactttgggaggccaaggcaggctgatcacttgagctcaagagttcaagaccagcctgggcaacatggcgaaaccccatctctactaaaaatacagaaattagccaggcgcggtggcatgtgcctgtagtcccagctactcagtaggctgaggcaggaggatcacttgagcctgggaggcggaggttgcagtgagccgagatcacaccacggcactccaccctggtgagagccagaccctgtcttaaaaaaaaaaaaaaaaaaaaaagaaatttcagattgtaactttttgagttacttaagcaatctaagcttgtttccttctctataaaatgggactaaaaagagtatatcagctgactctggatttgctgcctatgagttagccttactctgcaaggagcagtactgttcaataaaagattgctgtctaacaccactagcttgcccttgaattctttcctggctttctcccaggctaagccccagttttgaggcttgcctgccctgcaataaaaacacaccataaaaatagtgcaaagaaaagccacaaaatggatgaaaatgttcaaattaacgaataactctttcaaagttttataataaataggcaacaacaaaaaagagcatatcccagggtttctgtgaaagtaagaaacaatgatgtaagtaaaacaatgcttttttcacatgggcctggctcaggtacgttcgatatacagtagtgattactgtcactgcatcaaggatagctgcagtttctggcatgggcagcagggtaaagggtggtgttaagtttggagatgaagaatgcagatgggaagaagggcagattggcaggggtgagagtggtgatttgagttgttactggggtctctgcttgacccccttgccttccactaaagaccctcaaatctgagatcttctaatccaaaggttcttaacttgggggagataggccttaggaagtaccaaagcccctgaaattatatgtaaaatgctatggtgttttttgtctttatttttctgagaacggccaaagcttttaccagtctctcaaacagatttgtgactcctaaaaggtgaaaaccatagatccaagctatcaatgtatattgacccataactgccccaatacctgaccctctgctgtggttcaactgttgcaaatcacaaggaaagaggagctcatgaacaagactgaggcaatactgctaagcttccaggtctctcaatatgatccctcctacattaagccatattttgcattattattctctgtgggcttggttctctacccactttttttttttttttttttttttttgtatttttagtagagatggggtttcaccatgttggccagcctggtctcgaactcctgacctcaggtgatccacctgccttggcctcccaaagtactgggattacaggcatgagccaccatgccaccatgcccagccaacccccttctctttttttagggagacctcagatgtacaaaattgaattaatcataatctttgtttataacatacttttatcacttttgtcatgaataacaaatttttatgtataactttttattaacttagctgcttttaataattcaataagcaccaaacataaaagctagagccttaacaataatctaactttatgttccctccagccccatcctatccccctacctctaagaaccattatactgaattccatagtgagaaccattctttccttcttacatggttttactgcatacatgttctttttacatgtttttaaattcttaattgtatttaattttatagcatcactactcattagagaaatgcaaattaggaccacaacgaggtatcaagatacatccactagaatgaagtttttatttattatttatttttgagacagagtctccctctgttgcccaggctggagtacagtggtgcaatcccagctcactgcaacctctacctcctgggtgcaagtgattctcatgccttagtctcccaagtagctggaatcacaggtatgtgccaccacacccggctaatttttgcatttttagtacagacggggttttcccatgttagccaggctggtcttgaactcctgaccttaagtgatccgcccgcctcggcctcccaaagtactgggattacagacataagccacactgcccggcccactacaataaagtttaacgttgataatcctaagtgttagtactaagatgtggagcaaatggacctctcatacattgctgatggccgtgcaaaatggtagatccactttggaaaacagtatggtggtaccttataaagttaaacatacatttaccatatgacctagcaattctacccctaagtatttactcagaagaaaacatgggctgggcacagtggttcacacctgtaatcctagcactttgggaggccgaggtaggtggatcatctgaggtcaggagttcgagaccagcctggccaacatggcgaaaccccgtttctactaaaaatacaaagaaattaaccaggcatggtggtgggtgcctgtaatcccagctactcaggaagctgcagcagaagaatcgcttgaacctgggaggcgggggttgcagtgagctgagattgcaccattgcactccagcctgggcaaaagagtgagactccatctcaaaaaataaaaaaagaaaagaaaacacgtactcacaaaattatatgcccaaaaggtattggcagcattactaataatagccccaaactggaagcaactcaaatgtccatcaactggtgaacagataaacaacatggtggtatgtctgcaccatggaatacaattcagcaataaaaaggaacaaaacattaatactcacaacaaactgaatctcaaaaacattacactaagtcaaagaagtcaaacaccaaagactacatattgtatgattccatgtatatatgcaaaaattttccaagaccaaatatttgaaaggattatccaggcttcacagagcataatcacttaagatttttatttaaaggcaaaggatacagggcagcaagagaaagactaggtaggtaaacatcaggaatctcagaattcccaaatacaagctccccatggtccttatgcacatgtggactgcactgcaaagtgcctttggattgaatcatcatgatctatgtgaggcatccatcctggttttggaagagctcaaatcagaagttcccagcagggcttttatgttgctctggccatgkaatcaagccagacataygtaactggttagaccagctgcaaataatcaataaaaggagtgaccagtggagcttcagactttatttatttatttacttatttatcgaaatgaagtctcttgctgtcgcccacgctggagtgcaatggcgctatcttggctcactgaaacctccacctcccaggttcaagcagttctcccgctccagcctactgagtagctgagattacaggcacctgccatcatgcccttttgtacttttatagagatggggtttcaccacgttggccaggctggtcttgaactcctcctgacctcaggtgatccacctgcctcagccttccaaagttttgggattacaggcgtgagccaccgcacctggccgagcttcagactttaaacagcacattataaatcccaatgcctttttttttttttttttttttgagacagagtctcactctgtcaccctggctggagtgcagtggcacaaaacggagtctcactctcttgcccaggctgctcactgcagcctcaaactcctgtgctcaagtgatcctcctgcctcagcctcctgagtagctgggaccacaggcacatgccagcgcacccagctaatttttttttttttttttttggtaaagaccaggtctcactacattgtccaagctgatctagaattcctgggatcaagtgatcttcccaccttggcctcccaaagtgttgagattacaggcgtgagccactgtgcctagcctattttctattttctacatcttgatggtgactatactattatatacaattatcaaaatttattaaacaatatatttaaaatttatgaactatattgtatgtaaagaataactccatagaaaagaaaaaacctttcatttagaaagggcatcatgctacatttactcttctgggattaaacttttttcacttaattattttattgctcagattcatccatatggttaggtatcattatagttcatttgacaattgtataatgttctattatgtgaatattccagtttacttgtccactctcttgctcatgggcatctgggttatttctaggcttttgcttttgtgaatagggttgctatgaatattcttgtacacatctcctggtgtacatgtatgagtttctctaggatttatccccagtattggattaactgggttatagggtagctgaatgttcaattacagcagataaactgttttccaaagtagttctctgcttttcttatctaggtctgcctgtccccaattagatgatgactctagaggcaggggaccctctcattttgaattaccactgcttagcattcaattagcactaggctggatatccaggagtccaagggcagaagcccaggcacctgaggcctcttagcctcagcgaatactaagtactatacagagtgaacagcatgcagggaccatatgccacgcacggaggcggttacggtcctactcagagcactagccatgctccttaaagctccatcttcctagcttcacctgattttgagtctcagagatcttccagggccctcaattacaatgcaaatcccaaaagaaggcttaacctcagctaaagtccctcctcaactgacacctctaatacccaaataaggatgagcaggaaagacagaagggacaaaaagagtggcaggaagaggaggaataaggaaagtggaaaagccaagaagccttcaggtattctaaaattatatacccttttctgcacaggatgttttccaggaaaaaaaaaaaaagtttaaaaataaaatatctgcaagtgaccctgagcaattttttatatccctgccactaaaggttactttcttttggctaaagttacaaaaacaacatatcgagtatgcagtcagtaaatgatgaaatcttgccctgaacacagtgtgtgcagtgaagccctgtgatgctgagggaagagttagggattagggggtgggccaaagaacaggcaccagagctcagctgcagactagaaacaacaaaaagtctggaatccaacaaaacaaaacatcaggaaattcctaggtgttcagaaagcaaaaggagagttaccattctaaaggatgaggaagcccagtaatctcccacaatcccaactgctacatctccaagagctccctagctacctgtcatacacgaggtctgggaatacctgctagatgaatgaacaaagaacaaggcacgcacaagagtatgacggttttgtggcagaagcagcctcctaagccacatttgggcagcagtattgttgacagcaggaatggccagaattattcagctcagagggtttttccaatgtgagtaggtaagcagattattttgcactggcttaacatttttagttacttgttccttaaattagatcatgagccatatggaaaaaccaggcgggcttaattgagcctgttggctgctcaagactggtcaggtggaactcacttcaagggtgacaggggctcagtaactggctggtacaaatggaactaatggcatttgcactgacatgaagtccccaactgcagccccaggtctatagagtttcaacaactttattggccaaatgcttctcctatgtttacaacttagtgtgagcctgctcactggcttctccttctaagcccctaagcgggcagcaaactttagtacaggcctggagatggggtaggggttaatgagtgagttggaaacctgctgatgctccacaattggacagcaggacagcaaatcttctacttcttattgccgaaaactgcagaaagacacgaacaggatggagacaggaccgagagtgcatctctgccactggtcccagtttccagtttctggtgcatccaacagagtataccctttgtattcttgcttcagggattgggtgatactatgtcagcctacgcattttgcagaagtacatggggccaaaattggccatgaggtttggtattaccagctccccaacctgacaggatgagaagaaacaaaatgtgtccatgaaaacccttcggaagtgagtcagatcttccacctgtacctggatgctgtattgattggccaggagctcaatggcaccttgcaccacatactcgttctgtaagtgtgagagtgagcaggtagaatagacaacatggcctcctggtttggtggcaaggagtccagccctgaaaccagaaagagacagaagcagtgactagtgagcttcccagcagtagaagagcaacataaggagctggaaacatggataagggaaggctactacaggatgggtagctggttagactgcctctcaagtcccttccacaatgacactgtctgaaaagtcactctcaaggcagatagcaacccaaccttactccatgagctcttcactaggaagtctccttacaatgaccccctgagctcttgtttatggaccaaattgctatgctggctatagaatgagtccttactctagcagctatttttcaaacatgtgctactcactggtactgaggatgaaatagcatgagtcaatctgtgcagcccactctagtatatatatcctactagatagggttgcttttttgtttttgtttttgttttttgagacagagtcttgctctgttacccaggctggagtgcagtggcacgatctcagctcactgcagcctccacctcctaggttcaagtgattctcctccctcagccccctgagtagctgggactacaggtgtgcatctccacacccagctaattcaaatagggtttttatgttccagagatgatcccatttctgtctcctctaggcagatctccagccataagattcttgtgtgggttatggtcttggtaagagcttccagtcccccagtctcccagagcactctggcacaaagtcctgagtttaaaaatctgtcactcacgcaagaagctgcacttgcagcacaggcaatatctgtcgctccttcttccttgaccgcttaaagatgttgttctcctcctcatgaagggagtggcggtctgtggtacagggcacatccaccagcacctacccagagtgttaaagggtaaagtattaaagatccttataggcttctcttccttaggccagagatgttttaggcccctggcctaagtttgtgaaatattccctctgcccatccctcctttgcagagtacctgacaaagttcttcattttaacttggtagacaattgtgaaataatgagtggaaaatagtatatttgggaatattcatggctggtcaaaaacccaaaactaacacacaagtaactataattttttttttttttaatttttagagacaaatcttgctctgttgcccagactggagtacagtgatgtgatcataggtcattgcagcctcaaactccctgggatcaagcaatcctcccacctcagcctcctgagtagctggggccatagatgcaaaccaccactccagactaatttacatatatatatatatatatatattttttttttttttttttttttttttttgagatggagtcttgctctgtcgcccaggctggagtgcagtggcgcaatctcggctcactgcaagctccgcctcccgggtttacgccattctcctgcctcagcctcccgagtagctgggactacaggcgcctgccaccatgcccggctaattttttgtatttttagtagagccggggtttcaccgtgctagccaggatggtctcgatctcctgacctcatgatctgcccgccttggcctcctgaaatgctaggattacaggcatgagccaccatgcccggcctaatttttgtatttttgtagggacagcattttgctatgttgcccagactaactataagataattctttaaacagtacacttatgatttggtcacttctgtattatactccaataggaaagttattacagtctggaaaacatagtgagaccccacctgcacaaaaaaaattttttaattagccgggcgtggtggcatgcacctgtagtcccagctacaaaaaatttaaaaactagccaggcatggtggcacacacctgtaatcccagctactcgggaggctaaggcaggagaatcgcttgaacttgggaggcagaggttgcagtgagccaagatcgcgccattgcactccagcctgggcgccagagcaagacgccatctcaaaaaaaaaaaaaaaaatttagccgggcgtggtggcagcgctcttgtagtcccagctactactcaggaggctgaggtgggagaattgcttgaacctgggaggcggaggtagcagtaagccaagaccgcgccactgcactccagcctttggcaacaaagtgagacttcgcctcgaaaaagaaaaaaaaaagcttactacaggacacaaaaataaccacaaaacttaaaaggaaacacgactccttgagcaagtcagcagaaacagcaaccagtaaaactaaattcccagtttatttgtttgtttgtttttgggatggagtctggctctgtcacccaggctggagcacaatggcacgatctcggctcactgcaacctccacctcccgggttcaagcgattctcccacctcagcctcctaagtagctgggactacaggcgcacaataccacgctcagctaatttttgtatttttttagtacagacggggttttgccatattggccaggttggtctcgaaatcttgacctcaggtgatttacccgcctcagcctcctaaagtgctgggattacaggcatgagccatcatgcctggccggccccaatttgttttttcaatgagactagtcaactgctggagtgagaaagggagaaagagcaggagtgagaaggggagaaagagtagacgaagttccatctgtaactgattgtcaacaatagttttgatataggaattatccaatgtagaattaaaatattaatataaaccttcctaaataacaaaagaagttaaaagaaaaacaaaacagcaaggacagagaccccacagtgaaagaaacatggtaaataaacacagtaaaataatttgacaggtgtcaggcacagcggctcatacctgtaattccagcactttgggaggccgaggcaggcagatcacaaggtcaagagatcgagaccatcctggccaacatggtgaaaccccatctctactaaaaagacaaaaattagctgggtgtggtggcacgcacctgtagtcccagcta

SEQ ID NO: 12509 - DNA, 12666 bp, Homo sapiens
ttatgatcaggaaagcaaatggctgagactgggtaaaaggtaagatcagtgataaagaggaggtccagaaaatgacaggtcagtgtatctgaaggatcttctctaaggatactgaaatcatccaagaatcatgatggaagtaatggtgaagaaagtaacagtaagctagtggcaaaatgttttcaaaaagccaaaaagaagccaggcatggtggcatgtgtctgtagtcccagctactcgggaggctgaggcaggaggatcctttgaccccaggggtctgaagatgcagtgagctgtgattgctccaccgcatactccagctccaacctgggcaagagaacaagaccccatctctaaaagaaaaaaagaaaagtgaaagagagtgatccaggaatcaggagaggtagaggatgggatattgtgacaaaatgagatttcaacttagatatttttagggaggaggaaaggagaatagcagtgaaggacaatggagacacctatcccaccaacagaggccctatggtgaaaaggttttgagaataaaattagcaaccgttcaccggggcattacgggaagttgtgtcatccaggagcaccagattttgatttagtgctagaaagccaagagaaccttcacagaagagactgaagacataaacgaaaccacagtggcagacgaaagcttctgatcttgatacacatatcttaagtacagctgacagaagaataaagagaaggaaaaaggagaaaggagaaaggaggaggaggagggaagaaagaagaaagcagaataaagcagcttttgcacaaattcaagcaagagtaaaagagaagagagaaggagagaggagggtaaaacatacagacggcaaataagcatatgaaaagatgctcaacatcatatgtcatcaggaaactgcaaattaaaacataccactacacacctattagaatgactaaaatccaaagtactggcaacaccaaatgttagcaaggatgtggagcatcaaaaatgctcattcattgctagcgggaatgcaaaatggtatagccactttggaagacagtttggcaatttcttacaaaacaaacaaaaaacatgttcttaccacacaatccagcaattgtgctccttgatatttacccaaacaattggaaaatgcatgtccacacaaaaacctgcacacaaatgttttcagcagttttatatataattgccaaaagttggaagcaaccaagatgtgcttcaataggtaagtggataagcaaactgtgaatttatggcctaaactgtgtcctccaaaattcgtatgttgaagccctaaccccaaatattactatatcgagagatacagtctttaggaggtaattaaagttaaatgaggtcattaaagtggggcactaatctgataggactgtggccttataagaagaagaagattctctctctcagtgccatgtgaggacacaagaagaaggcagccatgtgcatgcaagccaggaagagagccctaaccagaacctgaaggtgcggccatcttgatcttgaactctaacctccagaactgggagaaaataaatttccattgtttaaaccacgcagtctgtggtgttgtcttatggcagcctaggcagactaataggctatagaacatacatactattttttgtaacactgtaaatagtatttttgtaatactatttagtgctaagaagaaatgagctatcaagccatgaaaagacatggagggaccttaagtgcatattgctaagtgaaagaagccaattcaaaaatgctacatactgtatgattccaactatatgacattctgcaaaaggcaaaaccatggagacagtgaaaagatcagtggttacctgaccagaggtagggaagaggaaggaggaaaaaataggtagagcatagggcttttttagggcagtgaaactattctatataatactgtaattatggatacatgtcattatacctttgtcaaaacccatagaacagtggttcccaaccctgttgggaaccaggccacacagcaggaggtgagcagcaggtgggtgagtgagcgaagcttcatctgtatttacagccactccccatcacttgcattaccgcctgagctccacgacctgtcagatcagcagcagcattagattctcataggagtgtgaaccctactgtgaactgcacatgtgagggatctagagtgcacgctccttatgagaatctaacgcctgatgatctaatcactgtctcccatcacccccagatgagaccatctagttgcaggaaaacaagctcagggctcccactaattctgtattatgttgagttatataattatttcattatatattacagtgtaataacaatacaaataaagtgcacaataaatgtaatgcacttgaatcatcctgaaaacatttcctgtgcctccctgtccccacctcctgtggaaaaattgtctttcatgaaaccagtccctggtgccaaaaggctggggatccctgccatagaatgtacaacagagtgaactttaaatgatgggcttagttaataataatgtatcaatactggctcatcaattgtaaccaatgtaccacactaatgcaagatgttaccaataggagaagctggggatgaaggggaagtatgtggactctttgtactatctgctcaattattgtgtaaatctataattatactaaaaaagtaggcttattatttaaaataattatgtgaaattcaaatttcagtgtctataaagctttatagaaacacagccatgctcacttgtttatgctgtctctggctgctcctgcactatcacagcagacttgagtagttgcaacagtgaccatgtaatcacaaagcctaaaatatttactatctgaacctttacagaaaatgtttgaagactcttgctctaaatttcattacctaagttaaaaagaaaaaggaaagcacatccctcacaggctgttctgagttaatcactttatttaaattatttagagttgttaaaatcacaggacatactaattacataatctgatttttaaattttaactagatagtgtctaatattaaaaaaaaatcaaggctagacacagtggcttgagcctgtaatcccatcacctgggaggttgaggcaggatgactgaggccagttggagaccagtctgggcaacacagcaagacccctgtctctacaaaaaattcaaaaattaaaaattaaccaggcatggtagcggtgtgcacctgtagtcctagcgactcaggaggctcagatggaaggatcacttgagcccaggagttccaggtcacagtgaactatgattgcatcaccgcactccagcctgggcgacagagcaagaccctgtctctaaaagaaacaacaacaacaacaacaaaatcaagtaaatcagtgaagtacttgaacatccaaaacagcaactgtcacagaacgaaacactatcagacagtagtgtttcactctattgccaacaaaatctatcctacttactgaacacctaaggaattaaattaaagtcttcaaagaagagaagactgttaacagtttgaaaagggaaacctggaaaacaatggaaatgggcacattcagggagggacagggcaggatacccgatagaagtgagtcggtgaactgactacaaagaactgaatgctctgttagagaacattaagtcaagtgatcagataagtctggaaaatgcagcctgggtatcagaagacgacataaaattatgctaccaggaagtgtcccacagttatactttaagaaatgtcactggccgggcacagtggctcacacccgtaatcccagcactttgggaggccgaggtgggcggatcacctgaggtccagagctccagaccagcctaaccaacatggagaaacctcgtctctactaaaaatacaaaattagccgggcgtggtggtgcatgcctgtaatcccagctactcgggaggctgaggcaggagaatcgctcaaacccgagtggcggaggttgcggtgagccaagattgcgccattacactctagcctgggcaacaaaagcgaaactccatctcaaaaaaagaggtaaagaaaagaaatgtcatgaaaatataatagctgactagctgacaaaataaatcataactacccaatatattcaagtagtcttattaataaccagggatcttaggaagaataaaatctgtagacatgagttaggaaagcattatagaatagatgctaggggtacagactttggaggtagaaaaacctggtctgatccttcttctgccactaactagctctaagaatctgagcacaaattctgttagcctcagtttcctcatctctaaaataaacagtacctcattggactgttggtaggattaaacaaaatacttcatgtcaagagtttaacagggtccctgacacaaagagctaaataaatggttactgtcactaatgcatttggcttgggaaaatgggaataaaaaatcttaagttttccagcaactcttaaaaaatctacccaaggattaaaataaatctccaatagaatatagttttagagaacatctgtccttgaaacaattaaatgactttgttcaataaaaagttgagattccttccactcctgctattgagaatgctgatccaagggagaaagataaactgggttccccccagttccaaggctgatgagtggtgtaggctcactagcgggcccatttgggaacctacacaatcccaaattcatattggaacctaagaacaatattactattatatcttgcaatcaagaggagaataaaagtctcctctaaatacttagataacaaagtttcttcattctcatttccacttcatcccattccacccttcctgaccaccaaaaccaaacaaaatatccattaacaagaaaattaagagctgtatctggagagcagtcaggattacaccataagtattaggtgtagctaagcagggacccgaggtcaggtgcttgggtgttttgcttttctgccaagacggacatcaggcttaaaccaatagtaaaagctgtaagattagaatttcttgtatataaccacattctctcatatacaccaaacacacaaaaacccactccattgtgctcaccgcccacatttcacactcaggaaatagcttgtagcctttttggcggtcccagccattttgctctaaacctcctaaagacgtccagtgttagccacacaaaaagatcacccggtacttccccagtgggaatagtgaaaaacgacagttaactccagttagacaatattctactctccctgtggccaggacagaagccgaacgatactcccagactcttccaggggcacgaacaggagtgacgaggggcctcactccccaggcagggttggtccacacctgtcaccacgagtgggcggaagtagggaggaagaaacctttagacgcgaacccgagccaccctggtacattctcagatcccactcaccccaatcttcatccagcctgtgaaagagtcccgggctaaaaggtgactccatggtgccggcaaccccagccggctcccccatttcacaagttccttctccctggaactccgtgattaatatctgggacggcggcggcaggcggacaaaatactccgtaacgctgacgagacggtggcctagtaaagacaaactacttttgccgcacgagggatttgtacgacacaggaaaacgtcagagactaagcaaatttgaatagacctctgagtaaatatttcccttttggagttttcaggactttctgtcccgctgttttatggggaaggcgggggaagacacgcagacatcaattcgactaaacaaagtttatcaataatattaaaaataaaaagtaaagcccctttctgaacattatggcttattccttgattatccttcttaatgccacagcgtggctatctcagaacaaaattagagactaacagtaaatttactttaatttttacgaataattctctatcaatgtaaaaatttttcatatacgcgtgtatgaaagaaaaacactactatttttccacattcgtgaaaactgcttaactgggacagtaaccgaggtaagtggtactataaaacatacttctagaaagactacttttatttaaataaattgaaacaaagcaaatataaaaagataaaccccccaaatttatctcctaaagataaatttctaaagcatagtatttagtcaaagtccaagcgagtctaccctaagacctacagtaatcgaagttcccaatatttgtattactaaagattcgggttttatttaaaggaaawtcacatacatcacgaactccaactgaaaatatgaactgagtttgataaagcagtttcaagaacgctacttaagagaatttctttttcatccattttaaatttcagcggccagtgaatatttaaaatactgtaaccgacgaatacgtatgcttctaggaccacgtggaatctttcccatggtaggtaagcaaaacaaatgtgcttcccagaaccctccaaactgctcgtgggtatattactacagattacataatgcagcagcgttccgggacgcaagcccagaaaaagataattaaatccccttacgtcagatgtaactacttttgtcattagaaaactaataaattttcacttaaggtgaaatttataacactttaattctcacccaattacaaattcaaaaattgacataaaaaactaaaataaggccgggcgcggtggctcacgcctgtaatcccagcactttgggaggccgaggcgggcggatcacgaggtcaggagttcgagaccagcctggccaacatagtgaaaccctgtctccactaaaaatacaaaaagttagccaggcgtggtggcgggcaagtagctgtaatcccagctactcgggaggctgaggcaggagaatcgcatgaacgcgggaggcagaggttgcagcgagcggagatcgcaccactgcacaccagcctggtcgacattgcgagactgcgtctcaaaaaaaaaaaaaaaaaaaaaacctaaaataaaataaaatcatcgagtcttctgtatcccactagacaccttagtcttttaagaaaatcaccatgacaaatcgccaatttttttaatttccaaaagattttatttttattcaaaaagtgcaagtaattatgaaacaaacatttgtgacctatcaccaagaatttaaaaatttaacatttttcatttttgtcccagatttttcataagaaattaaatactacagaattgaattcctctttcctccctgcttcattttcctcccttggcgtaggccacttctaccatgaattttatgggtataaaattttattttataaaaataaaagtgtaattctagtccacttttatttttagttttacggtgcttaaacatgtttatagacacatgcatttagtgtcatttgggtttttttaatgtatgtaaactttaatgttctccaaatcatttttcttattggatattaaggatctacccatggtatttccttgaatgaatctcaatttctctctctctctccctctttttttttttttttttttttttgagacaggggctcactttgtcccctaggctggattgcagtggagccatctcagctcactgcagcttgacctcccaggtttaagcgatcctcatgcctctccccacaatagctgagactacgggaacccaccaccacacccgactaatttttgtattttttgtagagacaggatttcaccatgttgcccaggctggtctcaaaacttctgaattcaagcagtccgcccgcctctgcctcccaaactgttgagattacaggcgtgagccaccgcacccagcctcaagaatgtcttaaataatgtatgtactattttatcagtttacaccctcactagcattgatgagttctctttgttccacattctctccaacacaagatatggtcagactcttaccatttttaccgctgtgaaaattgcaatttacatttccctaacaaagtggtgcattcttccatacttatgaaaccttatttcctcttctgtgaactgtccactcttaccttttataaagtttgctatggagttttctttcacaaatgatgtgtacgtcattagatagcctgctctattcattcacctgtataaagtaaaactaaactcctaagtccgccaccaacagaataggcccccttgtggccaaggggatcctagaaaaccttaaaactgagttctagaccacgatgggacaggttagacacaccttgttatactccctcccttttgtagtttaacacaacaactggccagcattaatgttaaaacagagatgataagactgacagaacagactctggcaataagatgccaaattataaaaaagacctaaagccattccaggcaaggttttagtcccacacccctatacttaaagaataaactgtgttctaactgccacaagattcttctctagcagctaaacaagtactggcctaaagataaacaatattaaaataatgtgcagctccacgagatgctgacttactgacccccagtccccgttccaccagccatagctacagctttcattggacaactttttgttgatttcagtaactttctccaggtaagaagaccactggccatggactggttctggctggtctacagaggtcgcacatttgcatggcttcatgtcctgaaagaccttttgacgtatagggctcgtaatacatttaaatgttaagtcttggctgggtgtggtggctcacgcctgtaatcccagcactttgggaggcccaggtgggaagatcacgaggtcaggagcttgagaccagcctggccaacatggggaaaccccatctctactaaaaatacgaaaattagccaggcgtgggggcaggttcctgtaatcccagctactcaggaggctgaggcaggagtatcgcttgaaaccgggaagtggaggttacagtgagctgagatcacatcgttgcagtccagcctgggtgacagagcaagactccgtctgaacaacaacaacaaaaaagttaagtctccatcccaaagtgaatatgggtcatatgttacatgagtttttgttcaatacgcatgtgtcaggaccactttcatgaatattcatagctcttcctgtaacctggtgaaaatgtaggtttagccaacctgttcagcctgaactacactccaagccctcctccttcaaagcgcctgtttctggaggcacgcttcccagcctgcaggatggccaccttgcaggccataaagtctccccttcttttctaaatttattcattgtggggctttttaatatatacatttttaaaagagagagagagacagagtctcgctttgttgcccgggctggtctcaaactcctaggctcaagctatccttctgcctcagcctcccaaagtgctgggattacaggcatgagccaccgcacccagcccattgttgggcttttttaagttaacgcttggtatatgttataaataccttctcccaggttgacacttgtcgtctttgtttacggtgatttgttctctagattttaatttcaatgtagtcaaatttatcaatctgttgttatgatagctgacttgtagctttcttaagaaatccttccctctcctgaggtcactaagattttcattttcattttcatagttttatagttttgtttttcacatctttttttttctatttggctattattggggtatagcaacactgtggatttttgtacagcaatcttgtaccaaaaaccttgttgaattctgttattctagtattttgtctgtgccaggaacagtggtacacacctgtaatcccagcttcttgagaggctgaggcaggaggattgcttgaacccaggtgttcaaggctagcctgggcaatatagcaagattctgtctctaaaaaaaaaaatcatattatggtagatggaaactagtatgtgataaaataaaaatgactttaaaaaaatttgtctaaagttctttaggattttttatttagcagaacattatgcaaacaccaaccttttaaattctattttatttaatgttttaatttgtaaaataaacttagtatgaaaattttcaaacaaatacaagagatgatataataaatccctgtgttcctatcatccagcttcagcttaaacaatttgccattcttgttttatctatcctacctctcctctccacaacttttttcattttgttctgtgtttttcccagaatttttttttttttttgagacggagtctctctctgtcacccaggctggagtgcaatggcgtgagctcggctcactgcaacttctgcctcccacaatcaagcgattctcctgcctcagcctcccaagtagctggaattacaggtgcctgccaccatgcccagctaatttttgtatttttagtagagatagggtttcaccaagctggccaggctagtcttgaactcctgacctaaggtgatccacctgcctcggcctcccaaagtgctgggattacaggcgtgagccaccttgcccagccttcctggagtattttaaagcatatctagatatattatttcacccataaatacttcaatgtatatctctaagagacaaggccttttttttttttttgagatggagtcttgctctgtcgccaggctggagtgcagtggcgtgatcactgcaacctctgcctcctgggttcaagcgattcttctgcctcagcctcccgagtagctgggactacaggcgcgcgccaccacgcccagctactttttgtatttttttagtagagatggggtttcaccatgttggccaggatggtctcgatctcttgaccttgtgatccatccgtttcagcctcccaaaatgctgggattacaggcatgagccactgcacctagcctgccttttcttatttttaaaaaacatactgataatcccattatcatacccaacaaaattaataattccttaatatcatctgatacctgttccatgttcagttttctgtctcaaaaatgcccttccttccacagttagttaaaatcaggatccaacaagattgtcacattgcatttagttcacatgacaattccctctccatttcttcccccctgccatttgttgaagaatctaagtcattggtcctatagaatttcccacttcatgattctgctgattacatcttcatggtgatgcttaatttgttccagaaactgccagtgacatctagaggcttgattagtttttggttttttgtttgcttttgcaagaatacttcataggtacttccttgcatcatagcagaaggcatatacatactgtcccacttttagagatgtcgagatttattagtgagttcagatttttttcctacgtcttaaactgtttagccccttgttttactgcaatggttaggccctctaatacgatacagaaggtaggggctagacatcttttaacttacttctaaattttaatgtgaatgtttgaaaagttttaccactaaataagattttttcccatatatttttcacagctgctctgattaaggaagcttccttccactctagttaccaggcttttctttttaaatcattaaatgttggatgttatggaattctttttcttgaatctactcattcattttcaacttaaacccttggaatagaaatacaatttgaaaaagaaccttatgtctagagacaataccactctttggtctaggtaagaggagcccctaccctggaccgacactttagaagactttactctgacctctggctctgccccacaggataagaatccatactgccaacgtgatgtgcccagctagaacagatgcccccttctagaagtgcatctaacacccaaatagcccaaatagctccaagccggcttccagggcttgctctggcctcatacctcttacgagtgaaatgggctaatggtatacaccagggctgtagccagatcttatacatataggtgggggacccacatatatatatatgcaccaggctcttcatgatgcagaacaaatcaaggggtggggaaataaaggaggcacccagtgggcgggggccacctctccctgcattgccatgctttgtcatggaatctgataaaatcagagaattctgaattcaaacctggtctgacaggtcattatgaagggatatttgtcaagataatagaataaaacattttatttaacagatagcttgatttataattttatttttttaagacagagtcttgctctgtcgcccaggctggagtgcagtggcgcgatctcggctcactgcaaactccgcctcccaggttcaagcaattctcctgcctccccgcctcccaagtagctgggattacaggggcccaccaccatgcctggctaattttatatttttagtagagatggggtttccctatgttggccaggctggtctcaaactcctgacctgcagtgatccaccccccttggcctcccaaagtgctgggattacaagcgtgagccactgcacccggccaatttatgttttaa

SEQ ID NO: 12510 - DNA, 71361 bp, Homo sapiens
gcccactaagatctaatttcccccccaggatgctcatcagctctttttggtctgtttcttcccaggacacaggggtcttctaaggctcagcatccttccaggggctttgcagaacatggtaaacagcagcaggggagagaagaggaaaaaggtagtggtggcattcggaagacccgggaaacagagcggctccggcggcagctgctggaggtgttttggggtcaggatcacaaagtggacttcatcctgcagcgggagccatactgccgggacatcaaccaactgtctgaggccctgctcagtcttaacttttgagcctcacctgcttgagtggctgccgccctgtcagctccagccgcctccagctcagccctttctgtgagagtccctctgctgctcactctgatccagaggcaccctgagttggtgctttggatcagggaagccactttgggacaggtccataaagtgaactgatcttaccgagtcaggacctcagccagctctcaagaggttctgctcagccttaacttctcaactttgccttagcacagggtttctgtagggagtgggggctgctagaggggattagttccggagactgagactgttggctccacctccaagctgagctagggtggagggcagggtgggcaggaagtgacaggaagttaagctgttcctctccctggctgctgctctggatggccagagaacaagatgctcccttgctgagctcctgggagcgtggaaggagatgctaggccctggcacagtgttatgtggactgggccacgatagggtggagtgagctagtgaagaaggcagagggagacttggcttctggtctcagctatgcctgttttgtgaccttgattgagttgcttgggctttacttctgcctacaaatcaggggtaaaaatacctgttgggaggagaaatgagaacatagaggaaagcctcttggaggaaaggtgcttggaccaagtctcaggtgtgtctgcctgtggctgcacaggctctctaaccgaaacctcactttcagagagatgtgggtcctttgtctccaggatccacaccctagattttaacactgcattctcactataacatgccctataatggctgcatcccttttgagcaacctccaaaatctacatttacacagtaggtaaattagggatgactgcattatcaaaatactctcagggttcctataaatggcagctctcctgttgtattcaggtgttgtttacagactaacaaatgtgttggcaaatccctggttagatgcacttcctggtgttgagatgaacacgtcgatttttcaccaatcgatgaagccatgctctgcaatgacaatattaatgtgatccgaccctaacattttctctatggaagacgtatgttgcataaagcaaggcacacttctgctttatgtgtgtgtgtatggggatgggaggacttaacggaagttgaaccagttggttctagatgaaccaattatctggaaaatgaaagaaccagagttggaaggcacttgactggccaccagaccaactctgctgttactgacatgctttcttcaccctgattcctagaggtcattgccctggatctgcttgaagtcctcctgtgccagggaatttactatctccagggtagcacattccctgtgtagatggtattaatcagtactccttactttagtgcagcctaaagtatgcttttctgttacatccacctttgaggctggtcatacctccaggaacaatacagagccagtcaacttcctggaatccaagaccagataaagaagtaggacaggtgcccctgggttctgttctgtgtgggcctgtggggagtctctagacaagatcttttccaggccctgacttctgcctccctctgagtggcacagggagttgaatactgcatggcgagtgtaatgatgatggggagggtccttgtgtcctcaccccttcctttttggtgatttacaccactgtaccatactgacccaggctgggggcaggtgtgttggagacaggctggtcaaagaggtgacaatgattaagagataacccagtggtccctgagaagagattggttagtatggcctgaactggtggctgggggaactgtgtctggtcaagttatggcagatgtcacagctttaggtaggtaaaaagggtcctagatgaaaaccttggagtttttttttttcctgatagggttgtttatacttcttgattggtttcttgccattttcactttcagtgatggtgggtgtgcagtagaccaaaagtgtcttctgcccttttgtgctaagggccctggttgactgagtggccccagtcagatgagaggcaagtcctaagcttcttatagacagggatgttgactttgttctgctgcagcctgataaactgggaccactgtgtggttagtaatgcacttgccatttggtgacacagactgaaggctatcctacacctgggccttacctcttcctctactggcatcctaatggcactctgacagcatccagggtgactacagggcccattggaaatggatcatcattctctcttctagtgtctatctttatcataacctgatgtcccaaacttgtgacaagttcttttggcaactgaaggaccaagaagggaaacggtgatgagagagactgcccattataactttcaaaaccccgtctttggggaagaatcatctagggtgacattccttgaagtaaatcccaggagaatctaggccaaagagatgagccaaggttagtgagacaatttatttttattgcctaaactgcagagcattctctacacagcgtaaaggagaagtggggcagctgcaggacatgtagagaaaccaaaccgggaaatcttacaaggagttgaaaagattaatgtcccaacctgatgagattacggccttgagacaataaggtggagcaacagaacaatgggaaagaggactgggagaggaatctaagaaccagatggcttcagctctctagaggagctgagcctattcacagtgcctaacctggaagcctgtgaggaacaggcctcaggcccttgccatgacctacttaggctacaatttcctttaaggcagcccctagctctgggaaggaatactggtagccagtggccagtgttcgccgtgggatcaccttctggccctccagcagcatgatggcacgctgtcgcccaaagacagcttgcaccacagcgctggggagagggatgaaggctcggcggcccagggcagcaccgaaggtctgggcaaactcagcattagtggcggaggatggagccactccattcaggaccccgtgcacgtggtttgcttcaagggcatgggtcaggattcctgccaggtccccgatgtgtatccaggggaagaattggtggcctgagccgatggggccccccaggcccaggcgaaagggcagcagcatgtggcccatggcaccacccccacggcccagcacaacccctagagcaggaaagagggaaggtacaggggtcctctcagccttgaaggagcccactgctcctcctggtttctgtttccccttcctcactctccccatgctgacttggctctgtaacagaagtgagcagtatggctgtctttaagacctcacaccttctcatctgcaggttggctagaagtggtggcatcctctcactctgtaattgtaatctcagctctcctaatcccatcacttccccagcccagagaagacattccaaccctgtctgatacccaggcccgtttctcacctgagcgcaccaccacctggcgtgtagaatctccaggaagcctggctgcagcttcccatttggttacgaggttggagaaaaagtcaaagtcccctcctgggctgtcttcatcatactccgcagtcagactgggctggtagtaagctgccggtggaacacaatcatttgccctgggtgtccttggtcctgcctggctctctgtagtggaggctccccttggcctcaccttctctggcccttaggatctccccatttggagacagagccatttggatattttccccttgaacttctccatgacctgaagcgttccttccctggaggaactctggttgcagggctaaacttagaggctgctagagtgtagtggttaagaacaggaacttgggtaccaggcgcctgaattttaatcagctccctcatttattaactctctgacttgatgcaagttacttaacctctctgtatagaattttcacatctttaaaatgggaataatagtacctacctcatagggttgttgtaaggaataaatgataataagcataaaacacttcaaatagtggctggtgtgtataattgtttgcaattacttggtcccaaaggtgaccaggaactctgttcctaaagaactatggtgtgagaagtaagggactttgggataggtggacttttccctggcattgagtgatgccactccccactgttttttcagggtctcaatttcttagtgaaagtacacaaaggttaggagaaacatgcatggatcaagggcctaggaagtcattttgcctggaaaagaccagtgctctggtgtgtgcatagctacagaggtctgagttaccccgttcccctggtgaatataaggggctggtgatttggggggcatacctacacctgtgactaagacccaggccttggggggttgtggggctttggtgatggctttagccagcaattgggtggtctctaggcggctgccgagaacctctttttggaaggtttcattccatctgcaggagaaacatgggaaataaaaagccactaaatacataagtgcacatatccctctctctgtcttttcctgggagctatttcataccaatttcttgtaaagccctgaattttggcttaagagaaacagtcaacgtctcctgtagagggaaagggcattcatttcttgggcatcctgagttatacgtgaggacttaagccaattggctgactgggtggaggagcaggtgggggtggaggagtggagcagaatgagtagtctgggatatcggtttagttcggaatctgggagctccattacccatagctcacaggttctcatcagtggggcactgtcctccctgtgctctagtgggtatcagctttagggcccgggctgaccttcggagagggttgaggatgttctctccggccaggttgacggcggcatcgcagctcggcagccccgatgcagcgagctcatcctgtcggagaaagcacacagtgcccctgccccgccctgcgccgcccaactctgccctcccacccgcttccagaggatggacttacccacgtgatccggccgggcccgggctttcgggagaccaacgtcacttcgtggcctctggcattcagcagctgggttagggctgtcccaatgaagcctgtcccgccacctgatcggaaaatacaaattgtttatattcccgtggagttggggtgggggcgccttccgtccccgctgtggcaccctcttccggcgccatcccatctgacaccagacttctccccacttatccccctcctcgcgatgcagaggtgacacaggtcacagggattagggagattcggcttctcgggctaggaggccaaggccaggttgcctgtgcactagacagtgccctcccggaagcggattcccagtcctcaatctccgactaagcccgcccagcactctccctttctgccctccctcacccacaagcacacgcatagcgactaggacctaacgcgcctgcgtaaagtttagagtttacctcacctcagacgcgactacgacctctctgcgcatgcccctttcgggaagcgcgttccaatcgaggtcgcaatcctgtgcgtgacccttctcggcgacccggaaaaacttgtaaatataggctgggtgtttcaatagcaagcgaggtgggagggattagaccgatggacccggaaagggcggaggagggaaggctttagtgtagaaaaccaaccaaaccaaacccaaaccaacaaaacccttcacctaaaacccgaagctacccagacctcagaattttggatgtctattaagttggcgggtcagtaatgcaagagaacccttccaccggtaatctggatttctttccactcggccagttttttcttctctctctttccgctggcgcctttctatcaacatttaaacattccaaagatccccctatattaaaataagccttctccagacctgtttttcctccagctaatattctttttttttttttttgccttcatagccaaacttcccacaagtgtggtttccattttctacttcttacttcactcctatagggtttgtgcctttatcattcatttcctcactctccaagaacataagtttcccatgtgtcaccaaatctaatccctagttttcagttagttttcttgacctctcagtatcattgggcacctgctgattcsttcctccctttgaaaatgtttggcttcagtgaaagacattctcttctcggctttctcstaccttttttcagtctctgatgcttgctccacctctgctaagttcttaaaatattggtattcctcagagctggatcctaggaccttctctttccaatctgcactttaccctaggcatctatgccttgaattcagttaccaggctttaacagaagacatcccaaatctcctatgcaactcggatctctcctctgagctcctaacccctataaaaacttttcactacacatctcttcttggacgtctgaaaccctattgattttaaatactgaatctctcccagatttatctaagaggggtctttgaaaagttcatggaaaatgtgtattatgctaaaaaatacataggtttccaattttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgtccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccaaattttttttacaccaaaataaacttgtactaacttgttatataacatgtctgaacaggatctgacgcactaagaaggctagacagtttgaaaagagcccctatcaaagcaacctgaattctgctaaaattgaagcaagaacaaacatggagtttctggtgaagaatgatgaaattgatgccttatgaaaagtttatgaggacaatgccccaaataaatcatcagtctacaaatgcataactcattttaagaaacgaggagatggacaagcatggtggctcatgcctgtaatcccagcactttgggaggattatgcacgagcctctctcaagcccaggagtttgagaccagcctgggcaacatagcgagaactcatctcactaaaaatttaaaaattagccaagtgtggtggtgcacacctgtagttccagcgtcttgggaggctgaggcaggaggattgcttgagcccagcagttcaaggttgcagtgagctatgattgcgccaccgtgctgcagcctgggtaacagagtgagaccctgtctcaacaaaaaggggaggagatgatgttgaagatatagatagtggcagactatccacatcactttgtgaggaaaaaaattcatcttgtttgtgccctaattgaagagaactgacaacagcagaaacaatagccaacaccatagacatctcagttggktcagtttacacaattctgactgaaaagttacagtggagcaaactttcaactcgataggtaacaaaactgttgtacccagatctgctacagttaagagcagagctttcagtggaaagtttaaacaagtggggtcaagatccttgatatggctttgtgacctcacccaaatctcatcttgaattgtaatccccagctattgagggaaagacctggtgggaggtgattggatcatgggggcagtttcccccatgctgtcctcatgatagtgagggtgttcccatgagatctgatggttttataartagcagtttcctgtgggcttttcacttactgtttttcctgccaccatgtgaagaaggtctttgcttcccctttgccttccaccatgattataagtttcctgaggcctcctgggacatgcggaattgtgactcaattaaacctgttttctttataaattacccagtccccagcagttctttatagaagtgtgaaaacagactaatacaatcctgaagcatttcatcaaagaattgtaacaggagatgaaayatggcttcaccagtatgatcctgaagaaaaagcacaatcaaagcartgkctatcaagaggaggaagtcaaagcaaagcagaccagtcaagagcaaaggtaatggcaacagtttttttaggatactcaaggtattttccttgttgactttgtggaggaccaaagaatgataacattaatttgcctattgagagtgttttgggaaagttagccaaagctttagcagaaaaacacctgagaaagcttcacyagacagttcttctccaccgtgacaatgcttttgctcatgtctctcatcatacaagaacaattttgttagagtttcaatgggaaatctttaggcatccacctgatttggctccttctgacttctttttgtttcttaatcttaagaaattctgtcaagggcacccagttttcttcagttaataatgtaaaaaggactgtattgatgtggttaagtctccaggaccctcagttctttagggtgtactaaatggctggtgtcatttcttacgaaagtgtcttgaagttggtggaacttatgttgagaaataaagtttatattttatattttttaatcttttaattgatttttccacaacattttgaaatttcctcatatttccctctgtctctgccatcacaatcgtcttatgagttattctgtcttgtgtaaatatctgcagtagtctcctagtaggtcttcctgcttttgcatgtttctcctctccaaactatttcacacattgcaagctgagtgatctttgaaaaccatatgaggggaacattatagtggcacgtatagtttaaaaaactcccagtttaaaattcctggatatgctggataaaattaaacatacctccatttaaatgtattgccaagttagctagaaaaataaaaaaatcccagaagccaaaaaatgaaatgtgtcttgggactgaggttatgacaaagattatttgcttggccaaactttagtcaggcttctgaaccttctaggctcatttgtacacctctttgtaaaatccagttttcgcaaagagccttgctaagtcagtttagcaagaaccccctcaacccttgatatctgatcactctcaatctctgatcaggcccctcatccttcatcccctaggtgatgtctgatcaccttggcctatcttcacatgaatcccgttagtttgggttagccagaatccctcttacccttgatatttttctcttactaatttttcatccactgacccccaccgtattcgttggctataaattcccacttgcccatgttgtttcakayttgaccccaatctctccyrctgcaagaccacattgtagtggtacctgtacctattgtgatggaaagtcttccttaccttactctatcaagtgtcactgaataattttctttaacaggtattttgtgacttttagtttcagtaacccagaggcttgggtgacaggagaccatgcctgagatcgaagcaaatttgggactgagacccctggataaagcccttgggctgtgttctcagataaaaagtaaactttaaaagtccacctggtatcaaagaacatggcctggaaacttgtttctctaggcctttgctcttgtctaggattgrttgtcaaaaaaattaccgttctttgagaagttgtatctattgtcctgtccgcctgcatatttgtggtttgaattaattgttacctacttggcctagaaagctctaacccaagaatttaaattaagtgttccagatagaagacataaatcttcccttggtttggtttcacaggatttcaatagataaaatcctgccaagcataaacatacaatacaaaattacaaaacacacaaggaaacaaagcactctgagggtgtcaaataaaatcaaaccaaaccaaaacagaaaacagcagatttagacaatcaaagatttcaagtgttagaatttagaggtatagaatataaaattaccaaagtttaaaacgtttaagaaagagaagaaattaaaaacatgagaaagagacaagatgctatcaaaaaataccagcagaattgataaaagaaccaacctgaactttgaaaaattaaaatttttttaattcaaaaaattttttattgtactttaagttctagggtacatgtgcacaatgtgcaggtttgttacatatgtatacatgtgccatgttggtgtgctgcatccattaactcatcatttacattaggtattcctcctaatgctatccctccccccacacccaccccrcaataggccccggtgtgtgatgttccccaccctgtgtccaagcrttcttattgttcagttcccacctatgagtgagaacatgcagtgtttggttttytgtccttgcgagaatttgctcagaatgatggtttccagcttcatccatgtccctrcaatggatcatcctttttaatggatgcatagtattccatggtgtatatgtgccacattttcttaatccagtctatcattgattgacatttgggttggttccaagtttctgctattgtgaatagtgccacagtaaacatacatgtgcacgtgtctttatagtagcatgatttataatcctttgggtatatacccagtaatgggatcgctgggtcaaatggtatttctagttctagatccttgaggaatcaccacactcccttccacactagtttccactcccaccaacagtgtaaaagtgttcctatttctccacatcctctccagcacctgttgtttcctgactttttaatgattgccattctaaccggtgtgagatggtatctcattgtggttttgatttgcatttctctgatggccagtgataatgagcattttttcatgtgtctgttggctgcataaatgtcttcttttgagaagtgtctgttcatatccttcacccactttttgatggggttgtttgattttttcttgtgaatttgtttgagttcattgtagattctggatatcagccctttgtcagatgggtggattgcaaaamattttctcccattctgtagrttgcctgttccctctcatagtagtttcttttgctgtgcagaagctgtttagtttaattagatcccatttgtctattttggctttttttgccattgcttttggtgttttagwcatgaagtccttgcccatgcctatgtcctgaatggtattgcctaggttttcttctagggtttttatggttttaggtctaacatttaagtctttaatccatcttgaattaatttttatataaggtgtaaggaagggatccagtttcagctttctacatatggctagccagttttcccagcaccatttattaaatagggaatcctttccctgtttcttgtttttgtgaggtttgtcaaagatcagatggtggtagatgtgtggtattatttctgagggctctgttctgttccattggtctatctctctgttttggtaccagtacgctgctgttttggttactgtagccttgtagtatagtttgaagtcaggtagcatgatgcctccagctttgttcttttggcttaggattgtcttggcaatgcggcctcttttttggttccatatgagccttaaagtagttttttccaattctgtgaagaaagtcattggcagctcgatggggatggcattaaatctgtaaattaccttgggcagtatggccatttcgatgatattcattcttcctatccatgagcatggaatgttcttccatttgtttgtgtccccttttatttcattgagcagtggtttgtagttctccttgaagaggtccttcacatcccttgtgagttgtattcctaggtattttattctctttgaagcaattgtgaatgggagttcactcatgatttggctctctctttgtctgtcattggtgtttaggaatgcttgtgatttttgcacattgattttgtatcctgagactgttgaagttgcttatcagcttaaggagattttgggctgagacggtggggttttctaaatatacaatcatgtcatctgcaaacagggacagtttgacttcctcttttcctaattgaatatctctttatttatttctcctgcctgattaccctggccagaacttccaacactatgttgaataggagtggtgagagagggcatccctgtcttgtaccagttttcaaagggaatgcttccagtttttgcccattcagtatgatattggctgtgggtttgtcataaatagctcttattattttgagatacatcccatcaatacctagtttattgaaagttttttggcatgtagggctgctgaattttgtctaaggccttatctgcatctattgagataatcatgtggtttttgtctttggttctgtttatatgatggattacgtttattgatttgtgtatgttgaaccagacttgcatcccagggatgaagccaacttgatcgtggtggataagctttttgatgtggtttgccagtattttattgaggatttttgcattgatgttcatcagggatattggtctaaaattctcttttttggttgtgtctctgcccggctttggtatcaggatgattctggcctcataaaatgagttagagaggattctgtctttttctattgattggaatagtttcagaaggaatggtaccagctcctctttgtacctctggtagaatttggctttgaatccgtctggtcccggactttttttggttggtaggctgttaattattgcctcaatttcagagcctgttattggtctattcagggattcaacttcttcctggtttagtcttgggagggtgtatgtgtccaggaacttatccatttcttctagattttcttttcttctttctttcattcttttttttttttttgagacggagtctcactctgtcacccaggctagagtactagagtgcagtggcrctatctcagctcactgcaagctctgcctcccaggttcatgccattctcctgcctcagcctcctgagtagctgggactacaggtgcccgccactatgcccggctaatttttttgtacttttattagagactgggtttcaccatgttagccaggatggtctcgatctcctgaccttgtgatccaccyacctcagcctcccaaagtgctgggattacaggcgtaagccacygcrcccggcctagattttctagtttatttgtgtagaggtgtttatagtattctctgatggtagtttgtatttctgtgggatcagtggtgatatcccctttatcattttttattgcatctatttgattcttctctcttttcttctttattagtcttgctagcggtctgcctattttgttgctcttattgaaaaaagcagctcctggattcattgattttttgaaggattttttgtgtctctatctccttcagttctgctctgatcttagttatttcttgccttctgctagcttttgaatgggtttgctcttgcttctctagttcttttaattttgagcttagggtgttgattttaggtctttcctgctttctcttgggggcatttagtgctatcaatttccctctacacactgctttaaatgtgtcccagatattctggtatgttgtgtctttgttctcattggtttcagagaacatctttatttctgccttcatttcgttatttacccagtagtcattcaggagcaggttgttcagtttccatgtagttgagcgtttttgagtgagtttcttaatcctgagttctagtttgattgcactgtggtctgagagacagtttgttataatttctgttcttttacatttgctgaggagtgctttacttccaactgtgtggtcaattttggaataagtgcgatgttgtgctgagaagaatgtatattctgttgatttggggtggagagttctgtagatgtctgttaggtcaacctagtacagagctgagttcaattcctggatatccttgttaactttctgtctcgttgatctgtctaatgttgacagtggggtgttaaagtctcccattattactgtgtgggagtctaagtctctttgcaggtctctaaggacttgctttatgaattctggtgctcctgtattgagtgcatatatatttaggatagttagctcttcttgttgaattgatccctttaccattatgtaatggccttctttgtctcttttgatctttgttggtttaaagtctgttttatcagagactaggattgcaacccctgcttttttgttttccatttgcttggtagaacttcctccatccctttattttgagcctatgtgtgtctctgcatgtgagatgcatctcctgaatacagcacacagatgggtcttgattctttatccaatttgccagtctgtgtcttttaattggggtatttagcccatttacatttaaggttaatattgttatgtgtgaatttgatcatgtcattatgatgttagccggtcattttgctcgttagttgatgcagtttcttcctagcatcgatggtctttacaaattggcatgtttttgcagtggctgataccggttgttcctttccatgtttactgcttccttcaggagctcttctaaggcaggtctggtggtgacaaaatctctcagcatttgcttgtctgtaaaggattttatttctccttcacttatgaaacttagtttggctggatatgaaattctggattgaaaattctcttctttaagaatgttgaatattggcccccactctcttctggctttkagagtttctgctgagagatccactgttagtctgatgggcytccctttgtgggtaacccagactttctctctggctgcccttaacattttttccttcatttcgaccttggtgagtctgacaattttgtgtcatggggttgctcttctcgaggagtatctttgtggcattctctgtattttctgaatttgaatgttggcctgccttgctaggttggggaggttctcatggataatatcctgaagagtgctttccaacttggttccattctccctgtcaatttcaggtacaccaatcagacgtagatttggtcttttcacatagtcccatatttcttggaggctttgttcrtttctttttcctctaaaattctcttcttgcttcatttcattcatttgctcttcaatcactgatacccttttttccacttgaccgaataggatactgaagcttgtgcatgcctcakgtagttcttgtgccatggttttcagctccatcaggtcatttaaggtcttctctatgctgtttattctagttagccattcatctagtcttttttcaaggtttttagcttctttgtgatgggttcaaacatcctcctttagctcagtgaagtttgttatgacygatcttctgaagcctacttttgtcagctcgtcaaagtcattctctgtccagctttgttccattgctggcgaggagctacatttctttggaggagaagaggcactctgatttttagaattttcagcttttctgctctggtttctccccatctttgtggttttatctacctttgatctttgatgattgtgacctacagatggggttttgtgtggatgtcctttttgttggtgtcgatgctattcctttctgtttgttagttttccttctaacagtcaggaccctcagctgcaggtctgttggagtttgctggaggtccactccagaccctgtttgcctgggtatcaccagcggaggctgcagaacagcaaatgttccagaacagcaaatgttgctgcctgatccttcctctggaagctttgtctcagaggggcacctggctgtatgaggtgtcatttggcccctactgggagatgtctcccagttaggctactcaggggtcagtgacccacttgaggaggtagtctatccattctcagatctcaaactctgtgctgggaaaaccactgctctcttgaaaactgtcagacagggacgtttaaatttgcagaagtttctgctgccttttkttcagctgtgcccttcccccagaggtggagtctatagaggcaggcaggcctccttgagctgtggtgggcttcacccagttcgagcttcctggccactttgtttacctagtcaagcctcagcaatggyggacgcccctcccccagcccrggctgccgcctcacagttcaatcttggactgctgtgcyagcagtgagcaaagctccatgggtgtgggacctgctgagccaggcatgggatataatctcctggtgtgccgtttgctaagaccattggaaaagcacagtattagkgcgggagtgtcccaattttccaggtacygtctgtcacggcttcccttggctaggaaagggaattccccgacctcttgtacttcccgggtgaggtgatgccccaccctgcttcagctcacactctgtgttctgcacccactgtccaacaagtcccagtgagatgaacccagtacctcagttggaaatgcagaaatcacccgtcttctgcatcgctcacactgggagctatagactggagctattcctattcggccattttggaatgatccacccatgatgattcaagttttaaaattcagtgaatgtttaaacatcagggaatagatttaggcattggttaagagaggattaactagatgtgaagaaattacccagaatgcaacagagaaaaagagatagaaaatgtaaaagagagggtatgagaygaggatgataaactgagaaattataattcttctatttggtgttccagaagagaggagtcagagaagagracagagaaaatatttgatgaaataatagctgattgttttctagaattaaagaaagatatgaatcctcagattcagtaaacaaaatgagtttcaagtaagataaataaaaacaaacccatacctagtttcatcatagtaaaactggaaaaacaaagagagatgttamaagtagtcaamaagaagacagattatctataaagaaatgcctttttttttgagatggagtctctctgttgctcagggtggtgtgcagtggcaggatctcagctcactgcaacctccacttcctgggttcaagtgattctcctgccttagtttcctgagtacctgggattatgggcatatgccaccamagccagctaatttgtgtatatttagtagagatggggttttgccaygttggccagtctgctctccaactcctgacctcaattgatccactgcctcagcctcccaaagtgctgggattacaggcacgagccaccatgcccagcctaagaaataacaattagacacctgacacatcagctgcaacaatatcatctaatggaataatatctcaagcttgaagagaaaataattaccaacctagaattgcttaccaacacattattcaagaatgaaggtgccgagacyagctcggccatggagaccctaacctggcggcrctagaggaattaaagacacacatacagaaatatagggtgtggagtgggaaatcaggggtctcatagccttcagagctgagagccctgaacagaaatttacccacgtatttattgacagcaagccagtgataagcattgtttctatagattatagatttactaaaagtattccttatgggaaacaaagggatgggctgaaacaaagggatgggctctggctagttatctgcagcaggaacatgtccttaaggcacagattgctcatgctattgtttgtggtttaagaacacctttaagtggttttccaccctgggtgggccaggtgttccttgccctcattccagtaaacccactaccttcagcatgggggtcatggccatcaygaacatgtcacagtgctgcagagattttgtttatggccacttttggggccagtttatggccagatttgggggcctattyccaacatgaaggtaaaacaaggatactttttagacaagcaaaaactgagagcatttgccaccatcagacttaatatactttgtcaggaaraaaggaaatgatctgaaaaggaaaatgtaagatgcaggaaaatagtgatcaaaggaattgataaagttgataaatataaatatttactatattaagcaacaacaataatgtttaatttgtgggtaaaaattaaaaatattagtcaccagtaataggtagtaagagaaatatttgactggagttgaattgttatgaaaaatatagcaatactgaataatgttaaactttgttaaatgtaaatttaaaaattaaggctaaatattgcatattagaagtaaagtgtgcacttctaaatcagtagagggaaacarttgaataagataatctaatcaatttaaaagttatcaggaaaagataaaaagaggatgcttrgaaaaaactagaaaggccaaaataagataacagaaataatcagtaaccataataaatttaaatggagtaagaaattaaattaactagatgtatctggaattacaaatttcaaaagaagtgaatctcacaactataatgttaaacaaaaaagaagttgcagaaaagtacctacaatataatgctatttaccwagagattaaaagtatgcaaaattatacttttttttattgaggggctaaatatatttgtagttaaaataaaaagaaatgcaagggaatgrtgatgatgggtagaatagtaatgtgatcaaggaggagtaccctgggaaatttaacttcttatttcttagggtgtattcattttatttttggtatatctgaaatatttcacaatatacaaaaatgtgtagtggatttaagatatgttgtcatatttcagatgtatggaaagataactttattttctgtagttgaacacaacttgctcataaacatttctcattggaagtggtataaacttaaactcatccaacaaagttaattatcatttctagtttaaaacttctcatatactcagttttctctgggtaaattcttagtctttcagcatgccttgtcccttttctcctttccttctcctagctagacacccaggtgtagcaggccctttggcaggcactgttatgtagtcctcagtgcctgcttggaagggtctcatctccttcggcctttggatcttgcctgctgagatcagctaaggcacagctggttaggccagacctctgggcagtgttttggccactgcttctgatacccatggctcttgccttgatatcagagttccacagcatctgctggatgatgaagaaacacttggcttgcctctggccaacagaatgggatgcatgggccttgatgagggtcccctcaggctcacctcttggtaatttttcacagtcattactgctcaggcaccttattgtgaactagttatatgttgctgttaacaaattatctcaaaacttagtggtttgaaacaacaatagtatttattatcttttacagtcttgtgggttaggaatatggtagcagtttagctcggtggttgtgrggtgtggctcacagtctctcatgagrttatactcaagatatcagctagggctgcaatcatctggatacttgactggggctggaggatcctctttcaaaaagmcttgctcacatgctgttgcaggaggcttcattccttgctgattgtttctcaccatgtggacctctccacatggctgcttgagtatccttatgacatggcagctggcttccctggagtgagtgattcaagagagtgagaatgaggagaaagcttcaatacctctaatgactaatctaatctcagtgtaacatacagttacttttatcacaatctatttgttagatgtgagtcactgagttgaaggggtgagaaatttggctgtaaaacttttaaagggaatagagtcaaataatttgttggcacattttaaaaccaacacaagctctgtgctgcatttagggcttctctgagatgcttgtagactctctcagttgtgcctgggaattgtggtacaatccttgttatttttagatgcctcttttacctctccaggttttcaagcatctctccttacctccctagctaggctccttctcagagagttcaggcagcatttataatctagttatgttctctccaaatcttttagctccttccctaagcccagggaaagctaggtaatgggcaactgctctgacatcatagccagtttctttcctaccctctgatttataaaacaaattccatgcttggtcttctctcaacaaaacccttgctcttgaatttcctcctttccaggctattagttagatatggaataaaacaacttgcttttgagagtcaaaactaaggcttgtcggatttgttcccttacactgcagagggaaaaggaagtactgagagggaaaatacgttgggtaatattgcaaagcaaactggcttyatacatggctagatccaggtgcttacataatgtcatcaaggatccacatctttttaattctcagctcttattttttgttggttgacttcattctcargaagattttctccctttagagtgagaatgaattcttggcttctatttccagcagagtaactatttctcttaattccataaagaatgtcagaactgactcttcttggactgttatgrgtctcgtgccatctctgaaccaactattgtggccaagtatggagtkttctgcctggccaggcctgagtygtgtgtctactgctggaccaggggtsgggtagccccactcactgtcctccactgtggaaacccagctgagcccctgaggtgttaaggaactcctcctctcttcaacaacgttgacattccttcctttctctcctggctatgtctttccttccagtgagctgggagttgtgctgtagaaggtgagaggtgagtgggagggttccactaaattacatgccttttagagtatagatttaagagggtggatgtccatcaatatcctcaaggaggtgagatggaaacctcctgcagagctttacaccccttgcgaagaggaggtacatagggacagagctcccattgcagcagccagcccctcatctccagggaggctgatggagagcaggctctgtctgaatgtgttcagctttccatccaacctccttaaagctgtygttcttctgggttctggggatgggtgggtcaacttctctcatcctcctcagcctctcctttagcaactgaactattttagttaaactttttgcagctctcagagtccatctgacacttkggaggttaaaacattcaaaccttagacaacaagacatgagaaattttcatctgcacatctgggcttaggggcaagtgcagctggctttccctttgggaagaaaaggcttcctcctgggtctgcagcaatcacaagkactttgaaatgggactgttttcctcacagctgcttcctgaaacaacaaaaggagctsagctcagtcaacctctggggcatcaggccagccctgcggggcaggataaaaagtcagagaaggatcctggctgcttcytcagcttgggccaaggcagagtgggatgggggatttgctggtgacaagtgcctctgccccttcccaatgccacctgtgtgaatgttccctgcttcattttgytggaatagatttttgtgacttctctcaggctctgagatgttacttgccaaatgctattcacataaccattttacatatttctgttactgtatggtagaaccaatcaactaaccaattaatcgascaaccaaccaaaatcctaattctggagacacattggataaaggatcctagaaatctcccttcctttttataagatagtctgctctgacctcagggtctggggccacaggaacagcattcctgaacctcgaygtctgtggagatgccaggtcttctccaggggctgcaccttgtcttctyctttttcccttccactaagacttttagatgcccccatccctagtctgacccctaaccagacatctgttcccagtgggaccttttgtaggagctgagagacctggccagcctccagcatcagctccgtacgctccgttgttggccaggacctgctgtggagaacaagtgcccttgaggtctctctgctcttagtttccagggcagtgaatgagaaatgccctcttacatactctgacagtgctggggagagaaagctaaatagatagatagatagatagatagatagatagatagatagadaatgatgttagtctttggccaggctggacctgagaggaactgtttagcatgagcagctcttcttgcaccaccagaggcttcaccagcccagcaattccatttcctactcactcagaggaaggactactggctgcagtctcttgccactgtctggctctgtgctgtaaaatggccactgggaggcttctcctgggtctgttttcccctggccccagcacaggcccttctgaaattaatctatggagaatgtatttctccatctccactgtggctgtggccctttccctacagtctactcagccccacatgagttgggggtagtgggaggctgggctctggggaagggacccagggagatatgagcaggtgcttgcagggaaggtcagctttctccagctcctttctcatggyagacactcaattacagggcctcccaggtgctggatagctctgtgctggcagaatgctacttctcacacccctcygcacagcagagatgatgagggctgggcctgattttctccctgcactctgatrtaataaagttgttgtcactaggacctattaaatcagrcactcatggtagtaaatgtggagatcaggcagcttggaaatcctcaggcacatgtgcatgtggatgcgtgtgtgtgtcatgargacacaggataaagtctgttgtctgtggccctgggggattgaggcagtgatcaccagagctggctttatctttgcgttcatgcrtcttctacccactcagctcacatttcgttataccattcagcagttggcaacctgaggggttcctagggagggagatgtaggctagtccatcttctcctccatggatcaacataggccagacccagctacaggaggctggaccacaaccarcatgaaatttttgctgagtttagacagaaggtcactacgtcactgaggtatctcattgaatacttgattagayagagaaggagatgatggagaagaaagaaagatgacaggagaggataagggggtggccatgacaacagaggaagagagaggactcagaggktgtccccaaggcttagactctaaataattaagagacagccctgggctcagtatccaggttagatctgtgtaggatccctggggcactgaagttgaggatgtgactagtggcttgaaggtggagttgagaggttcagggtgcctggtgtggattttggggatgaaggttacaaccaggaccttttatggactgttcacaggactccacatccaggcaaaggccagagtattgattcttagatgaaatgctgttacacagcatggggacttcacttttttgagactgaagaactttgaggggaaataaaatctctgaagagaagctaggttccatctacagaggtagcatggcttagtgcctctcatccattctgttgaaacagctcttgtcagtgacctctatgttgctaaattcattgatctcagatcaccacatactttgcctctctgcaacatttgtttcagtggaaacactttcttcactggtttccaggacatgatttgtcctcctcttacctcattagccacagctcagtccccttggctggctttgactgtcacctgatctctaaacattggcatactgcaatctttgtctttgggcctcttctccatgtaggctcactccttagtatgaatctcaggtttttgaatagtgtctaatgaatcccaagtttctgactccagcctgaatatttttcctgaattctaggcttaaatatcaaactacctacycaatgtttgtatgtggatgactaatagccatctaaacttaacacaccccataccattctcttgatttccatggccccaaacttgttcctttgctggttctcccagtctcagcaaatggcagtgtagttttcccatttgctcaggtcaaaataaaaaacttggagtcatcattaactccccgtgatccatgagcaggaatggttggatttatctctaaaagaaatccatacatgcaataaacccataattaggtatctcaccatgttcactacagctaccatctggtacaagttaatggcatctttgtctggatcatcataagggcctccttactggtttttctgccctaactcttgctcccttagaatttattgttcacttggtagacggagtgatccctataaaaacttaaatcaatcatgccactcctctgctcaaagtcttccaatggattctggtttcagaataaaagccaaagatcttataagatctcaggggacccttgagacccccagtgattttgtcctcacttgtctatrtgacctcacctcctgcctgtcctgcccaagtcacactggcttctcagtatagcgtgacaaacttgcttctgcccagggcctttttgctattcccctgcttgaaatgccatgcctccaaatagccacatggctctcccagacctcacttccttcaggtctctaatcaaatgtcttattagacattattgaccagcatatttaaaatcggttttcttcctcacctttggaactttgtttttccttcatcctgtcttatgtttcataccacttattatcgtctgatgtattgtgtatttacttgtttgtttgttacctgtctcttctcactagaatgcaaactccacaagagcagagattttattattactattattattattattattattatactttaagttttagggtacatgtgcacaatgtgcaggttagatacatatgtatacatgtgccatgctggtgtgctgcacccattaactcgtcatttagcattaggtatatctcctaatgctatccctccccccactccccaccccacaacagtcyccagagtgtgatgttccccttcctgtgtccatgtgttgtcattgttcaattcccacctatgcgcgagaacatgcggtgtttggttttttgtccttgcgatatttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacataygtgtgcatgtgtcagagcagagattttatctgctttgttcactcttcaccccagaattttggagagtaccttcattttgtagatgctcaattagtatttwttgagtaaatgaaagaatggtggttgagagtgcaggtcctggaaaaagrttccctgagttcaaaktccagatcttctctttaacaactgtgtgattttgggcaagtttcttaacctctctgtaccttagtttccttacagtaattgaggataacaagtacctgcctcatagaattgctatgaagactaagttaatacatttaaawctcagatmagtccacagcacatagatttgatagatgtcaatcatcatcatcatcatcatcatcatatgaaattattagctggggtgttagaaatataagaagagacagaattttagaaatctgggagaagtgagaggatgcagaacatacggatgggattggtggaagctttgtgtggcagattgtatttttcaaagacagctgcaacaatatctcagtttcacatgctattctggaaacttttcactccctatcaaaaggtagagcgtatgtactttcccttcaagtccagatgggtatttatgactgcctcaagtgatgtaacttccaagactaggttataaaaatgccacacacttcgaacttgttttcttgaaatgttcacttttagaaccacccatcatgctatgagaaagtccaaactagcccatgtagacagactacatagggaggctatatgggtgttcctgctgacagcccagctgaggtccttgccaacagccagcatcaactgccagatgtgtgtatgaagatgcctctagatgactctggtccttgttgagtcacccccagccttcaggtattcccacatgaagcaccaggcttcatggagcatagcccaggtgtctctgctgtgctctgaaattcctggaccaggcaatcgatgagaataatcctgtggttgttttatggcactaaattatggagcagtttgcagtacagcaacagcaatagggtactcaggttcaactgtcaagagaccagtcaacagtgtagcaaatagataacaggcaagaaaagccacacaaaaccaggtgtgagaagtggtcctatttcattgcttggtcacggattactgaacaggagatttgaaacccttaacggsatatctgatcagcaggggtttaatgggaagaagatgattggaacataattccagagtaaaagaaagatatatgaacaagcagatgaggktaaagtggtcctgtatgtgaggaaggcataagtaattttaaaacaaaaatttataaaatatctatgggaggaaattacattttcatgtgaatctgaaaatcacactcacatataataaaacatttgcgatttkatgatgcaatatactcttggaggttgcttgagaaggcagattgtcagatgaaktaaacttgtgtatttattggcttactagaacatatttagcatccttttttgggaaccactgagtgagtgaatgaggtggtaaagtatacttttatttttcaagattgaatggataaaacagtgaaacatgagtgtaaaaaagtggaggyactctttttttcctttttctcttaatatatatgtatttttttttctttttctttttcacacctggtgaacaggaagtagtggtkctctttattgtagatcacctgacttgtcccaaagactgagtaaaaaatgagatgatagaagctgttaattgaatgcaaacagtactacttgatgaaacaaatggtggaaaatgccttattatgatggaaattaaaggtgatgtttttaagatctggggayataaaaatagactggcatataaaccaggccaggtgttagctataattcttttagcartggtgtttatgcccagttaaattcaatatcctcatgggagaagggagataactgagataaaataggcaaattagttaatgaaaaattgaaaaatagaatatgaaaaggtaataacccatatgagccaggtaaattacagacacagtggaagttcaagaaataaccatttctggatcaatattttcatgtacttaatattttttccttggtgattaatagcataatcaaagaggctgttatgggtaaaaatatgtctcttaaaatatggtaaaattgacaaggtgaggaaaaaatgaggtcactgaaaagtgttaattataaattaggaaaccaaaaattctcacagggactgaaaaccaacttaaaaaaaaaaaaaaccaacataccaaacttttttttttttttttttgagacagggtctctgttgcctaggctggagtgcagtgacaagatcacagctcattgcaaccttgacctcctgggctcaatcgaccctcccacctcagccttctgagtgcctgggactacaggtgcaccccagcatggctggctaatttttgtattttttttttttgtagagataggattttgtcatgttgctcargctggtctcaaacacctggcctcaagcgatctatcctcttcggcctggaaaggtgctggaactacaggcatgagctaccatgcccagctcaaaccaaacttttaattgcagcatgatgctctgctaatgtaactcagtgagcaatcacaaagtgaacacatccctgttaccaccaccctagtcaggaaataggacatcaccacatcagaggccccccgacaaccatgtgcctcatcctaattcttaacatctccaccctcaccaaatgtgactgccatcttgacttttaacaccaaagattagttttgtttgtttctgttctttatgtaagtgtgctgacacaataggtctccttttaagtttggcttttgctccccttaacattatgcttgtgagattcatcaatgtcattgtaatagcagttaatttttgttgctggggagtatcctatcgtatcactgtaccataatttatatgaataaataagtagtatttattcattctactgttgaaggaattttgggctgtttcacatatcatgctataatgaatattcttgttcatgctttaggatgcagagatttcttttgggtgtgttcttaggcatgaattgatgtcataggatatgtgcattttcagtttctcagctgatactgagaaagtgaaaagtgacggagctgttaacggcacttcctctaatagtgtaggagagttccagttgctctccttgtcaatattgatattatcaatctttctaactttagctattctaatgagtgcatgctgctattgctcatggttttaatttctaattttttactratgaggttagtaccyttcatatatttayagttcagttggttatcttacttttgttaactttctgttcaagtctcttatctgtgtttcattgagttgtctgatgttttttcttattgattgataggcacaacttgtaagttctgcatgtgagccctttgttgatatatgtgttgcaaggatcttctcccattctayggtttgcctttttcgctcacttaaaggtgtcttttcatgagcaaaagtccttcttgtagtctcatttttaaaatcgtttttcctttaaggcgataattctcaatgatagggtgagtatttttcaggcaatatttgggacatactgagtatctatcatctatctatctatgatatcttcctatctatctaatctatctaagatatctatctatctatctatctatctatctatctatctatatggttttttccttgttgtttatctgagattctaattgaatttggcatcttgttttttcctcctaaatctggtaaccatacccaggggacattggagaatgtattggagaaactttgttgtcataactgggaagtggtggtggggaatcggttggtatcccatgggtagaggtcaaggatgctgctgaacgtcctacaacgcacagaacagctccccacaacaaaattgtatccagtttgaaatgtcaatagtgcaaggttgagaatcttgctttaaagttagtgcttttttatgtgccttgaagaaatctatctaaactccaaagttttaaagatatttttctattgtatcatctcaaagttttattgttttacctttcccatgtagatcacctggaattaacttttgtgtgtctgtgagataggggtcaaatttcatttttgcttctagatattcacttgacccagcaatattgattgaaatgaccatccttcccacttctctacagttcctcctttgtcataaaccaagtgtttatggataaaggtgtttgtttctggtctccattctgttctattgctttaattgattgtgtttgcatccacaccatattttactaattacagtagttttaaataaatcttggcatctggaagcaatctttttttttggcctttaaaacatttatataaatgtctggggtgcaagtgcaatttcattacatgcatatattgcataatggtcaactcagagcttttagggtatctagtaccctaataacctacactgtacccattaagtaatttctcatcacgggagtatctcgattggatttcctcagaaacagaccctgatacaaaaatttgagtgcaaatagtttgtttgtgatgkgattcctggaagcactgatgggtgagtgaagaagtgaaacagagaaggaaagaaaatacagggtgtttcaatgagcaaattacctctgtgggcacctggggatttatctcacccaggacttttggaagatggtgtgggacatgtctcagcactgttccactagaaggaacatgaatgaaataatgaaactgggttatttatccagcaattctcatccataatgggttaaggcaactttaggggcattaactctctgacatttcttgtctgctgtgtagtctggctgagcatgctcttgtggcctgagaaagcttttggggagagttgtggaagattggcataagaagccttctgtagaggctcactttggtgagcattgatgatacgttggcaggacaccaacagtatcacctaccctccaccttttgaaatggtctgatccagtacctcacattgagttcatttcatcttgtcactgattgttcaagggggtagccatttcaatttataataaaacggtcttataaagggaagtgtattactcagggttctctagagaaactgacccaataggatagatattatttgtaatacagagagagagagagagagacagagagagagagaggagagaggagagaggagagagagattaaagaattggctcaagctgtggaagctagcaagtctgaaatctgtagggcaagccagcaggctggaaattcagataagagttcaagagttgatgctggagtcttgaatctgaattcctcagggcagcaggctggaaactcaggcagtatttctatgttgctgtcttgaggagaattctttctactttggggaacctcagtctttgcttttcaggtcctcaacttatgggataaggcccacctatgttatggaggataatttgctttacttaaagtctactgatttaaatgttaatcacacagattcattgcaatccctatagaaataccagtgacatttttcacagaaatagaaaaaaatcctaaaatttttatgcaaccacaaaagacctcaaatagccaaagtaatcttgaacaaaaagcacaaagctggaggcttcacactactagacttcaaaatatactgcaaagttgaagcaaccaaaatagcatggtactagcataaacaatagacacatagactgatggaacagaaatgagagccaagaaattaatccatgtaactacagccaactactttttgacaaaggcaccaagaactctcattagtgaaaggacagcctcttcaataaatggtgctggaaaaactygatatccatatgcagaagaatgaaactagactcccacctctcaccctatatgaaaatcaactcacagtggatcaaagatctaaatataagacatgaaactacaaaactactagaagaaaacatagtggaaacacttcaggacattgctctgtgaaaagattttatgaataagacctcaaaagcacaggcaacaaaagcaaaataaacaagtgggattatatcaaactaaaaagcttctatacagcaaaggaaaccctacayaaaaggaaaagacaacagagtaaaaatacaacctacagtatggggggaratttttgtaaacaattcatctgacagaagattaatatccagaatatacaaggaactaaaaatctcaatagcataaaaaaacccaccccaaaatgattaaaacatgggcaaacgatccaaacacagacagttctgaaaagaagacaaacaaatggtcaacaaatatttaaaagatactcaacattgctaatcaccagggaaaggtaaatcaaaaccacaatgaggtatcatctcactgcagttagagtggctattaccaaaaagacaaaaaatarcaaatgctggcgaggatgtggagtaaagggaactcttatatactgttggtgggaatgtgaactagtacagccactatggagaaaagtatggaggttcctcaagaaactacaaacagaactaccacatgatctaacaatccyactactgggcatttatccaaaggaaaggaaatcagtatattgaagaaacatgtgcatccctaagtttatttcagcactattcacaataagccaagatatataatcaacctaggtgtccaacaacagatgaatggataaagaaaatgtggtatatgtacacaatggaataaattcatcaagccacattcagccataacaaagaatgaaatcctttcatttgcaatggcatggatagaactagaggacattatgttaagtgaaataagccaggaacagaaagttaaacaccacatgttctcactcatttgggaagctaaagaaaagttgatctcatagaagtaaaaagtagaacaagagggtactagatactagagaagggggtggggagaggaggagatttgttaaaggatacaaaattagagctagatagcaagaatgagttctagggttctatagcaccataggataactayagttaacaataatatatagtttcaaatagctagaaggaggatattgactgtcctcaacacgaagaaatgatgttttagatgatggatatgctaattaccctgacctgaccactatacattatatgtatcaaaacatcaccatgtatgtactccataaatatgtacaattatatatcaataacaaaatttaaaaatgaaaatgtcatacaaatattaatagcatcttaaaaaatatttttatagggacaagctacagtccatactttttttcataattttattttatttttattatacattaagttctagggtacatgygcacaatgtgcaggtttgttacatagatatacakgtgctacgttgatttgctgcacccattaactcgtcacttatattaggtatttctcctaatgctatccctccccctgcccyccaccccacgacaggcccctgtgtgtgatgttccccrccctgtgtccaagtgttctcattgttcgattcccacctatgagtgagaatatgcagtgtttggttttctgtccttgtgatagtttgctcagaatgatggtttccagcttcatccatgtccctacaaagaacatggactcatccttttttatgactgtatagtattccatgatgtatatgtgccacattttcttaatccagtctatcattgattgacatttgggtttgttccaagtgtttgctattgtgaatagtgctgaartaaacataagtgtgcatgtgtctttatactagcatgatttataatcctttgggtatatacccagtaatgggatggctgggtcaaatggtatttctagttctagatccatgaggaatcaccacactcccttccacaatggttgaactagtttccactcccaccaagagtgtaaaagcgttcctatttctccacatcctctccagcatctgttgtttcctgactttttaatgatcgcctttctaactggtgtgagatggtatctcattgtggttttgatttgcatttttctgatgaccagtgatgatgagcgttttttcatgtgtctgttggctgcataaatgtcttcttttgagaagtgtctgttcatatcctttgcccactttttgatggggttgtttttttcttgtaaatttgtttaagttctttgtagattctggatattagctctttgtcagatgggtagactgcaaamattttcttccattcgctacagtccatacttttacagtgagtcctgaggtcattattaacagtcattatcttcctttagcaccttttctgcattccctaccctaactccctggcaagcacttctgatggtttaggttgtttattcaataaggcaaatcggatctttatctctaaggttaccgtgccattgttaaggcaggatttytgcaattgtgtgttatagttatcactgggtagaagcatcaagaagtgtcttgtactgcttyctgggccacaattacattgttttgtggcaacaacttgatctcttcatgataaccagggtcatttagtaacttcactgttgcctagagatctactgtcaaaagaagcttgacatgacagttggcagccgtaactttattttttagtgaaacccttattgtatccctggccctggtgaaagcaaatcccccactctgtgcttggaaatgaggacctttattaagtgggacctaaaattgtagggacagaaaagccaaatttaccacgttggtccctaggagtgcttgccttatactatgacttggtggttctgatatgattcagctcatgatggacagctgtgatcacacagtcacccttatgtcccatggtcagataytcagtgtctgctagggcccagtagcaccctgggarctacttttcatatggtaaatagttctctgctacatatggcataaccttactatggaaccctagaggtctgtgctataattcacttatgagggcttgtcagtcatttcagaggtgcccacccttatctgtcatggctacctttagcacccatggaatctgctgggtcatatgattacgggccagggctgctcatacagcaggatgaayrtgccgcaggactctcttgttttgggagatcctctraaaagctgacagcagccttctgagaaaacccattaaatgggctggarcagtattcccaagagtgttatatgctatgtgcaaaatccaaagaggsctgccgggcactgygcctctttgtagtccatgtcgtcaatatagcggatccatctgatgatctgtgraatgtccasatgcaaaggtctctttggactgtgttgagagagaaccggaggtttaatatagtgctgagatgagactgctttccatmctgggtgaatgcaaactgttctgatccttcctcctgacgggaactaaaagaacacatttgccttatcaaaagtcacatatcaaatgctagaggctgtgttgctctattctaatgaagacacaacatacaaaactgcagtaaccgctgcyccaccacttggtagagtagtctgctatcatctgctagggtgtatttggttttccaggtgaccatytctgtatcayttaaatctttgaggctaccaccaaattctgccattttacctggaatgttgtattgtttctgatttgccatcttggctaggttgtggacaactaaagccttttttaccrtaatgcctcttattttataagtcagggaatcaygagagttccatcagcrtttaagtgctgcctatacattaaaagtatgcactcagggaccagggtatttaccaaagggtaggttcaaggacccaactggcccactgtgggatrgatttaggatagggcttcctttatcatttggtgcctttcaagtgcaactctaacagrtggaccacaacatattttgggttccctagtattagtgagaggtgacagygtgctggcagccctggcagccctyrctcactcttggcggtgccttggccttggcgcccactctggccatgcttgaggagcccttyattctgccgctgcactgtgggagcccctctctcagctggctgaggctggagccggctccctttgcttgcggggaggtgtggagggagaggcgcaggtgggaaccggggctgcgcgcggcactcgggggccagtgtgagttccgggtgggygtgggatcggcggcccatgctagggcttagcacctgggccagcagctggggagggtgcaccgggttctctagcagtgccagctggcaggtgctgcacttgaattcttgccaggcctcagctgcctctcygtggggcagrgctcggaacctgcagcccgccatgcccaagcctccccactgccctgggctcctgcgcagcctgagcctcctcgacaagcactgccccctgctccagggctcctggtcccatcaactgcccaagggctgaggagtgtgggcgcatgtgggactggcgggcagctctgcctgaaaggccctggtgtaggatccactaggtgaagccagctgggctcctgagtctagtggggacttggagaacctttatgtctagctaagggattgtaaatacaccaatcagcactctatgtctagctcaatgtttgtaaacacaccaatcagcaccctgtgtctagctcaagctttgtaaatgcaccaatcagtgctctgtgtctagctaatctggtggggacttggagaacttttatgtctagctaagggattgtaaataaaccaatcagcaatctgtgtctagctcgaggtttgtaaatgcaccaatcagcactctctacctagctaatctggtggggacttggagaacttttatgtctagctaaaggattgtaaatgcaccaatcagcactctgtgtctagctcaaggtttgtaagctcaccaatcagcaccctgtgtccagctcaaggtttataaatgcaccaatcagcactctgtatctagctaatctgatggggacttggagaacgtttatgtctggctcagggattgtaaacgcaccaatcagcaccctgtcaaaacagaccaatcagctgtctgtaaatcagacaaatcagctctctgtaaaatggaccaatcrgcaggatrtgggtggggccagataagggaataaaagcaggccgccccagccagcagtggcaacctgctcgggtccccttccacactgtggaagctttgttcttttgctctttgcaataaatcttgctgctgctcactctttgggtttgcactgcctttataggctgtaacactcactgcgaaggtctgcagcttcactccggaggccagcaagaccatgaacccaccaggaggaatgaacaactcgggacaggaggaacgaacaactccagatgcgccaccttaagagctgtaacactcactgccaaggtttgcagcttcactcctgaagccagcgagaccatgaacccaccagaaggaagaaactccgagcaagtctgaacatcagaagagacaaactgtggacacaccatctttaagaactgtaacactcaccgcgagggtctgcggcttcattcttgaagtcagtgagaccgagaacccaccaaattctggacacattagtaccagctcagatcctatacacaagacctcccaaaagtgctgcatattttgtaggttcctttggcaaaggattggaacaataytttctgaaggtcagatgaagcatartggaaggacccaaagtcaccagttctctcagatgcaactggggcagtgagaaactaaagaaaatattcataaaatggtatacaagtaggggcaacacacaaggtagaagagatgtcaaatgtttgctctcctgaaactgttagctgagctttgatgagtgtcactccatgtttcctggcataggtgagggttccctctctctgaaagggtggtgggatccaggttacatccctgttcgtaggagtcagggttagaagttaattgttatggagtgatcaraagatgtttccctggctcctgcaatgcctccgacccccttggtggcctctgttacatagggattggaagactccctcttgaggggtgtggcttcaaaaaaggagcatttcctatctccaggaaatggagacatgacagtatactttttggcctgcttgtttttytttaccaaaaacaattttaggaaaagcttgagaatatgtaagkctcagtgatgtgactttttcctttttcttctgtcgttgaagaggaagagttgaggaacctccttggatagaaggggtatagcttattttaggacttcaaccaaaggcacgggagagagaacaggccaaaggactgtaaggaaggttatctcaggattgggatccggcaggaaaaaagccctgggtcgttattctccacttacccctccatgacagcgcctcaccttgctctggggcctacttttgagggcggcttcaaaagccactctgtgctctggctggcagttggggttggccagtggaagcactggcaggagrtggaggsaggaagagagagaggtggtggaatttgttcacagaatctcttsctgccagaccaccagttggctgtgggtccttcctctattgcagcccacagctcctgccctatagctgcaaytggcaccatagaggtagaacttccactctcttcccaggtttcaagaaccactccttctccaggccccttcctgctggtaggcagtggtggcttctcactcttgctagctctggggcacatcaccatgccctactggttttctgtaactctgcttcttttgcaaatattccctctgttgaattttccctacattaccctgcgtgattgtgccattggccactgctgggatgtgacagaaaggccatttgaggataaaggaccaaagaacaggtcaatgtgattatttcagagcctgaggtggggttgattacagaaaactcacagctggtcagggtgcacttttcagagccagggggcccagcaaagatatggtcatatacyagatgcaaatcagagaagattttcatcaggaaaactatcaygaaaattagcaaagatcttagcttcctggctactcttacctaatgatgtaattaytgatgagaaaatgaacccaaagtaatgcagccaactcctcttctggggagtggttgcrtttaattgcactaaagccacgtaacaaaarcaacagcaaaacccccaaacacttaaactacccaaacaaattgaaagtgctgaaaagttgagtgaggacagaagcctctcatcatttaatccaaaacatagactcactaaataataaccccagccacaaatcatgtaatctagagagagatctatgagctctttctctgtctctytctggcctggcagactgagagatccagtgcacagaagatccagtgcacagaagggcagcctcatatggtttgtatggggaatacttagtcttgggatattcaaagggaaaagaggaaaagtccagggtttttcctggaaaaaccaggcttgccttagagctctcatactgacaaaccctttaattacatgtattgtgctgtgtattggcatgtagtcagtgttcagtgttttttggagttgttktttgctttttttgtttttatagacagagtctcactctgttgcccaggctggaatacagtggcacaatcatagctcactgtagcctcgaaatcctgggctcaagcgatcctcctgccttggcctcctgtgtagctaggattacagacccacactactgggcctggccagcagtgtgttttgacttgagcagccttggcttctttctctttccctcagcagcggggastcagcttggccagtgcttgtgatgggcaagccwggggcatccycttctcatgggttgggtgaagmctctagtgctgaaggacaaagctcacacaactccccrcttttggctgtcagcaccagccagacaggagcaagaaccaggaacaactcccagcatctcagaatcaaatctcyactcctggatgctctagtctttcctgattacaggcccacatggagcctgtttgaaggggtcgctgccatgggctgagtcagggcattgaggyctggatgtcagggcycagcagtgtccagtttccaggcctcattacagctgctyccatgaggggttcccccagcactgggcctggagagttatgagtctctcctgyamtttctgctctggggacctggttccacaatcttccgggaaggtctttctggtgtatgtgctctgtttcagtttatattctggactcctatgaagatgtttcagcaaagtcttttgctcctttttgttttatgtttagttatgtctgttgtaaaaaatcaatgtaataagtttataattaattaaaaaaaaacccagtcacttctaatctcacaaacaagtgtgcacctattatcccattgttgaagatatggtacatataatttttttctttgcctcaacattacattatattaagactaaaggctggacaatggctccatgtggtggaggggaggggtttcagaagcctggtcctcatcttgtctttttttttttttgagaccaggtcttggtttgttactcaggctggagttcagtggtgtgaacacagctcactgcagcctcaatctcccaggtttagcaattctcccacctcagcctcctgagtagggtagctgagactacaggcaygtgccaycatgcccagctagtttttgtattttttgtagagatggcatctcaccatgtcacccaggttggtatcaaactcctgagctcaaatgatcctcctgcctcagcctcctaaagtgctggaatacaggcatgagccactgtaccagcctcctcttgttttatacaagggaagaatcctatttcaaagtgaaaggaggagttcatcttcttgtattggatcctgtgtcagaaatatttttaaaagattttattataaaagttttcaaaygcatacaaaagtaggaaggattgtatagtgaactcaatgtatctgttcctcaccttccatcataatcaatacatggccaatttaatttcctttacaccttccattccttgccttatgccaacctccccaacccctcagattattttgaagcaaatcccagacatcamcaaatactcttstacaccatgagtatgggtctcaagttagggaagtgatctggttctaatttgtatacttggcttgccccactcctccagtggcctgaggagtcatgggtagggcagggggccttgcctcctgctcttgcatgtggtctttcacaacagctgaacatatgggggacctgtcccaggaaagcrtcaaccctggaccctgagggatatgtccagagaagtgaggaggctggaggaatgagagctattagtcagagaaagaaaagacctggagaggtatgaccattgtctttatatgattggagggtggtttggatttgaagtgttagatttgttttacttgttcaggtgtgaacacagaatgcaaatgaaggccctctgggmagaaataaccaggaagcagatttttagttcaagaactttctaatcatctgagtggtcaaaaagtggagtasgtcacccaggctwggggatcaccaggtgaagaygaggtagcagaatttaagcaatgggttaggrtggtacatgagtaaattaactaagttcctttaaatgaattttccagtttctaagagaatcaatgacacacttggttaagagtcaagaactttgtgtgaccacagaagtccttttaccttattgggtcctactcatacarttaggattttggattatgtgatagcaataatagctaactatgttgagcccttatgtgttttaagcaagtattagcttgctttcaataactacataagatagtgtattagtccaatctcacactgctaataaagacatacccaagattgggtaatttataaaggaaaaaggtttaattgactcaaagctcagcatggctgggaaggcctcaggacacttacaatcactgcagaaggggaagcaaacatgccctcttcacatggtggcaggaaggagacgtgccaagcaaaagtgggaaaagcctcttataaaacaatcaggtctcttgagaacccactcactttcacaagaacagyagcatgggggtaattgcccccatgattcaattacttcccaccgggttcctcccatgacatgtggggattatgggaactacaattcaagatgagatttgggtggggacacagccaaactatatcattccaccactggctccacccaaatctcatgtcctcacatttcaaattayaatcatgccctcccaacagtcccccaaaggcttaactcattccagcattaactcaaaagtccgagtctaaagtctcatctgagacaaggcaagtccctcctgcctatgagcctgtaaaatcaaaagtaagttagttgctttctagatacaatgggggtacagacattgggtaaatacacccatttcaaatgggagaaattggccaaaatgaaggggctacaagccacatgcaagtccaaaatccaatagggcagtygttaaaccttaaagttccaaaatgatctcttttgactccatgtctcacatccaggtcacactgatgyaagaggtgggttttcacagtcttggggagccctgccccttggmtttgcagggtacagccccaacttctagctgctttcacaggctggcattgagtgtctgtggctgcacatgatgcaagctgttgctgggtctaccatyctggggtctgaggacagtggccctcttctcacaactcyactaggcarcgccccagtgtggactctgtgtgggkctcccatcccacatttcccttccacactgacctagcagagattctccatgagggctctgcccctgcagcaaacttctgcytgagcatccaggcatttccatacatcttttgaaatctaggcagaggttcccaagcctcacttcttgatttctctgcacctgcagrcccaacaccatgtgtaagccaccaaggcttggggcttcaccctctgaagcaaaggcctgagctgtacattggccrcttttggccatagctgagatgcagggcaccaagtaccaagactgcacaaagcagcaaggccctkggcccagcataygcagccatttttttctcctcagcctccatgtctgtgatgggaaggactrctgtaaagayctctgacatgccctggagacattttccccattgtcttgggaattaacatttggcttctctttacttatgcaaatatctgcagctggcttgaatttctcctcagaaaatgggtttttcttttctagcacatcaccaggctgcaaattttctgaacttttrtgctctgcttcccttttaaacataaattccaactccaaaccatatcttcatgaaagaataaaactgtgtgtttttaagagcacctaagtcacatcttgaatgctttgctgcttaggaatttcttctgccagataccctgaatcatctctctcaagttcaaagttccacagatctctagggcaggggcaaaatgccaccagtctctgtgctaaagcataacaagagttacctttgctctatttcccaacaagttcctcatctccatctgagaccacctcarcctggactttattgtccatatcactatcagcattttggtcaaagtcattcaacaagtctccaggaagttccagactttcccacattttcctgtcttcttctgagmcctccaaactgttccaacctctgcctggtacccagttccaaggtctcttccacacttttgggtatttttacagcagtgccccactacctggtaccaatttactgtattagtccattctcacactgctwatcaagacatacctgaggctgggtaatttataaaggaaagatgtttaattgattcacagttcagsagggctggggagacctcaggaaacttacaatcatggcagaaggggatacaaacacatccttcttcacatggtggcaggaaagagaagtgccaagcaagagggaaaagccccttacaaaaccatcagatctcgtgagaaatcactcactatcatgagaacatcagcctgattcaattacctcccactgggtccctcccatgacttgtggggattatgagaactacaattcaagatgagatttgggtggggacacagcaaaactatatcagataggtactataattatctgtattttggatatggagaaactgaggcacagagacagtatgtattttgctcaaagtcacacagctatcatatgatagagctgggatttgaacccaggcagttggtttcaatgctagcatgcttaaccactatggcacagtatatttcaaagataagtttgagtgtttcagctctaatcatacagtgattctaggatgaaatgagataatatatgtgaccttgcattattctacacaaatgacaccacttcacatcttatatttttctcaaaasaaggatattacaatttcttttctccaaccagatcttggacaagctgtgctcctctgagacagtaacatcagacaaaagtctcatagaccgtgatctctgacagggcgagtactgaaccagscgtattcacctttgaaagcctgggacgatgtaggccctcaggaggatttgtttattgattgatggcaggactgtggcccagaaaacttttcactcgaaaggtgccatgttccaggtggccagctgggggagccttagcccaaaggcagggcaggctgaaagtagcagaggctgtgttgtgattggcggtcagcggtccggagtccaccgagggctgggctggatgtgaagggttgagttgcckgtgaggagaggccttgcctgtcccagaggcctggtcccgctcagccaggtcatgggacagtggaaaggccccgctggaacctaggaggaagtkgcgcwggtcaagacggtcttaggggacaggagctggtggcgggaggggagacagcactccgagcaacctcagcgtgcctcgagggggacaggcatccgggaggccagmggctgagctgggttctgggcgctggcaggtcagcagggcagggaagagaaggkcatcgagggtgggcctgggggcttcccagcagccagcccctgtgactgggagaaaatcctgcccctgggcggaaaggcccccatctctccctaatggtgagagggcaggatcccgaaggggccccaaaccgtacctctcagtgtgcgcctccttcaggcgatttcccaccccatccgcgtcttctctgccattcaaaggggcaagggtgtgtaggagasgaggtagggagatacctctctcccgaggatccctggcagaggggcctggcactgcaggggtgcatgcragaagtgggtgcacgtccgcagagcttgggtgggcagcaacgagagggcttgggtgggcgagaagagaaggcatgggctgcttgcactcattttattccaaccccacagaatgcggctcaaccacgaggtgagttgctgaggctgggcgaatgctctgctcccattttacccagggaagccagatggagacctgagagaagataggaggaagaayccggaaccccactctcatgggaagtggactcggaccagagactttcctctttatgttttattttattttgtgtttttagagacagggtctcactccattatccaggctggagtgcagtagcaccatcacagctcactgcagcctcaacctcctgggctcaagcaatcctcctgtctcagcctcctgagcagctgggaccacaggtgtgcaccaccatgccccactaattaattttttttatggaggtggggtctcactatgttgcccaggctggtctcaaactcctggccttaagtgatcctcccacttcagcctcccaaagtgctgggattacaggtgtgagctgctgtgcctagttcctcgttttttaactctatttcctcttccccaaggaaggagatgaaggagaggcctctgtttgctgctagtgtgaggttaagctgggaggatggccagaggctgagtcacaactcctgaggcccctttaggtgctgcggtttcagtagtccaggctcctaccctctttaggccacttcagccccaggttctagcaccttcaccctggtgcttttccctcccagggagtctcatgaactatttcctttggggaaggtgaagaaagwccagtttagcttggaggggaccatctctactactcaatgccccaatagaggacttcccagctgtcatctcgaaatttctcattcttggcacttgtgggwaaagtctaattctagagctccccagagtcactttatctcctggggcagtaaaaatctgcccatggcactgatcttggaggagacctcttatcttcagggacaccgcatctgctagaggtggcagaggccctgccattgtttctttccgcctttgagctgcagcacctttttcttggctggtctgaagaacccctctacccacactgcaggctggaggtcgccttgcatgctccggctcctaggctgggtgagccttagagcctttgggtggactsctrctttagcagcttaggaaggcaaatgctggctcctcttcctytcctcamttggtaggactcagagcaaagaaaggatggcttttctccagtccttctcccttttcagacaggcggcacagctagagaaatatgtaaagatcaggggaagcctgttttgcatagtgagagtcttgcaygcttgggacatcaggacagcctccaggggttctaagtgtgtgtggactattctcagggaagaaatgctggagggccttgggctgacattctagctcctccacactgctcttgacatcctagaataaaaagggaaggccaaggtcacctttagggcattctttgaatgtggctggcctggggctggaatgggagaatatagtgcggtcctggctctgaaaaaccacagttactctgggtctgtgccttaaagctgtggtttcatgacgtcagatttcctctcaacagccaggagtaatcaagatagagaaccatttaggcttgttccttcctatatgtcaacagctattctaccccagggctcagatttagagctagtgtcctgttctctttagcagaactgactcctctctcctctgtgcctctgtgtgattgctgacctggccttaagcaccgcctcagtggttaagttttgcagagagggctggttacttccctggtacctctcttgttattgaaccctagtttcctattgactatctatcttttcttcatttactccttattttgtcatgtctagctcccagcagttttctgagaaagggtacttggaaagccawttttttttagactttcaacgatggaaatagatttattcattcctcacagttgattgatacactgtctgcttaagctttttgagggtcaaattatgttctctggtatcagtagtaactgtgagctgtgagagayctttctgtttcatgatagacagatacratatgatggactcttggagaaatcgctggtcacaagggaagaaggtgaggtctctgatgaccctcccaaaatacayatagccaataaaccaaatcatatctgagcccagtttactggagctgtggattggggtggccaagagctttgtcatgcgtatggtaatagcttataagtatttattcccaaatggctaagaaattaaytgagcaccatttattttaccayagtttctgtgtttactatatactaaatgttttctataggctagagccattatctgagctctctagtcagtttcatggatctatctggtcaattcttgtagcatcatatatattttaaagtttgtcttctctttatgtatttattttatttatgaggtgtcttargaagaaatctcaaactgtcaaaaggctctgattttgttcttgggctacctagtgcttttgacagccttggaagatgcaatggaaagcatgtccatcaatgctaaaaatgtcatgagttggcaggaatacacaaaacccaggagagcaaagtagcagtctaaaaagattctgctaatgatttattaaagtctcaaaagattatatatatatataaatatatatatatatttttttgagacagagtctcattgggattacagggattacaggcatctgccaccatgcccagctaatttttgtatttttagtagagatggggtttcaccatgttggccaggctggtctcgaactcctgacctcaggcaatccgcctgctttggcctcccaaagtgctgggattaccggcatgagccactgcacctggcctatatgtatatacttaaaggatagatacagagtctctcatttggtttaaagaccaactgcacaagaataaaagtgaatatgcatgccttaacagttgtgtatgtcaagaacacacgggtttcacttggatgcaaagtcagcttgaggctgctctactctgatcagataaaatacctacaggaaccaggatggtaactgcactagtgcagtggactgttaatttaactatattacattatatttaatttaatatgtacatgttaaattaatatgtaactttatttacataataaacattaaactcataggaagaatctttatttctacaaagccgtgtgtgctctccccactttttttgaagcacatggccagctctctccatctatatttatcattctccatgttcgatacagaaaaatttcaagaaaaatttcatttttctccttactgcgagaaaagcaacagcataacagcaatgatacatggaaacggacactctgtgctggggaagcaaataaggggaggtgggatttcctgtgtgggaattagatggttgcatgctccttctgaactgagcagccatcaactccaactgattcttgccatacaggagtatgggtcaatgattgccagacctcatgttcaggagatgccagcaatctggattttcccatgagatttcctgattttaaaaattttggcaaccatgtttttattttattttttatttatttatttatttttttcagtgttgtgtgcattctttatttttattattatttttttttattatactttaagttttagggtacatgtgcacattgtgcatgttagttacatatgtatacatgtgacatgctggtgcgctgcacccaccaacgtgtcatctatcattaggtatatctcccactgctatccctcccccctcccccgaccccaccacagtccccagagtgtgatattccccttcctgtgtccttgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaatattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggttttaatggttttaggtctaacgtttaaatctttaatccaccttgaattgatttttgtataaggtgtaaggaagggatacagtttcagctttctacatatggctagccagttttcccagcaccatttattaaatagggaatcctttccccattgcttgtttttctcaagtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtgccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacatgcagagacaaacataggctcaaaataaaaggatggaggaagatctaccaagccaatggaaaacaaaaaaaggcaggggttgcaatcctagtctctgataaaacagactttaaaccaacaaagattaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacaaaatgaaggcagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacgcaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatgcaaccatgtttttaaaaccttgtgcaggacaggctcaatgagcaggataggctcaatgagcaggatgctggattgtgctgtctcaaacattgtagccagctctaagtactttattttattttatttttttgagacggagtcttgctctgtcgcccgggctggagtgcagcggggcgatctcaactcccttcaacctccacctcccgggttcaagtgattctcctgcctcagcctcctgagcagctgggattacaggcatgcaacaccgtggccagctaatttttgtatttttcgtrgagacggggtttcactgtgttgaccaggctggtctcgaactcctgacctcagatgatccacttgccttggcctcccaaagtgctggggttataggcgtgagccactgtgtctggccagccctgagtacttcaaagtaacggtgacaaactacagcacattaaaattgtgagagaaactagaagmttgggaaaagggtggaagacccagggatgatgcttctgagaaaagaaagctcagctgagatttgataccagacttctggttgtgtatgaacttccctgttagggacagaacatttttttactggagacaggaggagcgatgggatcaggtctagcattygaaggtattttggaagcagctgtgagatctatataagcagaactaacaatcagctactttaggacatcaggacatatgtgcctgggaaaagcagtgagtttycatcattggagatgttcaggcagcatcttcaaccagttggggacatcataaagagtactgaaacactggaggagggcatcatgtccagtcctgatggtcctgtccatccctaagggattatgattccaatcttctttagctactgtggagcatttgggcttttcctttccctaagctcccwtgcaagttgtaccattctttttgctatttaaggcatgcagtaggcaataattcaatgtatggggttccaatcctgggtgccctggcttttgcccttggcaaagctttatagcatctcttagccttactttatttataaaaatatgagtgaatacaaaatatcagtgtgaagattaatatggcccatgcagctcttgtgagaggtcatggagattgggactgtyraatggcctttaaaaaaaattaatccaatggcctttaaaaaaaatagtcttttaaaaaaatttagctctgctgaagggggaggttccaagatggcagaatacgaacagctccagtctacagctcccagcatgagcgatgcagaagactggtgatttctgaattttcaactgaggtacagggttcatctcactggggcttgttagacagtgggtgcaggacagtgggtgcagcccacggaccatgagccaaaacagggtgaggcatcatctcactcggtaagtgcaaggggtcggggaattccctttcttagccaagggaagccataacagacggcacctggaaaatcaggtcactctcaccctaatactgcacttttctgatggtctcaacaaacggcacaccagatgattatatcccacgcctggcttggagggtcccacacccacagagacttgctcactgctagcacagcagtctgagatcgaactgcaagtcggcagcgaggctgggggaggggwgcccgccattgctgaggcttcagtaggtaaacaaagtggctgggaagctcgaactgggtggagcccatggcagctcgaggaggcctgcctgcctctgtagactccacctctgggggaagcgcatagctgaacaaaaggcagcagacacttctgcagacttaaacgtccttgtctgacagctttgaagagagtagtccttctcccagcacggagtttgagayctgagaatggacagactgcctcctcaagtgggtccctgaccccgagtagcctaactgggaggcacctcccagttggggccgactgacacctgatatggctgggtgcctctctgagatggagcttccagaggaaggatcaggcagcaacatttgccgtttcacaatatttgcaattctgcagcctctgctggtgatacacaggaaaacagggtctggagtggacctccagcaaactccaacagacctgcaactgagggtcctgactgttagaaggaaaactaacaaacagaaaggacatccacaccaaaaccccatctgtatgttaccatcatcaaagaccaaaggtagataaaaccacaaagaggggagaaacgagagcagaaaagctgaaaattctaaaaatcggagcacctcttctcctccaaaggaatgtagctcctcaccagcaatggaacaaagctggatggagaatgcctttgatgagttgagagaaggcttcagaagatcggtaataacaaacttctccgatctaaaggaggatgttcaaacccattgcaaagaagctaaaaaccttgaaaaaagattagacgaatgcctaactagaataaaccgcataaagaagaccttaaatgacctgatggagctgaaaaccatggcatgagaactatgtgacacatgcacaagcttcagtagccgatttgatcaagtggaagaaagggtatcagtgattgaggatcaaatgaatgaaatgaagtgagaagagaagcttagagaaaaaaagagtaaaaagaaatgaacaaagcctccaagaaatatgagactatgtgacaagaccaaatctccgtctgactggtgtacctgaaagtgacggggagaatggaaccaagttggaaaacactctgcaggatattatccaggagaacttccccaacctagcaaggcaggctaacattcaaattcaggaaatacagagaacacaacaaagatactcctcgagaagagcaactccaagacacataattgtcagattcaccaaagttgaaatgaaggaaaaaatgtgaagggcagccagagagaaaggtcgtattacccacaaagggaagcccatcatactaacagcggatctctcagcagaaactctacaagccagaagagagtgggggccaatattcaacattcttaaagaaaataatcttcaatccagaatttcatatccagctaaacgaagcttcataagtgaaggaggaataaaatcctttacagacaagcaaatgctgagagattttgtcaccaccagacctgccttagaagagctcctgaaggaagcagtaaacatggaaaggaacaaccggtatcagccactgcaaaaacatgccaatttgtaaagatcatcaatgctaggaagaaactgcatcaactaacgagcaaaatgaccggctaacatcataatgacaggatcaaattcacacataacaatattaacctcaaatgtaaatggactaaataccccaattaaaagacacagactagcaaatttggtaaagagtcaagacccatcagtgtgctgtattcaggagacccatctcacgtgcagagacacacataggctcaaaataaagggatggaggatgatctaccaagcaaatggaaaacaaaaacaacaggggttgcaatcctagtctctggtgaaacaggctttaaaccaacaaagatcagaagagacaaagaaggccattayctaatggtaaagggatcaattcaayaagaagagctaactatcctaaatatatatgcacccaacatgggagcacccagattcataaagcaagtccttagagacctacaaagagacttagactcccccacaagaataatgggagactttaacaccccactgtcaacattagacagatcaacgagacagaaagttaacaaggatatccaggaattgaactcagctctgcaccaagcggacctaatagrcatctacagaactctccaccccaaatcaacagaatatacattcttctaagcaccacatcacacttattccaaaattgaccacatagttggaagtaaagcactcctcagcaaatgtaaaagaacagaaattataacaaactgtctctcagaccacagtgcaattaaactagaactcaggattaagaaactcactcaaaaccactcaastacatggaaactgaacaacctgctcctgaatgactactggttacataacgmaatgcaggcagaaataaaggtgttcaatgagaacaaagacacaacataccagaatctctgggacacatttaaagcagtgtgtagagggaaattgatagcactaaatkcccacaagagaaagcaggaaagatctaaaattgacaccctaacatcacaatgaaaagaactagagaagcaagagcaaacacattcaaaagctagcagaaggcaagaaataactaagatcagagcagaactgaaggagatagagacacaaaaaatccatcaaaaaatcaatgaatccagaagctggttttttgaaaaagatcaacaaaattgatagaccactagcaagactaatgaagaaaagagagaagaatcaaatagatgcaataaaaaatgataaaggggatatcactactgatcccacagaaatacaaactaccatcagagaatactataaacacctctatgcaaataaactagaaaatctagaagaaatggataaattcctggacacatacaccctcccaagactaaaccaggaagaagttgaatccttgaatagaccaataacaggctctgaaattgaagcaataattaatagcctaccaaccaaaaaaagtccaggaccagatggaatcacagccgaatactacagaggtacaaagaggagctggtaccattccttctgaaaccattccaatcaatagaaaaagagggaatcctccttaactcattttatgaggccagcatcatcctgataccaaagcctggaagagacacaacaaaaaaagagaattttagaccaatatccctgatgaacattgatgcaaaaatcctcaataaaatactggcaaaccgaatccagcaacayatcaaaaagctgatccaccatgatcaagtgggcttcatccctrggatgcaaggctggttcaacatacasaaatcagtaaacataatccatcatataaacagaaccaatgayaaaaaccacatgattatctcaatagatgcagaaaaggcctttgacaaaattcaacaaccttcatgctaaaaactctcaataaattaggtattgatgggacgtatctcaaaataataaaagctatctatgacaaacccacagcaaatatcatactcaatgggcaaaaactgaaagcattccctttgaaaactggcacaagacagggatgccctctctcaccactcctattcaacatagtgttggaagttctggccagggcaatcagacaggagaaagaaataaagggtattcaattaggaaaagaggaagtcaaattgtccctatttgcagatgacatggtggaatatctagaaaaccccattgtctcagcccaaaatctccttaagctgataagcaacttcagcaaagtctcagcatacaaaatcaatgtgcaaaaatcacaagcattcctatacaccaataacagacaaagagagagccaaatcatgagtgaactcccattcacaattgcttcaaagaatataaaatatgtagaaatccaacttacaagggatgtgaaggacctcttcaaggagaattgcaaaccactgctcaatgaaatcaaagaggacagaaataaatggaagaacattctatgctcatggataggaagaatcaatatcttggaagtggccatactgcccaaggtaatttatacattcaatgccatccccatcaagctgccaatgactttcttcacagaattggaaaaaactactttaaaactcatgtggaaacaaaaaagagcccgcattgccaagacaatcctaagccaaaagaacaaagctggagtcatcatgctacctgacttcaaactatacaacaaggctacagtaaccaaaacagcatggtactggtaccaaaacagagatatagaccaatggaacagaacagagccctcagaaataataccacacatttaccaccatctgatctttgacaaacctgacaaaaacaagaaatggggaaataattccctatttagtaaatggtggtgggaaaactggctagccataggtagaaagctgaaattggatcccttccttacaccttatacaaaaattaattcaagatggattaaagacttaaatgtcagacctaaaaccataaaaaccctagaagaaaacctaggcaataccattccagacataggcatgggcaaggacttcatgtctaaaacaccaaaagcaacagcaacagaagccaaaattgagaaatgggttctaattaaactaaagagcttctgcacagcaaaagaaactaccatcagagtgaacaggcaacctacagtatgggagaaaatttttgcaatctacccatccgacaaagggctaatatccagaatctataaagaactgaaacaartttacaagaaaaaatcaaacaaccccattaaaaagtgggcaaaggatatgaacagacacttctcaaaagaagacatttatgcagccaaaagacacatgagaaaatgctcatcaccactggtcatcaaagaaatgcaaatcaaaaccacagtgagataccatctcacatcagtcagaatggcaattattaaaaagtcaggaaacaacaggtgctggagaggatgtggagaaataggaacacttttacactgttggtgggactgtaaactagttcaaccactgtggaagacagtgtgttgatttctcaggaatctagaactagaaataccatttgacccagcgatcccattactgggtatatacccaaaggattataaatcatgctgctataaagacacatgcacacgtatgtttattgcagcactattcacagtagcaaagacttggaacgaactcagatgtccatcaatgatagactggattaagaaaatgtggcacatacacaccatggaatattatgcagccataaaaaaaggatgagttcatgtcctttgtagggacatggatgaatctggaaaccatcattctgagcaaactctcgcaaggacaggaaagcaaacactgcatgttctcactcataggtgggaattgaacaatgagaacacttggacacaggaaggggaacatcacacactggggcctgtcatggggtgacgggagtggggagggatagcattacgagatatgcctaatgtaaatgacaagttaatgggtgcagcacaccaacatggcacatgtatagatatgtaacaaacctgcacctcgtgcacatgtaccctagaacttaaagtataataaaaaaaagaaaaaaaaaattaaaaagtttttcaaattttaattttttcagttttatttatttattactattaatatttatttatttattwgtttttgagacagaatctcacccttttgcccaggctggagtgcagtggcacaatcttggctcactgcagcctctacctcccgggttcaagcaattttcatgcctcggcctcccaagtagctgggaccacaggcacccgacaccatgcccagctaagttttgtatttttagtggagacagggtttcaccttgttggctaggctggtctcaaactcctgacctcaagatatctgccagcctcagcctcccaaagtgctgrgattacaggcataagccactgcacccagccaatattaatttttaaattgacaaatacaaattgtacatatttacagtgtacaacatgaagttttgatacacatatgcattgtggaatgactaaatcaagctaatgaacatattcattgtctcacatgcttatctttttttatggtgagaacacttaaaatttattctcttcatgattttcaattattaaaatgcattgttgttaaccgtaaccagcatgttgtacaataggtctcttgaaataggcctttattgttgttaacttccttcctttaattatgttttgctcataagactttttcacaggtaaatkatgagttcacccattgagttgaaacccttgtcagggaaggtcaggagtgcatatatcacgttttggacctctcccatgacaccagtgaattacaggtgtgcagtttgcaggccctcactatgtcctgctttacacagaggttttcatcctgactttattctgcttcacccatgggtttgctgagctctctttacctaggttgttgaggactagataaatcattgttgatttgactatcaaatggccgtggagagacaaaccttggcttataagaatgtatatgtttgcaagaacttttcttagggaggggcagaggctgagaagaattcaagtttgttgggcagtgtgtggagagaggagtgctatgragctgtcagagcacaatatttacaagcatcagatgttcctgaacattctggagctgtactctatacaagttctgacagtaggataaggcttctttgtttctcttttcaatttctttttggttatcatttaccatataaycactttagaataatttgacacatataagggaaatctgtttctctattaccccttgctctatatcaagtaggattgtgagtgtacaaagtagttaagggaattggaatggagggaggggaacagctttcagtatcttaggtgaaggctcagctttgggtcagggtcagggccgggagtcaggggtgtccctgtttggcctccttacttctgtctctgccttttctgcagaacccagggaaactgggctgttttggactataattatccagtgtttgtgttgggcaggtcccttcccatggcatggagaaaaaacccctcatatctgggctaaatctgcagatgctggaacatttttcttccccttatcagaacctagcctccattaacagggtcagtgtcactctctgaatcactgaatcaaatctgcaatgatggctgatattgtcttttatggatgggctggttgaagaggccagtgtggcaccaacagctctttccacactccttgcccaagaggaagttgtcttctttgggttcacactacagggcagacccagccackggcctcagggcatccttaaagcttttcctaggtagttcctcccagctcaggctctggatgatcctgaggatgtcctcctcactccctatcttctgccccaggcgacsgggtaccatgtcctgtggtttccctgcttcctggggaatgtgctctgtatgggaaaaacagaaaataagaccatttgctgagcatctaagmaaatgtttgagaaagccctcctgcatttttgtgtttcttcattttttttgtgatttgtgaaaacaaaaacaattttaaggagaataaaaaattagaataaataaataaaaaagccattctttaagttacaattatgagaaaattacctctatttttgaaggattctttccrcttttccctaaaatatatagttttccatactgttgcaatcaaagtatgtgtacatttttgaatattcttttttcttcaattcgcactatattgtacttataactagatttggagttgggattcccaagctctgaggcaagcagggagggagcygttggaggccccttgatgtttgcgcctttggagtagsatgattgtgaaagcagtagaaggacttcagaaccaggaaggtcatctcctcctgtacctctcccttaccccaggctctggtaaccaccattctacttatttctatgagtttggcttttaagagtatatgaccgagatcatgcagtatttctctttgtgtgcctggtttatttcacttagcataatgtcctcctggctcatccatgttgttgcaaatgacaacatttcttctttttaaggatggataatagtattccactctgtgtgtgtttgtgtgtgtgtgtgtgtgtgtgtgtatgtatgtgttctttatccattcatccagtgatggacacctaggttgattccatatcttagttattacgaataaacatgggagtgcagatatctctttgacatactgatttcagttcctttaaatatatatccagtagtgggattgcttgatcatatggcaattgtatttttaatttttgggtaaagctccatacttttttcataatttacattgccaccaactatactaatttacattgccatcaacagtgtacaagtgttctcttctctacatcttcactatcagttatcttttattttttgataattgccattctaataggtgatatctcattgttgtttaatttgcatttccatggtgatcagtgatgttgagcattttttcatatacctattggctatttgtattttttgagagaggtctattaggttctttgcccattttaaaattgggttatttgctttcttgctattgarttgacttctttatttgttttgaatattaamyccttattagatgtgtgatttgcaaatattttctcccattctattgrttgtttcttcactctgttgattgtttccttggttgtgcagaagacttttagttagatgcaatcctatttgtctatttttgctttgttgcctgtgtttttgggataatatccaacaattcattgcccagagcaatgtcatggagttttcacctatgttttcttctagtagttttagaatttcaggttttatatttaagtctttagtccattttgagttgatttttgtatatggtgtgagacaagggtctaatttcattcttttgcatgtgaacatccagttttcccaacaycatctattgaatagactgtccttgccctattgtgtgtccttggcagccttgtcaaaaatcaatttggrcatctattttgtgtggagagaagtggcgcagggaaaggatacatgttagctcatggccatggatattggttagtggctatcactcacaacagctggggaatgggtrcatcacctgcttaagaggtcctgggaagggcatcaacaatgtctactaaaatccattccttgcactgttcagattcacttgtttctggccttcaggtgggtagtttttattttctcatccacattggtgttacctcctcaaccccctcctttactcactctaatagatgacatttacmtacataattaggtccactgttgacaatatacctttgctcagaatgatctaattatcagcagaacaaaggtgagcttgtttatggaragtcccaactacatctctgggtaaggaccagtgcacctggtccagtttatacaccactccagcttccctggattccacttgcattgactgcttgctttgcttttaggttggagtggctctggtgacaactcactctgttctcatggtcacaaatccctgctcactgctgccactgctgctgccaccacagaccaagagctccacttgcacagtgctgctggctaagaagaagttgctgtacctgagcactggaccacatggactcacagagactcccaaccargtaaaggggtgatatggcttgtggatgtcaaccatattctcttcttgatcacctcgctgctggaayaatgggccatggtcagagtagagtggtcatggaggttgaatagatgccatgaatgggtccaagaacatggacactctctttcaccaaaatcaattcgggtcttgccactgttaatcacctaacttgcyaacagcagagactaycgctgagtctttgagatggcactgctcttggagagatcaggcagccatccagtgagaggttgacccctctgctttggaggggatggacattcatccttatcaccattgatacttgctctagacatgagttttccttctctgcctgaaattcctctgccactaccaccatatgagggcttacagatttcccaatccatcaacctgcttctcacacacattagctcagagtaaaggactcattttatggcaaagaatgtaaaatgatgggctcattggtcttattatataccatgccacccagaagcagtcaacctagtggaatgatgagctggcctgttgaaagctcagctaaggtgccagctcagagatgacaccctgtagggttggaagttggagcactgctttccaggatgtgatacatatgctgaatcaataccaatctatggttcagtgtccccacataactagaatatatgagtccaggaaccaagggatagaagtagaattgatccctttagttatcactcccagggacttacttgtggaatttgtatcttactgttcctgcaaacttaaattctgccagtttagaggtctaagtttccaggaagtaaatgctttctccagtggaggtgggaaaggctccagtgaactggaagttgtgactatcactcagctgtttggggctcctcataacagtggaccagcaggcaaaggaaagagttgccttatggctagaataattggccttgattaccatgagaagctagggttgctgcaatgcaatgggagaagataagagtatgactgcaacccacgggatttgctggaagtatcccccatacttttgtgctcactgatgattgtaaatgggcagttacaacaacccaaacctaacaaatgcaaagcaactaacaactcagtcccctcggggtagaggtctgggtcactccatcagactacagcacagacttactgaactgctagatggttgttggggggcacctagagtgggtggtggaagtgagatgcaaaatatcaattaggactctgggatcagctgtggcagtggagattttcaggagattgcaattggccattgacaccaattgccaggaaagactgctcactaacctgagggaacctgtagggcttagcttctctggtagcttcctgaatgggctgagtgacgcgacctggaaatggaaggatgctttgttcccatgcagaaaaccctgagcaatggaattctgaagatggttatatgtgcttatccactggtggagccatgagtggtgctgcgtcctcaatagttagaatacatggatggggcttggagccagcataaagacaaaatcagaatagctattaatcccatcctgtagagataacccccataattattttgatgtaattacttccaattttttcctgtgcatatataaaatatatagctacaaaagtgagattctactataggaagattttcatattgctttgtaaaagcattacattatattgaatatattgaattttcttgaatttttccatactaaatgtttttaacacaaattttcatgaattcagaatattcaatcatacaagtttatcatagaagcttttctccatgtctgggattccagatttttgttattgaaaatgctgagattcaaactatcataaggacaaaaaaccaaacaccgcatgttctcactcataggtgggaattgaacaatgagaacacatggacacaggaaggggaacatcacacaccagggcctgttgtggggttggggggggggagggataccattaggagatatacctaatgttaaatgaagagttaatgggtgcagcacaccaacatggcacatgtatacgtatgtaacaaacctgcacgttgtgcacatgtaccctaatacttaaagtatgataaaaaaaaaagataaccaagaaaagaatgttgaatttatagacagcaattgtcctttttgtagaaaaatattgagctcctgtatttcaggttaaaatgcatgtcaatttttcagatgaagtaactgaacatatcaagtagtatctttaagtcatatagctggtagaagacttgaaactagaaaccagagctgaaatgaagtcaaaaattctcactttggtatggtttcatgtttctgaaaaaaaaaatcaagtcatacagtgcattaaaaaatttttctgatatctaagactatgatagaaatttcatatgtatatatgtgtgtgtgtataataaatcacttttttaatacctttgatatattaaatgcaaagcagaaattatttggaagatgaaatatataggaataaattataaaaagtaaaaaacataaataaaaatgctgagattaaaatttttatgcatgaatctttttgtgtgtctttgattctttcttaaagataaactcccagcaatagttcacttggccaaaggtgttcagcacaccctcagaaatgatgggtgttgccagcctcaggctctggctgtcctgtccctttcctgccctgttttctctcctccagtcagtctcccatgacaagggtttgtgttgagcaagctctaggttttggtcttcctgctggtttgggtgaagccatttgtggatgggtgttgctcatgcagaccttgtagtgctgtctctcctctaatctgctctcagtatctgtttggtaacaatgagtgagtgggaggcagtcttctctgcatatcagatgaaagcttcacagagggaagatcttttcttatcgatgtgggctatgaggagggccctgtgtggcatcagctgccttctttatatcatgtatctaaaccatggtcttcaacgaaagagagccagtggtcttcaacgaaagacagtgatctttctttcctcctccctccctcgcctggggacatttagcaatgcctggagacattttggttgtcacaactttgcggtggagaagggggtgttgcttctggcatctagtaggaagaggccagggatgctgtaaacatcttatatcttgcttataattcaaaatgttcttagtgcttctgaatattactaaagataaatcagaattggtatagggttgatgattaaggcaaagaaggatttggtgtcttttcttaagctggaaatatggatcctgcctttccagggaaaatctcttctttttcctcatttttttttcttcattaattcctctctatttctctctctctctctctctctccctccccccccatacacacacacacacacacacacacacacacacacacacaccccttccaaatccttgggtgcttgggctgggaatcaggtcactatgtgcagggagaagagagcagcagagaggggacacacactcacgactagaagctgtgtcttcactgaggtttattgagagttctgtgacctgtaggatacttctggaggcttagggttgtggctgagggaccaagggtagaccagaatgagtggcacacactttgctgctcaggtccagttccagcttccctttcaggctggctcaggatccaggattaatttgcctgcaggatctggttgatccagggccggtaatgggagattcgggtgaagacagcagggggctttgcatccgaccgtccataggatacgatgccctgggccaccccagcacacagaagagggcccccagagtctccctgtagggggaggagagagagaagaaggtgagcccgggaagtcctccactcctgtctgccagccagcttggagtcacagtgagacctaaagtcagacccaggaggtggagctcctcacttatacatctagttctgatgccccttcttcctttcttgggaccgtcatccacattctccacatcaccccatgcccccagtgcagtagactggaatggatggtcagaggctgtcttggaccacgggaggacagcaattcctgtgatgctcaccctgtcactgactgacaaccttctgaccccatctccttctaagagcattctggtccctgaacagtgagttttggagaggaaacctagttggaggatcaccttaaatgcagattttgtcttcctgggattgcccacacacagctgaagattgtggtcaaagtctctgaagtggctgcaggcctggggatccatgagtctcagcttcacctcttgcagagtgtctgagcccggcttcaacacacctgttcttccccagccagccacccggcacattctcccaggtgggacaaagttgaattgtgatgggaaggggagtgtccccacagccagggtcaggctggctttctccttcaactgtgaagggaatgaaggactgtcagtcctcgaaatgggctctggacagttggaggtgatcagggagggacagggtgagtagcttcatgttatagccaagtcctaagaaaaattcagggcaatgaggacctgaaggagaagcttaggagaatgggaagtggaaagggagaagagaggtgttgtcacctttagtaacatgatatcgtggtgaagagtagaagtgttatattttggatgacggaattgctttataacctcaagcttctgccatgtgtcttcttcctctgttatgttatgggctccaagggtgactgttatagacctgttgtgaggaagaaggaaggaaaaggagcgacagtgatggcttggggtttcttctgaggtgagctcattctgagaaaagaggactaaactctgtcactgggtcgccggactctacccatctcccttttcatgggccacttgtggcatttgagggctcaggcttaactcatgaaagagctttctcaggaaacagacacaatttctacgacccctggaattgctggggactgaacaggccagggaggactcaggggacagggttcacacttcctaattcagggaaccctgcatgagggccagcccctgaagcaggagatatcagttaaacgggaaagtgggggtctcatgtagaccctgttctctgcctcccataaaatgatgggttcaggaccctgagaactagaggccagtgttcttgaaaaggccatagaggaagtggccctgagactgggtggggccctgaaaagtgagccgtgtgtcttgagttgggtaggggtgaggggtgctactgcaacaagagggaccttggacaggacctccttttcctccgaaggggagcttagctcacagtgactgaggctcaaggaactattcaaacacagactaaagtctttcagcccaagtcttccctctcctgaaagttgacaagacccaggaccccctcttcagtccccagtgcaggtgtattcctggatgctactctggttgttcatctcccatttggagataaatagaccctgttgtctcaccttcctgcacaatgagcagccgtcagcacaaagttccgtcttataaggaaaccaccacaaaattttgagggaccgttggaagttacaatttccaggtaggccatgtaggggcgggaatgtggcttgcattctgtgcccccgatgatctcccctggaacagagcaccccagggtttgaacacggccatagatactctctccaatgaatggacaaattgggttaaagctgagctaggcttccctggaatctcattctcaccctgtgttccgcccatcttccctctcctgtctcctgtatttcgtatctttccccacccataacctcccaggtgaaatctcattcttgcctctgctccattctgatgttttcatctcagacttctcccactcccaccttgccctggcccaccctcctctgtctctgtgtaggacccactgtccaggttcctgttttagatttctccatagctcttgagcatggtcacagagtgagaaagtcacaaagtaatgggtagccctgatgctcagaagattaagaggacatgtctgttttcctggggataccccttttccttccacttgctctgggcttttctacaattgaggtgaaattccttgttcctgggggctgtcctaggctgtagagaatggcagtgggtgggggtgggggtggggtggcacacatcccaagtggaaatttccctctgggactcttgaagagagatcttggaaccctgtttaggagtcagctattttcagactaaacatctttgtttcaggagctgatactgcagatttcagagggaagaaccctgatactcaccagcttcagctctggagcacaaga

SEQ ID NO: 12511 - DNA, 14292 bp, Homo sapiens
atttcctttaagtttcaaaaggcaaactctaagctttcagtaacacctaaagcgaaagaggttctcaatgaagggaaactttctgactattggtgttgacagaacatttaagctcttgggagatcatgatatgaaaattatttaaaagacaagacaaatttttctcattgcccagattcctgggacttgccattgcttcaagcattgtaacaaatgtgttccctctgtcataggagagccttgttcttttgatgtggctatcattgctggtcgccttcggatgttgggtgaccagttcaacggagaattggaagcttctgccaaaaacgtcattgcagaaaccattaagggacaggtcaagtttctacttcatgctattgtttgctgcttttttttctatttcaaacttccttttcttactactcccatactacagtgactaggaatgttctatgaaaatatttgggtgcttatatttcaaggaagtatagcaagaattctccaattgctaaaacctaagtggtacagagatggaaaattttgggcataggctgatgaaccttcagtttgtctctacttggtcttcatcacagctgttgtgcttagtgtgcacagagcacatttataacactttattcttggcaaagtatagtatctttttttttttttttttttcagacagggtcttactgtgtcacccaggctcaagtgcagtggtgtgatctcagctcactgcagcctccacctcctgggctcaagcgatcctcccactgcagcctcctgagtagctgggacttcaggcaagtgctaccatgcccatctattttttttatttttttatttttagtaaagatgggtttttgccatgttgcccgggctggtcttgaatgcctaagctcaggtgatccactcacctcggcctcccaaagtgctgggattataggcgtgagctaccacacccagcctatgctttttttttttgagatggagtctcactctgtcacacccaggctggagtgcagtggcgcgatctcggctcactgcaacctccacccaccgggttcaagcaattctcctgcctcagcctcccaagtacctgggactacaggggtgagccaccgcgcctggcccatctgggcggatcacctgaggtcaggagttccagaccagcatggccaaaatggtgaaaccccgtctctacctaaaaatacaaaaattagccgggcggatcacttgatgtgaggagttcaacaccagcctggccaacatggagaatccctgtctctaccaaaaatacaaaacttagctgggtgtgatggcccatgcctgtaatcccagctacttgagagactgaggcaggagaatcgcttgaacccgggaggtggaggttgcagcgagccaagatcacaccactgttctccagcctgggcgacagagcaagactctgtctcaaaaaaagaaccaccctcttaaccgttatgctttattcgtcctactatacacagcttgggcagtgtgcctacactatgttcaggcagagctggacctgttactcccagttgcttgccctgaggctgtcctaggtagttgatagctgagttgactttttttctcattaaacatatttttttttttggctgggtgctgtggctcatgcctgtaatcccagcactttgggaggccgagaggggcggactgcttgaggccaggagtttgagaccagcctggccaacatagtgaaaccccatctctactaataatacaaaaattagttgggcatggtggcacacacctgtaatcccagctactcgggaggctgaggtaggagaattgcttgaacccaggaggcagaaggaggttgcagtgaactgagatctcgccactgcactccaacctgggcaacagagcgagaccctctctcaaaataaataaataaatacaaatacaaaaattagccaggcatggtggcacacaactgtaatcctagctacctgggaggctgagacaggagaattgcttgacagggagggggagtttgcagtgagccgagatggtgccattgtactccaatctgggcgacagagcaagactctgtctccaaaaaaaaaacataaataaataaataaataatttgacttgaacttgttttaataaaaaaaaatatattttgaaacagccctaaactcagggaaaggttgcaaggatagtacaaataatttctctcttgaatcatttgacagtaaggagttgacatatttcatcaacccctaatacttttatacttccctcaaacaagaacattctgtaatgtaaccacaatctaaccatcaaaaccaggaaattaacattgattcattatcatctaatccttagatctcattcaagttttgccatttgtcccgataatgtaatttatagtaaaaagttgtaggccagaatcacatactgcatttagttgtgatttctctttagtttccttcaatctggaatttttccttagtctttccttgattttcatgaccttgacacttgaagactatggtctatcttgttgaatgtcccttaactggggtttgcttgatgtttcttcttgaataaattaaggatatatacctttggcaggaatatcacagaagtattgctgtgttctcagtgcattgcatcaattggcacaagatttcattttataccagtattgatgttgttaactttaatcacttaagatggtgtctgtaaagcttctcctctataaagttactcttttcccctttgtaattaataagtgttttatggagaggtactttgaaactatgtaaatatcccacatctcatcaaaatttcattgcattcatttcttatcagcattggacccatgaattcctactttattctgtggattataatctgttaacatcattattaatttagatgctcaaatcatcctagttttagctagtgggagtcctttcactctagactgcatctctttgatgtgtctctattattatttgagtacttccttaatttctgacagaatatcttatacttccctagccccaaactgaaatcaaccattctccagagagctctggtttcttttattttttgagacggggtctcactctgttgtccaggctggagtgcagtggcacgatctccgctcactgcaacccctgcctctcggattcaagcaattcttctgcctcagcctcctgagtagctgggactacaggcacacactgccacgcctggctaattttttttttttttttgtattttagtagagacggggttttaccatgttgctcaggctggtcgcgaactcctgagctcaggcaatccgcccaccttggcctcccaaagtgctaggattacaggtgtgagccaccgcccgcctttttttttttttgagacggagtcttgcgctgtcgcccaggcaggagagcaatggcgcaatctcggctctcttcaacctctgcctccccggttcacctgattctcctgcctcagcctcctgagtagctgggattacaggtgcataccaccacacccagctaattttttgtatttttagtagagacggggtttcactatgttggccagactggtcttgaactcctgacctcgtgatctgcctgctttggcctcccaaagtactgggattacaggcctgagccactgcgcccggcctctggtttcttttaatggagaatgatatttagaaatcaagatctaggtgctctcccacatggatgtccttttcagcttgtttgggctctgatattcagctctgaccacccttggcccccctaaatccccacagatcttgcttggacccacctaatggattttagattccatttttgaaaaagaaagaggaaaaggaagagctactcaattattttaatgaattattattattttattattaattctaattaactactatttttgagacagtctttctctgttgcctaggctggagtgtagtggctcaatgatagctcactctagcctcaatctcataggcttaagtgatcctcccacctcagcctcataagtagttgggactacaggcatgtgctaccatgcctagctactttttaaaatttttcatagagacagggtctcaatatgttgcccaggctagtcttgaactcctgacctcatgtgatcctcccactttcgcctcccaaagtgttgggattacgggtgtgaaccactgcattcggtcttttttttatttgagatggagtctcgctctgtcgcccaggctggagtgcagtggcgtgatctcggctcacttcaaccttcgcctcccaggttcaagtgatgctgctgcctcagcctcctgagtagctgggattacaggcctgtaccaccatgcctggctaatttttgtatttttagtagagacagggtttcagcatgttggccaggctggtcttgaactcctgacctcaggtgatctcccagtctcagcctcccaaagtgctgggattacaggcatgagccactgcccccggcctttactttagagtctcccagacatttcctagtcattcaagcaatacctttacaatttaaccagctggactatcacatacttaatatttttctttcaaatcatttttcattcattttgtttaacctaagcaataatacctgaagtcatgggtttgatggactacttatgtattttcaagtgcccattaagataacaaaatattaaaatgagaaaagattattcatctactctctaagatttccttagttaccaccagttgcacatttggcactctaagaaacaattgctttactggattcctgcacctgcagcctcctgcactttttgagtgatactctgttgatgtttcctttgtctttcctcagacaggagctatactccagaacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggtaagtttgttggggctcctggttttgctaggtatttgcactgtttttgtactaatacctgggattccaattcatgaccctttttgtaaattggaaaccaacaggaaaacaggcttccctattttgctgaaaatgcctagattttcttgccatggaaaaatggagcagacagaagctcagcctgtggatgttggactcgagtcatgctaccttaaatattgactgctgactactgtaaagctaatcttcatttcctacacataatcatctataaagtatattcatgatagagttctaatttcagcctggcttcactccgttcctttgtaaatttctgggtctttttttcctaacttctctatgtgtgtgttagggaagtcagaatcaccttaatagtatctaagaaaaaacagtctttgctgtagtggtaactatataaggtattctaagcccatgttttagtaatcatcagaacttatgctgtcatagagcactcctttccatttacagggtcagtgaaagccttaataagagctacatttcctggagctatctgcagatcatttcctggtttcttaggaagttcctgaaagcaattcctttgactgtaggattttctctgtcttccctaggaaaatctggagagctgaagagttggagctattcacgagactgaacatcacttccttgttgactgattgggtgattgattcctgggaattcaaacaaacaaataaaaaagcacttttttcattttatcagaactgaacttagctgaataagttattttttactgattgttaaagttgggagcagctgccagaggcctgcagagttggtttttgttttttttgttttgtcaacttaatgcaaaccacagagattttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggtaagaattgtgcctactaattttgcaatttaaaggatttcaggaagctttttggttgaaaaatcttgtttttttttttttagacgtagtctcactctgtcacccaggctggagtgcagtggtgcgatctcagctcactgcaagctccacctcccggtttcactccattctcctgcctcagcctcctgagtagctgggactacaggagcccgccatcacgcccggctaattttttgtatttttagtagagatgaggtttcgccgtgttagccaggatggtctggatctcctgacctcgtgattcgcccgccttggcctcccaaagtgctgggattacaggcgtgagccaccwcgcccggcctaaaatcttgttattttaagttgagcattttcattcaaaatcatccctaaacttcatgttaatttcacctgagaaggactattttatgcattttagaggttggaagcaaaaaacaaacaaacaaamaaaaacagttgtttctactaggaaggtcaaagaaaataaaagttactccatttttactgccacaggatgcaggaagtgctggcccacatctaggacagcaaggccaccccagcttagatgaagctagctgcataacacaaagctttaaaagtgtggttcacacaccacttgtggaccttattgaattgctgattcgcattcctagagattctgattctgtaggggtaggctggagcctaggaacctaccttttaaactagttccataggtgattctgatgtacatatagagtgtgacagccatcactatagagaatagattgataaattacaacccacgcgtcaaatctggcttgctgtcttattttgtaaataaagttttattggaatagagcaacattcacttgtttacatattgtccatggccgcttttgtgctacaatggcagagttgaatgattatagaagaccatatggctggttaagtccaaaatatttactagctggccctttacagaaaaagttggctgaccccttctctaaatcaacatttctccttggtaactgaaactctattacagtcctgacaattccagcaaacacagctgtagatagggtttaaactcaaagatatttaactcttctttgggaacttagtctccatatgtttgttagttcttgcataatccacagtttctctgggtcttcagccaatcagagagctctgtagctcctgagtagtccatttctctggccctacaagtgagagtgattggaagcaaagcttatgatttgtatgatcttgtatctcaaaatagtccttaatgatctaatagattagtaggcagtcatcaggtagagactccaaaaaccagactactttcctaaatatcaagaagaaaggcattgctacagtgattcatgaaaagcagcattaataactttggctaaagtttaacaaagctaaccacttcccctctatcagccagccatctatgtatctcctctaaatgcagagaagtaaatatgtagtgctgttaatacatttttgctttttaaagttatgctttgtcctggcgcagtggctcatgcctgtaatcccagcactttgggaggccaaggcgggtggatcacctgaggttaggagtttgagaccagcctggccaacatggtgaaaccctgtctctgctaaaaatacaaaaaattagccaggcttggtggcacgtgcctgtaatgccagctactcaggaggctgaggcaggagaatcacttgaacctgggaggcggaggttgctgtgagctgagttcgcgccattgcactccagcctgggctacaaaagcgaaactgtctaaaaaaaaaaaaagaaaataaataaagttatgctttttcctctattcctagttaaatcacaacaagttagtaatccataaatgatgtgtcctgtttctctttagtagaaattatatttttggctaccagttaagaaacttgtactcctttgtcccttatgttactataaactcaagatratgagttttgtggtatttgacttcataggcaaaatcaaaatttttactttgttgctattctgttttatgaaataaacttctgtctatgcatttgaactaagtttcagcaaattcaatctaaattgaataattccagctcccagttttatcctatgttgctcataaaacagttccaagtatactgcattatcttgagatttgaagatatggtgcccacggggattatactaggcaaatgcgttaagcagctctggcctaggtgttgtgtattttaagagactctatcttaggagagcttaagtgattgggctgcaggaagaagacattgtaacccaggaattaaaaatggattcagattgcctgattttaacactttagtttcaccataggctaattatgtgacattgggcaagagacataattcttctgtaccttagtttctacatttgtaaaatagagatgatttggtaacttattaataagatttttgtgagagataaataaaacaaatacattttgtaaagggtgagtacttggaatattttaaacactgtgccattagcaatttggaattctgtgttatgcagttcataaggttctagcttgacttttttctctctccattaaccctgtctctcacagatgcaaaccactcttaatggctttactttcacatcaatgtgagtgattcctaaatatgatttatttcccttctcaattccatacccacagatgcttattatttatttatgtgtacctttcttatccccatactctccctgtttgcgatacaactagctcaaaacctcagtcatttttaccttgtctctctctctccagtccaactcacccaactagtttttctcatttgttacttcatttttgtcctggttcttctaccagatttattagcaactgcctggactattaataaagcctcctacttaggctttcaatagattgttctgttcctgctccattccagtctgtcctatatactgccatcagattgatcaaagctgtggtttctttgtctattattttgattcatttttagatatggtatcattcatttttaaatttaacataccaatgaagattacaagacttaaacatcttatcagaagggggcatttattttttaaatcaagaaataactttccaaaagcattgctttgaatgccattctcttaaagtccttcagtggaacttttgagtgtgattagacatgttcattatcttgattgtagtgattttatgggtgatgatttcacaccaacttatcaaactgcatactttgaaatgtgtagtttattgtacatcagcactaccttaataaggttgtttttttttaaaaaaaaaaaaaaaccttcagctgctccctactgttcatcaaataacagtctgatattcaaattcccccagtatctggccctaactgccctatatagccttaatcaatcatgattctcctctacaatcccaatgctctagtataaccgagccagtcactaaagctgccctcctcctactgttccctatgtttcatattgctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttaagttgtaattatctgtatagtcatcttccccactaggataaaggattgctgaatgatacaatttgttgtatacttctgtaacacccctcctcttcattatctggcatgtacatcgatattaaaaatattcattaaatgaatgaatagctgattgactcagatgagacttcaagtttgattatatttgaaaaggatgctaagctttaagagtcctgatgctctttattttaaaaaaaaaatgcttcaggctgggctcggtggctcacgcctgtaatctcagcacttttgggaggccaaggcgggtggatcacctgaggtcaggagttcaagaccagcttggccaacatggtgaaaccccatctctactaataatacaaaaattagctgggcgtggtggcacatgcctgtcatcccagccactcaggaggctgacgcagaagaattgcttgaacccaggaggcggaggttgcagtgagccgagatagcaccattgcacaccagcctgggtgacaacagcaaaactctgtctccaaaaaaaaaaaaaaaacttcaattgcaagttattggttgacctttgcttcttgaggattttgaaaccaaaggcagagtatgcttccctgtgtagtgggaggttgactatgaagtctgcagcaggtgaactgaaggacttagtgaagtctcagaatgctgtagtgacaagcagtagattgaaagatgggtagggggacttttcctacccgggatgatgtgaaaacatgagaaaatcaaacaagcttcgttaaaggtattttataagcctcttctgtgttcatttataaaaggaaaaacaagcctactctagagataaaggaggtcatttatttctggccattgcagttcttcagagatggactctgaagctcagtattgacaccattcctttcataataatagccctgctgcttgggcagcagcattcaggaaagtaccctttgccaggttcctgtgcctccatgtaggaaggcccatctgctcctggcataatgaaagtgcctagctagagacaagaagcacagactgtgccagacaagagacttggagtaattgatataatgagtaaccaagtgagagtagatccctcaccaaagcgtaaccacattagctactttatcacaacagacttatttttaggtatactcaagaccatgttaagcactgtgggttatacaaacgcatagaatacactatcattgcctttgataaatctgaaaatacaggggacatcttttgaataaactcttaaataaacttataggagacaaggaaattgaataaatgaaaacttctatagctgaatatacagatttatattgaagagattcagactaagggaagatcatggcgaaacagaggtaggggcaagatttttgaagaaaaattgagctttatggttttattttcattgtggtgaaacttaggggtaaaggtgagaagtagaaaaaagtggtagtagaacgaacgaggtctgtaggtgatgtgcttggataggttgggtggggatagttgacagggaggggcttggtgacaagctaaggaatctggacttgttcccgtagatcatcaataactattctgattctttagcattaaagtgcagttttaagaactttcatccagccttggttaacaggagatactagaatggaaacatatagataggaagatactctaagtttattgctataggaatccgggtgtgaaagtgggaatggggctaagtgggaatggaaaagacaggttgaatctaaaagacattgaggagaaatttccaataggccttggtgatcaaaagaatgcttacaaaggactgaatgtttcacagacagtatatatatcccatatcaaatcaatgaccctggaatgtagggaaaggcaagagtagtgaaactaaagctaaggttgggtaagtatcttctccagggtaaaacatgtctccccctcatctaaaagacagaaggatgttctgagaatcctgaatgtttttcctattgaatagtttatcttacccttgtagtcttccctgaaattctcctcaattaatgtttattgtaatctaattcctgacctctgtgatactgatatttccccttaaactagcatactcccctcttcttggaacacgtgacatggtgaccagcactcttctctgttgtgttcttccttctgaccaagcactacagccacatgaggcagcagtgagatgtggccttgtcactcctcttcaggtgcttatccacaatttacttcccacaatttacttgatggttctggcaaaatgtttgtgagtctttttttattgcatggaattgtgttcacttaggttttatgccagactggtttaaatgattcatcataaattctgaaactcttttaggtatttgccaacctttactgcatgtcttgtttcccctccccagctctttatcttcccgcaagatacaaatgagtcaacacaatcttcatcaaaaagcattgtgctctgtagaaggaagtgtgataaattaagtagtagcttatttttttaaaaaaaaaataatagctccagctacttggaagtctgaagtggaaggatcacttgagcccaggagttccagactagtctgggtaacatagcaagaccctgtctcaaaacaaaacaaacaaacaaacaaaaaaacccaaaacaaaaaaaataattaaagttttttgttttcttcttcagtttgttttttgcttgcttgagtggtctgctcaggaaatggccttgtagctaagtgggttttgggggtttggttatttcacaatgtctctataccttttgggtttacagtagaatagattgctgcttgcttttttaaaaaagtgtgaagttctgccaagacactatttacagattcttagattttgaggaaagggactatggaggcatctaagcaaaattttttttgttatctcctatttatttctgtcttctccctcattaagaagaaacaagaaagttagtaagagattgtgctgaaatataggcttgagaaaaatagatttaaattttattaggcaggtttgcctcatcaattaataaaaattaataaagttctagttttgtgtaattgaggacattctaagggtacagagaaattataaaactatattatcttctttgtccaaacatagaaaatcattttccttttaggattatgctttgctactctgcaattaagcaagttagtttggaatgtttttatttttattttctttcccaaagttacctaaggagtgttttaatttttatcagtaatcatgtctgtatctttagttctgagttgctttattaactggctaaggatgtttttgttttgttttgttttgtttttaccatattctggctttctcagtgttgtatgccaatctcctaagacaatgtttagaatttagtgggtactcaataaatttgttgaacaacttaatggatttttaaatgtttatttctaattttaaaaacggtatgataattttagaaagcaaactttatcataattctaaaattatgataattttagaaagcaaacttacacaattgattcttttttgcttcttttagtctttaactatgtacacacttttacatggttttagttattacaaacttgaaattttgtatttttataaatcaaagatttcccatattttatgttttaaaatagccaaagtaaacatcacgttacttagagcagcaagaaattctctcttaattctagatggggataatttaagaaatatactattcctaacaaatattgctgaagaatgagggtttattttaatttatgtatactgggattgagtttcttaatttgaaatattgtctttaagttgtctataaccaagatatctcgatgatctttcttttttttttgcagtacttagtaaagagcatgcagtatctttaatgttcagattaagcagtgttcagaatcatgatatcctgaaggaagtttgaataatgttgcaaaacagaaaggattgctaatatcttaaatagaggaagtcctaacaacacatttcccagttttcttcaggatcaagactaattttgttaacatttgttgaacttctgccttcaataaagatgatatactgatttttggatgttctcacactgaattaggcacttgggtagacttgtacccattgagaggttatgcaagctgaaatgtggaaagtttttctagaagagcctgcctttcagggccaaaatgccacaggcacagcataacttcctgaaacaaatttatttcctaagacattggttgcagagtagaaatgtgttctttagaaacagttcttcaggctttctgc

SEQ ID NO: 12512 - DNA, 15411 bp, Homo sapiens
cccaaagtgctaggattacaggtgtgagcaccaggcctggcccgatcttgttatttaatttgttaataaagaagcacttgtattactacatcacacatctaaaatattttgaaaattgcatttcagtaggtttcctttgtaaacctatgtatttggctaagtgcagtggctcacacccataatcccagcacttgggaggccgaggcaggaaaattgcttgaggccaggagttcggagagcagcttgggcaacatagtgagaccctgtttctacaaaattgataagagaccccgtcttttaaaaaataactgggtgtggtggcaagcccctgtagtccctgctacctgggaggctgaggtgggaggatcacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtgagagggtccatggcacacagagtttgagagctgctgccccagtgggtcctgatacacagttcatgaaacgctaccccatgctgaaagctcttggggggcagagctccggagtcttgaacctcgagcccagcatggaaatcacatcggtggccaatgtttccatagcacatatggtgccagcctctgtacgaggcccttcacatggattatttcttttaatctttacaccaactcttgtgtgaggggtactattcttagccccatgtctctgtctctttaccctacttcatttttcttcttagcaccagaagtgtcatatatttttatctgtttattggcagcctcccccactgggatgtgtgtctcttgaaggcaggaatttgctttgctgagtgcttcatctccaaaatatcaaaatatgcaagacttaagggggtaccaaaaactcaggaatcatgccatgtcacatatcatgttcacacacacacccacaacctcagaaatcgaaataaggaacattttactgcctttttttttctgggacagggtctcgatctgtcacccatgctgaagtgcagtggtgtgatcatggctcactgcagccttgaactcctaggctcaaaagatcctcttgcctcagcctcccaagtagctgagactacaggcacacgccaccacacctggctaatttttttttttgagacaacagtctcactctttcaccaggctggagtacagtggcgcgatctcagctcactgcaacctctgcctcctgggttcaagcgattctcctgcctcagcctcccgagtagctgggactacaggcgtgcaccactacgtccagctaatttttgtgtttttagtagagatggggtttcaccatgttggtcaggatggccgcaatctcttgacctcgtgatctgcccacctcggcctcccaaagtgctggaattacaggcgtgagacactgcgcccagcctaatttttgtatttcttatagagatgggatttcaccacgttgcccaggctggtcttggcaactcctgggctcaagtgatccccttgctttggcctccaaagtgttgggattataggcatgagccactgtaccctgtctgtaatatttaaaaaaataaaaaataatgccccaaacccataaacaaaatatcaacatttcaagtaaagataggatccaacctcctgcatgtgtacattactgcctggatctccttatcctgttactggtcctgaggggcttaaaacctaacggttgctaaagtgaattagtctcattttgcagatggggacattgaagcaaggatgctaaagaccccctcggtgccaatagccagtaagtggagcagttaggattttgaactcaggcaattgagttccagccccatctttcttaaaccctgcacagccagcctcatgaattatcatgcttgatctttttggtagaggcagtaaactggtaaaatcagataggtttgagttaaaaccccagttttggctgggtgcagtggctcacgcctgtaatcccagcactttgggaggccaaggtgggcagatcacttgaggtcaggagtttgagattagcctggccaacatggcgaaatcccatctctactaaaagtacaaaaattagctgggcatgatggcgcatgcctgtaatcccagctactgaggcaggagaattgcttgaatccgggaggcggagattgcagtgagccgagatcacaccactgcactccagcttgggcaacagagcgggactctgtctcaaaaaaaaaaaaaaaaaaaaattcaattttgccccttcctagctgggtgatcttgggccagtcatctcaatgctctgtacacagattaaagagggcagaggggactggaaggggatcagaatgtggctacttcattaggtgggtccactgtgggtgtgtctgagaaagagtggggagaccgggatgttagagcaggcacccttgggtgagagctgtgggagatgaaatagagaagcatgcaggagccagtggatgtaagtatttgcagaccaagccagggactttggactttatttaacacgtaacagaaagcctttggaaggttttgatggcaaagtgacatgatcagactgacagcttgacaggacccctctggccattatgttgagaagaacctgaaagatcaagggcagaaatagggaagctggtctggacgtggtacaatatgaaggcaataaacaatggtggcctggccccaagctgcagcagtggaggagcaagaaatgcagatcccagatctattttgaaggcagagcccagaggaacggctgacaagccattcatttcagcactgtttgttatagcaaaagttgaaagcaacttgaacgttcaggagtaggagactggcaattaccatgtataatagaacacaacataggcttatgaaagaatgaggaggctcttcgtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatacgtgagaaactggcggcctctagggacagggggacaggggtccaggggtataagggaaatttcacttttcattgcatcttttggatttgagattttgtgcctcttctcaactggaggtgatgtcccccaggggacatctagcaatttctggagacatttttggttgttgcaactggggggaggtattactggcatctggtgagtagaggtcagagatgttgctaaacaccctgcagtgcccagggcagaccccacaacagagcaagagctggccctaaatgtcagtagtgctgaatttgagaaggtttgatctattaaaaaacataataaggctgggtgtgttggctcatgcctgtaatcccagcactttgggagagcaaggcgggtggatcacctgaggccgggagtttgagaccagcctggccaacatggtgaaaccccctctctaccaaaaatacaaaaattagccaggtgtggtggcgggtgcttgtaatcccagctacaggaggcaggagaattgcttgaacctgggagacagagattgcagtgagccgagaccgtgccactgcactccagcctgggcgacagagcaaaactcagtctcaagaaagaaagaagaaagaaagaaagagagagagagagcaagagagagagagagagaaagagagagagagagaaagagagaaagaaagaaagaatagaagttttttttttttcaggatggtctttattctgaggttgtatattttatgggtttgatatatcctttgttttactaagataatatatagtacatgatagtcattttttccacatctttacttggcaaaataaaatgtcagcaagccttatacacttctctaagctgaataaaaaattatccgggcatggtggtaggtacttgtagtcccagctacttggaaggctgaggcaaaagggtggcttgtgtccaggatttcgaggctgcagtgagctaagactgcaccactgttccccagcctgggtgtcagagtgagaccacatctctagacaaataagaataatttttttttttttactgggctatgaaatcctaaagtctggaaactacccttttcactcaatgggcttttgaaaggtaatgattttaaaatatgtccacaaaatatttgatcctttttccccaagaggtagaattacctctctctaagtgtgaaccagatttggtgactcactgctaacaaatagaatttggtgcgagtgatggtttctgatttctgagactaggccacaagacgcattgtgcctttctccttacccctctctcttggaccactgcccctgggggatgccagcttccatgctgtgaggatattcaagagccctatggagaagtccacatggtgagcaactgaggcctcctgccaacagccagtaaggaactgaggcctcctcagccaacttagaggcaggtcttccatcccagtcaagcagaggactgcagctggtgtcttgattgcaaccttgtgagagacccctagccagaaccactcagctaaagatgctcctgaattcctgacccacaaaaaccatgagataataaatggttcaacttgctagagtttggggggtaatttgttacacagcagtagataaatacagaaggctgggcacagtggctcatgcctgtaatctctgtactttgagaggctgaggtgggtgtatcacttgaggccaggagttcaagaccagcctggccaacatggcaaaaccctgtctctattaaaaaatacaaaaaattagccaggtgtggtggcacatgcctgtaatcctagctactctggaggctgagtcacgagaattgcttgaactcggcaggtggaggctgcagcgagcagagattgtgccactgcactccatcctgggcaacagagtgagactatgtttcaaaaacaacaacaaaaaacctcccaaaaacaaatatagaaatctttgagccctatcagtaaggcagagatcacagaaaggtagcctatgggctctggtctgcctacagatatatttcctttggccagtacaggactacaaaaaatggaattaatcactaatgtttatttatttttattttttatttattttatcttttagcagagacaggatttcatcatgctggccaggttggtctcgaactccgccttggcctcccaaagtcctgggatttcagttgtgagccacatgcccagccatagttgctaacatttaaaagttgggtatttcctttaaaaatccagatttctgacttctcttagaaagatctaatattgctgggcccacatccctatggggtaacaaccagctggagatgaatggtgttcacccctttagacagggtgtgtgttctgttttttatcacactcaccaccacccccttaagtctcttagttaagttgctttactcatttatgttacctgctctgccccagtagtcatttgagcttatgccttctattgtgagacagtttttaatgagatgcccaggcatagttgacatgagaactaaatgaccagagttggaactttgattcatgaatatcatgtaggatgggttaccactgggttgcatagtgggggtgaaaagccagttatattttcatgtcctccctcttctggggggaagagagaaagctgatgccgcctggagacaggattcctgattcaagtccccttacagcgcttcccatctcgcctccctgtgccctccaaaaaataaactcctccaggcttgttttttccataccttttattgaactctgcagacttcattaagggaccatttgcttagaaattcttaaacatttggacatattttacaagacaagacagcagctggaggtcacacaaagatcacaatttcatctcaccacatgcataaaaagacactgggatttgtgtgtgtgtgtgtgtgtgtgtgtgygcgtgtgtgttgcgcacatgcgcaatgcttattttcacctttacaggaaggactagagacattaactgacgagagatgaataggacccacgaatgcacccccgagaaaagagtggctgaggacattggtcatttatggctaatgtgattggcttggcccctgtcaagggtgaggtgatcagaatggctttactggcagaaaagccccaacctcacacgacgggttcctgggagagacagggtcttagctgatgggatctgggggcatactatcatgacggctttggggctcagaaaaaaagatcttcggctctaaaagctggagggcaggctggccttaatatccagctggactcccatggctcagggaaygcaatccagtttccagatgttggctcctatgtttctgccccaggaagtcccagaccaaaggaagtcccaacttcgaacccttggcttagtccattggaaaaccacttggtggtcccccccatgggtcgtgtgtgagctaaaatagaacatgaggctgagaaatgcagggtaggggaagaggaaggagggcagagctgctctgtgggcccccaggaagtgtggctctgagagrgctgtggcccttatcagcttggggcctacaagcatcaaattgagatgtcatcttgagtcaaagaaagatgaccttgatggggcagttatgggtttcagtgggagaggggctcctcatttttcttctcttcacagttaggtagggattcattaactcccccattcactcacacattcacgcatccagtcatccactcagaggccaaccagtcacacattcactcactcacaaaaacacaggttggatgaccatcatgtgccagcggcataggttggggataaccctgagttcctggtgcagaaaataagattctcagtttttgaccttggattgagaaggacctatgaaatcaagatagacctggagaatcctccctgtccccacccactcaggcacactcagctcaaccaagagggaggcccaaaccccagtgaagcccaaggggcagagccaagctgtggatatgtcagagtttcttgggcatcttctctgctgcctgcctctttccaatcttggttcagatcagggaagcaggaagtatgggaagatccctgcatggccccttgagggcatcctaatgggacggaattgggagtttcttatattttcatgaaatatcctatttttgtctccttgtgttgttgcaacttgagtgattctgcagggcagagcctccagtgaggagttgggaggaatcttgaaaactggtttttattttattttggtttcagaggaaggcggctgctcattctacccatccaaacatatcatcctgcccaacctcatactaaaacaaccaaagacaaaccagtcttcggttcaccctgaggttgaagtctcactttctcccaatccaccatacataaaccctctcttgtcaaatgctttccttagagaatgcagtatgcaggatgatttgrgatggaggccacagctgcaggagagtggcattctgcttggaggcagccaagagcctggttttgctgtgaaactggattaaaagctgcctttctcttttgacccttctggatttttttcattgacggggactttcaaaggtcttgagtggggtctcttatttgatttaccaaaaaaacaagcccttttggaatggagccatttgctattgcctgggaagttgttcattgtggggatggctagtggggaacagatatcattgcatcttttatacagaaagccccaggctcatgagggcacaggagctgggcggaggggctgaagcaccataagacagccagccagggatgggggacagcgtggattgctccttggctggcctggggaagggtagcatgagtctcatcccaatgtggtgcctggtaggccactggggatgggttggattggtgactgacagtcattaaaatgttccaagacggagccggaaggaagcagacttgtctcttggacaccccctctgagagctccaaagcccagaagttgcattcctgctaattgtgctgcatgcctttgcctcagtggcttgagcttatatccagagtgttgaaaccacctacacacacacacacacacacacacacacacacacacacacacactccaagaaacaaagaggaatttctgtggttgttcagcccagtttccatgcaatgctagggcccctctgcaatgcccattttttacaccatctagccagcctctctttaaacacctgtgatataagggagctcactgtccaccatggcattgagctccatggtcagacaacccagcctgttaggagggcttccttaatttgagctgcaattgaccccatccctttcatacaatagaaattttcggagaacttgcatacagccagctggcagctaagtttttttcttcaggtgcactgccccactccaccccatcctggccagcctttaggagatcttttcaggatctttggagggaggaacagagaattaggtttataagtgaagatgagggttccctcgattaacagagccctacccaaattcaagttggcatttggggtagttcaggagaaattctaggttaagataaaatcagggagagtggatggaaatgcaaactatataacctctttcttgatgaaaacagcaacagccataggcaacagtgtttgcttatctgggcatcaaacccaggaaactactggcagacttttttttgttttgtttttttgcttttgtgcagaggaaaaaaaaatcttgtctgttttatttgactctggttcaaaccagactatcagaggttttcggggtgggagaactctgatcagggtcatagtccagaataataaaattcatatttgagttggcttcctcttgggagttatctgatgggatggctcactgccatctgagggtcccagtttggctcaaatttctgattctaggcagagccccaagccctgcagctgacagtgaggtgggtggtataccaaaacctaaacgaatgcaagttggagattatctgggctttcttcatcttcctgcatgagttgacggatggagaatcactttctgctgaagatcctgcctagtgagatgtcctccgcccacccaggactgaaaactgcctctggaattaattatcaggacagtccaaaaactcccccaggcgtggataggtggaagctggaaaactgcccctgtccttgccacacacctcctgctctatggagccaggcagctggcaagggaaggggagatgagctagcagattcggggacatctcttctcagggtttggctgcaagggtgtctggccactgttttttggtgaagctgttagaaatggattgaaatggactgggtgcagtggtggctcacacctgtaatcctagcactgggaggccgaggcaggcagatcacctgaggtcaggagttcaagaccagcctggccaacatggagaaactctgcctctactaaaaatacaaaaattagctgggcgtgatggtgcgctcttgtaatcccagttactcaggaggctgagacatgagaatcacttgaacctgggtggaggaggttgcagtgagccgagattgcgccattgcactgcagcctgggcaacagagcaagactttgtctcaaaataataataacaaaaaaataaataaataaacagatcgaaacaaggaactgataaacaagttggtgagatcggaggcccagcatgttcttgtgaggttcacgagaacctgaaaaacctctgaccttcagctctgattgatgttacaggccgacagggtgctggacatgtgggagcagcccagccaggagggactcacatgtgttctggatctcagaaatgccagtgatgagtttgcttgcatgagatttttggttccaagatctctggggatgagaaaactcagtcccttcagatccctaaaggggtgtgggatataagtgaaaccagcccacatcccatcctgattttgagggccatctgtagctctgcttccctgggtctcattcctgcattcatgccctggattcttaagaacaacgaatgggagaaacacacagaaatgaatgaggaaagtcacagcattgacagagtccaggcctagtgtcaagaaatgcctacacaaggaagtcaaaccccaaagtctttccccaccctcaagaaatcagaatcaaaaggaagaaaacccaaacagcccaagggacaatggtaggaactgcaaaagaccagaaaacatcagctacgataatgaccaacaatgaaactcctaagatattgttctgtattacaaaagaagaaattagactcaattgccctattataaatttgctaaaaatacatatatatatatattttatctgaacagaaaaatagactactctgagatgcgtggacattctatgacatagtcgcgcatcagatacttctagagccagaaaaatggcaacagaaaatgcagaggtaactcttatttctgggtgtagccaggactggtttgggttgcctgggctgagtgacatgaaagcatttggatgctgtcctataagcagtgataggtgaggaaacatcagctcggggctggaagctttccattgtcctgccggggtctcaggggagccccttctccctcctgcccactctgcagctacagaaaaagtcctttcccaaagaagcatgtccggaggctttttgccttgctctcttttgattcaaagttacttgaattgaggctgaaaaaaagcctggggtattgttacttgagattagttggtagagaaataagaataggagagagattagcgatagagacctggctttagtggctcttgtccgtggtgaattttaaatatccccttgtccatggaactagacactccagctgggactggagcaagacagaaatatacaatagttacaaatatcaacaatacattacagttttacagaagagaatactgttttgtttttctccttagaaacatggatcttattaggagaaagggcagagacgaggctacagttaccaagacacatggagaagctggaagtcagtttgaaaaagtttgtatcaccagcagttttcaggggcaagctgggtgggttaaaagaaatggcctcctcaggattttgttgtttttccttcttactcttcttccttcttgatccccagtcctttggagaaagggacttcacgggaacaaatgttctctcctccttttttctttccccttgaagtgtgcttaagatagaattcctaaagaaggcactgagaaatctactgcaccaaagtcctgttggtttcttttacccaaagataaaaaggtgaatatactgtctcctccaaagcttccccacctctctcaccgccggtggcagactctcccccgtgtgattgggacacatggctacctggtccctagccctttcagataattgtggaagttggaatgcaagttcagctgggttcttgatgagtttcagtgaatttgccaaactgaccagcatccattcgccgcgtccagcccctagtttgcttgtttgggttgacttgtttctttctgctctcattggttcaggaatgaatgggaaatggaccaccaagttaaagcaggatttgccttcagaccattgctttcctcttctcttctctatcaagacctttctatcgagtgaacttctcagtgaagactcttaagtagatttcccagtgcatgtatattcacgtacataggtacaggttgggtgtatacatattaaaatttggatatgttcttttttagcgggtggatgggctgggaaaacttataatactctctttcgaattgagcacagaataaaagctatactcccccagtacatacacacacaagtaaaagaaaaaaaaacccaatcaaacccaaacaaaatactttctaagcatagtatatgctgaatttcaattattctgtttctataagaactctataggactctggctatgaagcctgaaaaggtaggttcttaatgatacttctgaattcgtccttcaaaagtgactcaataaaatgctactttacggttggacaaaatacacaaggaaggaagggccaggtcctacatgaccacagaaggcagaaagggcctttggttacaaggagagttgcaccaattggttttcgttttttttaaaaaaaaaaaaaaacaaatcattttcaatctgtacagttctcatctgcttcaaccaacaaatgaaatgcctcgattggaagaaggggtggtaagttccttctcaatatatatggctatattgaaacatgttcactttcctgatatgtaaaatagactatattattattattattattttttacagatagcatcagctctaaaaatatctgaattggaaatcacaactatttacttttatcaaaaagcatttgtttttttccctgaattttcacatttgtgctgatggtggacattaatggtgatgaaaacaaagaagagacatgtgagatggtcggcggagaactgtcccacagtcattcctcaagaggcccccagctcagactgcgtgttcagcaaagtgttttgggagtgctgcttcctctgcctggcacgggatgacctcacactctccctgcccctaagtccctttgcagttgctgcgcgaatactctgaagatacctaggaagagtgacgttctcgttttctctgttaatgcggcaaagaacaggactgcaccctcttggggggatctacagtctctggagatgctgagaagtgttatgaattgggtttgtatacagcagagaagacatatttttaagggtggtggaatgatcccatctcatcatatgtgtggcaggtggctcaaccttatgccttatgtatgaagagcaggcagaacagctccatgatatttgtgtactgagaggtggatcatgccattgtactaacaggcagaccagcaacagatgatattgagacttaagactaggtgaaccaataccatatctttcttccactgggaagacatatgcctgttactgtattgaggatagacagaactacactattgtacttgggacatcatccatcaacattacattaagagaacaacattgttccattgtactacagacaggcagaccaataacatgtcatctttactgacaggtgagccaacactatagcattgtattcatcagtggttcaacctaatgccactgtactgaggaatggccaacaacaccatgctgttggactaaaagcaggcaggacaatgccaggtcatcaaacgaggacaggaaaaccaacaccaagaaatacaccagaaccactcaggatgcacacaaatacttattgcttttgtctgtactggctgcatcgatggctgcaggaaggagagttgagcttttagtacagacagtgacactgaaaaaccaatagctggttgacaagaaagagaacagagtaaaacacccaatgtccaactgtcactgtgtccttttgagatgtgcatgtctcctgtatacttgacttcatgagaggccccacccaaggggcaagaacccctcctgacccatgagggttaagggaaggtttcagaggggcagggaaggagcccacagactttgatatggcagacagtaataccagcacaatattacccatgctggccagaaatgggcaggtagcaacaatccaactacagtcccaacaattgggctatgggaaatagtgcttattttaaagtgcaagatgttgacactgtccctggcagaacctatttttgaaaaacataaagtgctttttattttaacttttttttttttaacttgaaaaccacagaaaacaaaacagaatttctattatagtaggtactttccttgctgcagcaggaattattcagtctgaactgggcatttcaatgcgtggtatttttttcctttcatttttgcaagtaaaaaaatcatatttttatgctgttcttcagtaacacacagtctctttgaataaactatttcttttgcatatttgacacttgcatatcttttgagtctacactagtgatgtaaagaaagcgtgttcctcctccaaccctaaaacaatgctctgagttcatgctgttggctgggtgcccaccttctgaacccttcccagattgccagggggcaattagaattgagtacaagtggtgcaactcaccctgatggtatctcaaaataaaatctcaggtactatgaaataccgaagtcaatgaagacatttgagtaagggttttgcgctgggatcgtggcttatggcgcagagacttccccatgaccaatcattccctgtagctgtctaacagtggaatccatccaggaggtgatggacaggtgttcctaggggtggctgggcaacattcaataccaaattggtcaacccactctttcaacaccagccgcttgttccagcatccttctctagctgaagccaggaggactgtcaatgttgccctccgaggctgagatggaaagccacgagagaatggggagtatgtggcctcggtcctgtctaaagtggtggtagtggtggctgtgagttccactcatgtcatctcccaaagagggctatagagttgttacaaggaggtgctgtgccctatggcttggccaacttcatgctgatggacctgtcatggctctcaaggtcttagggagccttctctggagtctctcttctctctgagggctttacagggcctttctgttccagagttcatgcagaaaagctctgtggcaggtaagctgaacagctctcctctttggacctcacccaaaagtctctcctccaaggcagggcagttcagatgctctgatctcgtgtgcttccatgggctcctccccctggcaacacacggacgtcaggggagatgtggttctcaagtttgcacttttcctgaccactggggccttttccagtcaatgcttctgtggagtaaatacagttctgccttaagaacttaggggaggtgggtaaaggggagctttcaaagtggtttttctccgatcttgtccccgtgctgaacttcggactggtgctcccagggaggcttttgggggggctggagtccacactgtagagcagctgtccctcatcatctgtgtctgc

SEQ ID NO: 12513 - DNA, 15993 bp, Homo sapiens
ctagctgtggagaagttgctaaacatccggcctcctcctcgggcacagtggatccgaggtatgtccccccaactttttctgtggcccactgtgagcatagcatagtgccttttccaccacttccccgttgaacccaagcttagtgttcagaccccaggctctgcccagacctctctgtccgcctcagtgcttggctcctatatcctgtcttctccttgtcttcacagtgctgtttggagaaatcacacgtttgttgaaccacatcatggctgtgaccacacatgccctggaccttggggccatgacccctttcttctggctgtttgaagaaagggagaaggtaagagtgggaggaaaggataggaatagggaaggaagtgcaggaagtagagaaggtataaaggagacaggagattaaaagaagagagagaacatgggagaacatttagagggggaaggtatgtttaacttgggttatatttgtagaaactatatcatgaggggttggttgggcacaagaaggcagaaagtgggggagtaggccatcataggacctgggggcctgggactttgacactaattcccagcacgttctatgaagatgtttgagttctacgagcgagtgtctggagcccgaatgcatgctgcttatatccggccaggaggagtgcaccaggtgagcaggtccccggcttccccaaatgtccagcccaggcctattttccctgtggccactggagggcagtgctggatgatggaaactccaaacctgtatcgctgggggagggggtgctgagagggctctccttagtgaaggctatgccacattcagtagcacttccgtttggcttctaggacctaccccttgggcttatggatgacatttatcagttttctaagaacttctctcttcggcttgatgagttggaggaggtaagctaggagtcaatgggaaaaatctctcccccacaagaagggctagagaaatacagagatatttgaagagtgtgaggaagagtattaacacaccagttttcttgatcaatagttgctgaccaacaataggatctggcgaaatcggacaattgacattggggttgtaacagcagaagaagcacttaactatggttttaggtgaggggaatacaacttctctccgtaggagtgggggtgggagtgggggagttccagcctaatatcttgtctttgaagacttgttggcatcctcctagtcataccctgaatgtgaaggatcaacaagggaggctaaggaagaaggagcctccttacttagtttgtggagagtggcccttattcccattatgctctccacagtggagtgatgcttcggggctcaggcatccagtgggacctgcggaagacccagccctatgatgtttacgaccaggttgagtttgatgttcctgttggttctcgaggggactgctatgataggtaaggccccaatcctttcttggctgatattccagctagtttcccctgcctcactcttctctttgccacttccttctttaccctacttctcagtgtctgtgggagctcttgtgtgtgttagacgaggttgctctcaaaacactttcacatatatggaatcttacttatttttttcttttttgagacggagttttgctcttgttgcccaggttggaatgcaatggtgcaatctcggctcactgcaacctccgcctcctgggttcaagtgattctcctgcctcagcctcctgagtagctgggattacaggcatgagccaccacgctcagctaatttatgtatttttagtagagacgggatttctccatgttggtcaggctggtctcaagctcctgacctcaggtgatctacccgcctcggcctccaaaattgttgggattataggcgtgagccaccacacccggcctatggcattctttttatctttacattatccttgtcttagatggagctagctttggctgcattttatagctgagaaagctgaggcataaaagttagggattagctgggattattcttcaggagtggtcgagactagaatcctcctgatccagtgttctttctagtagatcctaagcttcagattctcctcctgggccaggcacagtggctcatgtgtgtaatcccagcattttgggagtccaaggtgggtggatcacttgaggtcaggaattcaagaccagcctggccaacatggtgaaaccccatctctactaaaaatacaaaaaattagctgggtgtggtggtacatgcctgtaagtccagctacttgggaggctgaggaaggagagttgcttgaatctaggaggtgaaggatgcagtgagctgagatggagccactgcattccagcctgggcgacagagcgagactctgtctcaaaaaaacaaaaaacgaaaaccaaaaacaaattctcctcctgttttctcaccctgagtcagatttgttactgtgtattgttttttttatttttgtttgttttattttttgaacctggtagctactgctgttatttttgtttgtccatttgactctcacccatcctgtggtccaaaaagtgcttaaggaggtaattaaagaaataaatactacaggccatgttctgagaaaataaggagagggtttggggaagcacccaagagtagaagcaaacgattacagggggctggggttggtggctcatgcctataatcctagcactttgggagaccaaagcaggcagtcgcttgagctcaggagttggagatcagcctgggcagcaaagtgaaacctcgtctctacaaaaaatattcggatgtggtggtgcacgcctgtaatccaagctactttggagaccgagatgggaggatcacttgagccccagagttcgaggctgcagtgagctgtgaaaccctgtttcagaaaaaaaaaaaaagactacagggtttatatgggtggccaagccaagcagagatgctgtacttggagaaaagagtggggagagttgacctaacccttttgaggttggccaaagggcatccttcctagccccatacctgctcctctgactgttcttctcttgctctgtctcatcttcttgaggtacctgtgccgggtggaggagatgcgccagtccctgagaattatcgcacagtgtctaaacaagatgcctcctggggagatcaaggttgatgatgccaaagtgtctccacctaagcgagcagagatgaaggttggctgcagggagggggaaagtgtggggtgttggaaaggggccagtggctggggaggagtatccttggattaaatcctatcttttggttttcttttttttttgagacagagttttactcttattgcccagactggagtgcaatctcggctaactgcaacctccgcctcccaggttcaagcaattcttctgcctcagcctcccaagtagctgggattacaggcgtgtgccactacgcccagctaattttttgtattcagtagagacagggtttcaccatattggtcagggtggtctcgaactcctgacctcaggtgatccttggcctcccaaagtgctgggattacaaagcgtgagccaccacacccaacccagttttcttttaatagagaatttactgtgtagtaagagattcgggttttttttatttttttattttttttgagacggtgtcacgctctttcaccaggctggagtacagtggcatgatcttggctctctgcaaccactgtctcctgggttcaagcgattctcctgccttagtctcccgagtagctgggattacaggcacccaccaccacgcccagctaatttttgtatttttagtagagacggggtttcactctgttggccaggctggtcttgaacacctgacctcttgatctgcccacctcagcctcccaaagtgctggaattacaagcgtgagtcaccgcacccggccatataagagattcttaatctcccatagctctcctgttttattctgtatcctctctgcttactgactgacatgtggctttagtctccctgagggtagagattattttctgtgctgggggaggcctaggagacagagtttggatatggtttattgatgctccctgtttcctctcttcagacttccatggagtcactgattcatcactttaagttgtatactgagggctaccaagttcctccaggagccacatatactgccattgaggctcccaaggtaaggagaggaggggaaggaaaagaccatatgtagagtaggtagctaaagatagatgtttaacaaatagctcattcatcaatgagagagaaaacagaatgaatagaggttttgttggcagagaaaaatactcttcatgttaatacagacacccaaccttcttccttgaacagggagagtttggggtgtacctggtgtctgatggcagcagccgcccttatcgatgcaagatcaaggctcctggttttgcccatctggtaagaatcaatcccagtaactataactccaatgaattaaacctgaccttggttgaggtttttatgaactcttctttctcctcccaccttgcaagtcttaactaacattgttgccatctcaatctccctaggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaacttctggtatcttagtgtctcagtatcttagtgtccttcactcggactgtaaacctaagaatgttcattaaccctccattcctgttagattcagtcaggtcttagcaatttttcctgctcgtctccacccccttctctgactcttgtcctttccacttctctattccccatttcctctttcgcctcagttccctccttgcccaaaccttctcagtgcccacataacttggtaaaccactcaaatcaagacctggggtaaagttgggagggaaagggctatagtggggtctgagggaatgttgacgggcagtttcacacagataaatctctgaaccagccgggcgcagtgcctcacgcctgtaatcccagcactttgggaggccgaggcggatggatcacctgagatcaggagttcaagaccagcctgatcaacatggagaaaccccatctctactaaaaatacaaaattagccgggcgtggtggtgcatgcctgtaatgccagctactcgggaggctgagagaatcgcttgaacctgggaggcggaggttgcggtgagccgagatggcgccattgcactccagcctgggcaacaaagcaagagtccgtctcaaaaaaaaaaaaaaaaaaaaaaatctgaaccaggtggagtggaaaatggcagatgtagacagcctttcctgagcgtgaaagtctcctcattctgtgggttaggagttggtcattgaagggctgacgcttaagagcccagatctcccaactcccttagttggcccttccgggagccgcccggtctcttgtgcaggaaggggaaggggccaaagcatgggggaaggcgtggcaggaagagggggactctgtggtcagggaactkctcgctgagcacagctgcacagtgctgtcagaacggccgatctccagcccaagatgattccagcagtggtcttgctcttactccttttggttgaacaagcaggtaagagggtttggtgagggatagcgtgagctggctccagggtggaagtccagagcttgggtctgagggccaagtcaaacacaggtgaaggaaggctgacagtgggtaggtgggcatagggagaccctgaggctagtcctctccagccccgacccagggcactagactcatagttccctcctttcttgttgccttcttacttcattccagacttttctccgtattattattattattttggagatggagtcttgctctgtcacccaggctggagtgcagtggcgcaatctctactcactgcaacctctgcctcctgggttcaagcgattctcctgcctcaggctcccgagtagctgggactacaggtgcccgccaccacgcccggctaagttaagtatttttggtagaaaccgggtttcgtcatgttgaccagggtagtcttgaactcctgactcaagtgatccacccacctcgacctcccaaagtgctgggattactggtgtgagccactgcacccagctattattattattaaaaaaagacagggtcttactatgttggccacatcggtcttgaactcctggcctcaagcaattctcccacctcggcctcccaaagtgctactgtgcctggctgacttttctcttttcagggttgatagaaagtggcaggggaagggtctggttgtatggcatgaagagctggtctggtgaaaagcctcatttctcatgatgagcatttcccatggggtgcctttggtcttgtctgctgggagctgatctctagctggtttaatatacaaagcacccttggtgcctataattccagctactcagaaggctgaggcaggagaatcacttgaacccaggaggtggaggttgcagtgagccaagatcgcaccactgcactctagcctgggggacagagtgagactccgtctcaaaaaaaaaaaaaagattttacatatatatctctatctatctatctatatacacacacacacacatacacacacacacacacacacacacacacacacacatatatatatatatakagagagagagagagagagagagataaccctttaggaaggtaggactctgttcttgtgcttgggagtaaggcaaggatatagccaagacaaacagacgggattgctgtttctatgggtcattgttaatgctccattctgtcagcagttgataatgagggtgggcagcatgagatccccagttccagagacctgagcgtcagctgagaaatagaggcagaaatgggaaggtctctgaagctctacagctccagccactatctaagaattctcactcctcgttcactctgtgttgtctgtgctggattggtgtgtgtgtgttggtggcagctgggtgttggggaggaggaggtcagtaaacttcagggaaactgtggaaattgaaagagaatgactggggaggaattccagcagcctagctgagaaggtgggagcaagtattaagttagccactggtctgctgccgtgggatgaggagggaggaggcccgctgaggcacaaaggaaagcatgggctttagaggcagaaaacctgcatttgagttccagctctgtcacttaactctgtggctctgagtgagttacttagcttttccgagccttggtttcgtcacccataaaatggcgatgatgatgtttccctcacagggtagttttaagatttgtgcaatatcgtgtgtgtgaaagagtgttgcagaataaaaagtacttgaccgatgtcagcaattgactgacgttagtcacatgttccctactggtcctctgatacggggtgagagcagtctctggagcccagacttgatttgattttttaaattgcacaaaacttcccctctcagagacccagagagtgagtaatagggcagagtaacaggagctggaatccatatagctgtggtcattcccccagccttgtgttcagggccaaaggtatctgtaaggtctgggaaaaacagacacactttttttttttttttttttttttacatatttaagtgtcttgtggtgggacagaaagcaacaaggctgaggctaggagatgaccaatgatagagtaattgccttctctcccttccccagctcacatccttcctgtccagccctcagccacaggtcacaggacttagtagagacacttctgtggtttcttcactgaaatttgccactacctctccctcccactacccatcttggctgaggttttggtttcagtccagtggactcagatgggtcccttgaggtggataaagtgctcaatggtgcctgaagaacccacagtgctaaaaagaaaaggttgggggctgagggggaaggcctcaattattagtccgtgtgagtcccatttcaatagaaccctcaagcttcctatcctagcctgaccctatggtgtgggaggagggaaaggtaagggcagtggaaggccagagagaaacagaatttcttcccttagayggctcccctccaggccctgtcctacctcccagagccccttcccttctctcctctgagtaccagatcctccctgatacccccgaccccatgggcatcctctatcccctcagcggccctgggagagcctcagctctgctatatcctggatgccatcctgtttctgtatggaattgtcctcaccctcctctactgtcgactgaaggtagcgctgggcagggtggggtaagggctggaaggggaagtgggaggagggcagcagcaaggattcgaagagaaggaataaaaggggatcctccacaaagtttggagggaagggggatgggccattaacttaccctttactgataacctttcccccattccagatccaagtgcgaaaggcagctataaccagctatgaggtatggaccctcctacacctggtgtggacaacttttcagaccctcagccctcctggggctctagcctgggtttccgggcctctgggagggcctgcctctcaggtgctgatctgcatacacctcagaggcctccctcccaccttacctagccaagccacaagtaaaatattcagcaggtgacasggaagaatcaagcatagagtgataaagaatatgtgagagacttggatgtagtatgtcgggtgtatatgtgtgcttgtagccatgtgggcaaacaggtatccatgtcccagagtgtccatgtgagtgccctctagcccaaggtggctggctgcccaccccccatgcctccctgggtggggcagatgctgaggggccctggagaaagtgtgggtctttaatgttttgcttcttttgtctctgcagaaatcagatggtgtttacacggtaagtgtgcctacctcccccacccaggaagtcagcagaagagggtgggattttgagcgatctttggaaggccggtggggggaggggggtcctgtggaggtgggaggggcctctgatggactccagctcctgatcgccctttgactcccatctccagggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctacccctataatgatcctgtgtcctaaattaatatayaccagtggttcctcctccctgktaaagactaatgctcagatgctgtttacggatatttatattcyagtctcactctcttgtcccacccttyttctyttccccattcccaactccagctaaaatatgggaagggagaacccccaataaaactgccatggactggactctattcattcattcattcatttatcatagatttattcagtctctgctaagcactagatacagcttttcagttccagaactcacagtctaatggacttcagagctattttgctcgactgagggataaatgctgactatggctgggggagggataaaaacctttgacctgtaggtgctctgaggatggagctggagcagggactagtgtgttgggagtctaggcatatttggaaacataagaaatgacttctgtatcagcatggccttctgtgttcgacaattgaaccaaggttgggttgtaggggagcctgggtgtccccagatggccaccaatccagacagcatcaatccagtacatgcatatgggaattagcatagctgaaaagccaaatatgcagaacggatggtgtaactagggctgagtgaagctcctaatggaaggttttatagcaacagtgaattttcagggcatctggggcaagtgggaccttagagggccagatgggtcagtggtaggtaaggcaaagggaaataagttgggtccaaatgggggggtcatctccttcaagtgcatgggtggtggtcaaggccctgtcaatgcctgtcctgttttcagagctacgaggaatatttgcctgaaagaatttaaacctcaggagatgctgccagtcctacttgtgacccagtcttttcagaatgggtctagagactccaagcttacccctggcataacccccaacctccacagtgctgcacaacacttcacactgcatagtgacttacacttttcaaagtattttccagctcattgtaccatttgatctgctaattaaccctgtgaggaaattcaggctctttgaagttaattaacctgtccaaggtcaccttgcaaggaaccgactgagatcactttcgtctctgcacattttgccacatgagaagaagcagatattgggaaagagaaggggtagtgagtaatcatgaatggcgagggtcttgaaggccagatgaagcaggttgatcaatatctggaaggaattggagccatctccggtgtctggcgggggaaaggtgatttcagatgagataagagaaatgagccagggtaggaaagtaacttttttttttttttttttttttgagatggagtctccctctatcaccaggctggagtgcagtggcatgatctgggctcactgcaacctctgcctcccgggttcaagagattctcgtgcttcagcctcccgagtagctaagactacaggcaccaccatgcccagctaattttttttgtatttttagtagagacagggtttcactatgttggtcttgatctcttgacctcgtgatctgctcgcctcagcctcctaaagtgctgggattacaggtgtgagccaccgagcctgacctggaagtaactcttttaaagataaagtgggaataaacttttattggaaaatgtttcattttcctttgctctgccttttgggattgtaagtctctccccatcaacccggactgatttccattccattttcatttaatccaggtatcacagctcccaaagtttttctagtcccacatgtccaccgaattggatacttgccaggcctttaaatggctaccacagctactacttccaggctccaagatggctaccaggccagttctatgaatagtgcctggatagcagtggaggagaggcttggaatgggtcttccacagacagtgtctagataagagggtttttgttgttgttgttgttgttgttgggatggagattcactcttggtgcccaggctggagtgcaatggcgtgatctcgactcactgcaacctccaccttccgggttcaagcgattctcctgcctcagtctcttgagtagctgggattataggcatgtgccaacactcccagctaatttttgtatttttagtagagacagggtttcaccatgttacccaggctggtctcgaactcctgacctcaggtgatctgcctgcctcggcctcccaaagtgctgggattacagaggtgagccactgcacccagctggtcttttgtttttaattaaaaaaatatatatattaggggggctcactgtgtttctcagtctggtctcgaactcctggcctcaagtgagtctcccacctcagccttccaaagtgctggggttacaggtgtgagccttgatgcctggtctagataagaggttttaaatggagaaattagagcacttctagggagaggagcaaactcaagtcttttattgtgggaaagggggaaacacagtgttcccctggctcagaagggaaaggagggccacgggtgacaccttgggaagctttcttttcttcatagaatgactaacaggaaattatgaggggtaccctcattttctttttttctttactttcttttttttttttttttttttttttttttgagacggagtcttgctctgtcacctaggctggagtgcagtggcacgatgtcagctcactgcaacctccgcctccccggttcaaaagattctcatgcctcagtctcccgagtagctgggattacaggcacgtgccacaacacctggctaatttttgtatttttagtagagacggggttttaccatgttggctaggctggtctggaactcctgatctcaagtgatccacctaccttggcctcccaaagtgcagggattacaggtgtgagccactgcaccccaccagggtaccctcattttctatgacctccagaaatcgagggattcagtttgtgaatccttccttcctctcctagttccttgtgcaatgcaaagcctctttagtgttcacctgcagagtcgtgcccaggctgtaggagactctgggtttggagaatcatggcaccctcatcctgtcattttcatcagttgtgtcttcaatcctttcttcacccctccacactcaaacctctctccttctagaagcagatttttccttttccttcctcttctcctcccttactcccctacttttcccagtcccccaaacataccaggctcagagctggattcattcagcatttattgtagcaaagagtgggtagggacaggagctctaggactggccagtgggtgttctagaggccagctggggttggaagacaatggtctggacacttcactgggtggcaggctgtgttccaagttccacgaaatagctcaagaagttaaccagttccgttccagccttcttgatcaggggtgtcagctgctcctttgacttttcaaagtaagacctggataggtgaggggattagagtttaatctgagggaccctaggcactggcaggggccttggtggtggtgggaggtcagagcagactgactcaggtccccaaactctagtgcctggtccatcgcatggcaaagcccctaggtaggaatagagtcaagacctttgctaggtagagggacagactctagagactgaaattcaaggcccagttcttgctgttcctctctatctaagagacgtgtgggatctttgggtgatgaaatactttttctctgcaatttaagcctaatctgccctaatccccacccctgggttcagacttctgtgggacctctcatcttcccttctttctctccacagttccacagcccctgaaccccttgccctgagacttacttggcctcggcctgaagctctgggctcttgaccttctccatcaggtccttgccatagtcagtcacggtctggaagtactgagaaaccaggctctccacacatggctcctttgcctgtctccgaaccaaagctcctgcccacacacacacacacacacacacacactcttttcagctgggtccacagcagtgaatcctggcctcctgccatacctctgccagtacccaccccagctctctgccccctccccaaaaaggtatccagccagatctttggatgggctttctgggctttagagagggaatgatcttccttttgagccctttggttgccagacctggatataagagcacaggcagataggtagctataaccaccagcacattctcccttttggccccctctccatatcacacccaccttcaaggctgcagatggtgaggagtagcacagttgctgcgagcagcttcatgttggtaacagtggggagggcggcctaggaagagggtggtgggggtttgggggacactgaagccaaatgggcttcagctcctccccagggatctccctacctgctgcccattccaacctggctctctccctctccacaactgaagcccaggcctctttggatgctgctcacacatcttgcctccttatcttacctagccagcgtctctgtccttggtgtctgtgcctgccctggctggagaggaaggggctatatacctgtctgtttacccaccccctgtcaggtgacagggactatggatgggcccagtggggcagggattatgtgaggataaacaagttggagaaatgggggaggagaggacaagcacatggaagactcatggtgatggggtgagaggcagggggtacagctcttagtggaggctaagggggtacacttcaggtatatttgaggttcattcttttgagatctgaggtccttggacttgaatgcaacaggaagcaggattccaagttatttctctggaaagctctgacatatcaacccatggaataccatcaacccatcataccatggaaagctcatggtgtctttattccattatgggtagatctcatctctcaaccttatcccactttactgcaacttggcagagagatattggggagcagaagaaaggagaaaggaattgaaatcagggacagggttgagggctatgggggttaggggaatgagggtcgggtaagagggcaagtgtaaatgatcttgtccgtttttgagttaatgtgtaatgagacggggagaaaacaggagagcccagaatgacctggatgctgatcactgaacataccctacccccagtaaaacaaattcagaaaacagcttccgcccgtcccctcccaatggagggctctggcaggaaaagaggtgaataagaggcttctaccagggtaaaggttgaaggcacctggtcatttgatcaccttatcagttctaggcagtgattagccaatattgagtcagcaggggcaatagccctggcccttgtctcactcctgttgggggtgggggagggggagaggtacattcccaggttcaaagcatttgggtgaaatcagttaaatagatatcagaagcttttgtatctttcacccttttgccccccaagcatactcgctgagtatgtggaacattcctgagggtgacagtggaggcgcaaagctgatgagggaggtagtgaccagagaccaagaaatctttgttttttaacttttgttttaaattcagaagtatatgtgcaggtttttttgtttgttttcctgagacggagttttgctcttgttgctcaggctggagcgtaatggcatgatctcggctcactgcaacctccacctcccgggttcaaggattctcctgcctcagcatcccaagtagctgggattacaggcatgcgccaccacgcccgggtaattttgtacttttagtagagacggggtttccccatgttggtcaggctggtcttgaactcccgacctcaggtgatctgcccgcctcggcctcccaaagtgctaggattacaggcatgagccaccgcccctggcctatatatgcaagtttgttacacacgtaaacttgtgtcatggggatttgttgtacagattatttcatcacccaggtattaagcctaatatccattagttatttttcctgatcttctccctcctcccacccttcaccctccaagaccaagaactcttactccattttcaattattcccctgtggagcgcttagtgcttgaggtcagccctttggcttgtccctggtcctgggatggagtgcctttgggggcca

SEQ ID NO: 12514 - DNA, 15272 bp, Homo sapiens
gaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatttgtggttgagattgctggagatattcatttatatgttgcaaatttattttaaataccaaatttttaataagcaagaggaactaaaggttagaatgaaaaacaagtttcatcagtttttttatattactatatataaaatatatactatatataactaacattttatagttttttaagttagctgttctgccagtcccttaccacagtgtggtttcttcttgaattgatctcaatatttataaataatatgtttataatactatatcttgatattgttttgtatttgaaccatttctttctataatagaaaagcattttagctttatttccaaactaacaaacatatacaaacattgcaaattctttttctcctattctccaatatagatgtcacagtttcttagttaaattagtggttattatctatattgttacatgcttcagaatatgcatttgtatactgtactagaattacatttccatacttgaaaagtatggttcctagagttcgtaattgttatttcatacttgcattattttctatgtacctctattgtttttttccatatctttcatttgaatgtattttctccttaaaaatattccaatttttaagatactctgtcaatgacatttattttcaggagctctttcatcgtgagtttcctgtttcatttagactggttaatctatagactgttaccctgggactttttcccttcaatactttcctgtatgagtctacttttccaaggtccagtatactcttttttctagtttactctcttattcagctggcacgcatctctcaagaccttcatataaacgaatgcagaagagatttttaaaaaattgtctccttacattgtgaagacatcttttttgtttgttttcatttgcttgatagtttgactgggtataaaattctagtttgaaaataattttccctcaaattttgaaagctgaagctgtctcttttactcattgcatgtcgagtttcttcagaagactgacttgattttgattccacctctctttgtgtccttctctcttacctcctttcctggaagcattgaaaaactttttcctggtaatctgaaaagaccttaatacaggcattttatttattaatctggccatgcaggcataccctgttaacatatagactcttactgtaagttctgagaaattttcttgttatgttttagtaataatttatccattgagttttctacagtctcactttaaccagaatctcattaaatattgcacctcctgtgttgattttctgagactctaaattataatttttttcttcttttccatctcttgttctacttattagacaatttatttaatcatccaatctccatatttaagtttttctttttggatagcaaatatttatttttaagagctcttggtttttcataacatcctattacaaatttgcaaatgtaaatcttctttcatctataattaatctatttattctttaaaaatgcattatatagtaagagttattattatacctattttaaacttgcaagtgaatcaaagggaagttaagaatttgcctaaggctatatagctagtaaggggcacttaagccctaagctattctttgtcttccaggtataaatacgtacttgatagggttactgttaacatcaactaggtaaatccatatgaggcactagaataatgaacttagaataagtcaataagtgttagctcttattacattttgtttctctggggatactaatcagacattttaaaaggctttcttttgttttctgaattatatctattccctcctgttgctttttgtgcttggcggtagtattacagttttggcttttctatttcatgttgtaggcattttctcaaatgtcttgttatctttgactgtcttattatatatatgaatggtgacacagcaaatgctgacagtcaacacttcatgagtattgatgacagggcttcactctaatgtaaccatgctaggatagagctactaccttgggaaacccccacatatcagtacatgtaagtctttatctgcgcctttcatattccccaggatagaattctacaatattcaatgttttgggtgcgatggggaagatgtcaggcatatatcttgtgtcctacaatctgagagtatcatggctaggagtctcacaatacagaaggcagtgttttgcctaatctccctatctttagtttcatacctcctactttcactcagctctgcctggggtttccaagactggagatagtataatttctccagaatataatctaatttctccagagtataagctttccattctctggctctcagttattttcttgtctctgtatgatggtgaaaagaccagagaattcaactatcctacatacatactttcaactaataacttcttttttaagcccttacttgacttcagccttcttatacacctggttcctccaagtctggtacctactaggattgtgtagggaaaacccagtagtttatttttagtatctccaatgaaggaactttattttagacatttcttggaactattgtcaattgctctttcatctgctttctatcatcaaataatttgtgtatttacttatgtattcttagtctttgtgaattcataccttttattacttttctgtcattttagagaggggttaagaagaaggaaggataattgtatagtcaatccacatactattcaatttctactcttctgcactgataatttttcaaccatgtatctagttcacatttttgtgaatgtaatttgaaattagaatttttaaaagcagacttcttagatgtcctccattattgagagtactttgagatgtctaacagtggataccattggtagtttccaagcacctattccaactatctccctcattatgccatgcactttggctaggactgaaaccacctcaagtttaaggggcaatctctgcctggattaaaacaaagggtcaaagatggagtctttagattctgggactataatctctacctttaatcctatacatcttgagacactgatttcttcagtaacaggctgaagtgctctcagttggtctaatcagaatgaaggctaagattttgttctattattgaggaagaaaatatctctcattctgtcttcttgagctgaaaaacaaagcagatagccatagatgttgctggaataaatcttgggaaactgagggagggcagtcttagaaataagcctgctttaaatgaaactaacatgcttgtgcttgtgtatttattattttttgagaagctggaactaaatcaaggattctcataatgtgttctactcccaatatcttactttactttctagcagttcacaattccttgctaccaaggaaatctatataaatgccttcttgtgctatcataactatcaaagtatgtcccatctcatggttaatccagtttcatatcctctgagaggacttctaaaatgacccatgtatagtttgccttttcattaccacctaaggaaagtcaagtagtgatagaattttgtacagcttaaaaatattatggttgttttatgtttccagtcttctcagaaagattacaaaccactgggagccaggaatcacatcttgtatttctgtattcaccacaactaagcacgtttggttgtatggagaagggggaaagataaatgctttaagatgaatattaacagcatatcaaactaaagagaatatgaaataattattacagaacgtgcaatatatttgtaatcacttgaacacaatgaataaaacaatatttgtttccggaggacatataagtgaatggaatttaggtagctttcaccaaactgtgaaaatctatggagacacttggtggcgctgcaggataacatcgtgaaaaatatattcactggatggcgttgtgaacactgatatccagtgcacacagagaatcagaagacagaaacaacaagccttcaagagggtgacctggaaaccattcaacagggttaaaatccttagaccacagaggatttggtggacaagtcagagacgcgttccgcagagctgaagcctttcttcaagaagcctacaagaaaggaactatggagaaccragggacacrcactcagcagataaggcaagtcctgcttctctttgttttgctcggaatgtctcaggcgggctctgaaacctggagcttttctgtggcagaagaaatgcagagcgggagttttgtaggcaatctggcaaaggacctggggctgaaggtgagagaactgtcctcacggggggctcgggtggtctctaatgataagaaacagcgtttgcagctggacataaacactggggatttgctcttaagtgaaacactagacagggaggagctctgcggttccatcgagccttgcgtgctacatttgcaggtgttaatgcaaaaccccacgcagtttttacaaattgagcttcaggtcagggatataaatgatcactctcccatcttctcggaaaaacaaatgctcctagaaatcccagagaacagtcccgttggtgctgtgttcttactagaaagtgcgaaggatttagatgtargaatcaatgctgtaaaaagctacacaataagccccaactctcattttcacattaaaatgagagtcattccagacaataggaaataccccgagttagttctggacaaggcgctggattatgaagagctcccggagctcagtttcatcctctctgctctggatggtgggtcccctcccaggtctggaactgccttggtcagggtggtggttgtggacattaatgacaactcccctgaatttgagcaggctttttatgaggtgaagattcgggagaatagcatccttggctcgctgattttgattgtctcagcttgggatttagactctggaacaaatggtgaaatatgctataccttttcccatgcctcagaagatattcgcaagacatttgaaattaatcaaaagtctggagaaattactttaagagcacctctggattttgaaacgattgagtcatactcaataatcattcaagccacagatgggggaggactttttggaaaatctacagtcataattcacgtgatagatgtaaatgacaatgctcctgaaatcactgtgtcatcaattaccagtccaatcccagaaaatacgccagagaccgtggttatggtttttagtatccaagatatagactctggggacaacggaagaattgtwtgttccattccggaagacctcccattcgtgctaaaatcttcagttgagaattactacacgttggaaacagagagaccrctggacagagagagcacagccgagtacaatatcaycatcaccgtcaccgacttggggatacccaggctgaaaaccgagcacaacacaactgtgytggtctctgacgtcaatgacaacgcccccrccttcwcccaaacctcctacaccctgttcgtccgcgagaacaacagccccgccctgcacatcggcagtgtcagcgcyacagacagagactcaggcaccaacgcccaggtcaactactcgctactcccgccccaggacctgcacctgcccctcgcctccctggtctccatcaacacagacaacggccacctgttcgccctcaggtcgctggactacgaggccctgcaggctttcgasttccgcgtgggcgccacagaccgcggctccccggctttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctattcggcgtgtgggcgcacaatggcgaggtgmgcaccgccaggctgctgagcgagcgcgacgcggccaagcacaggctggtggtgctggtcaaggacaatggcgagcctccgcgctcggccaccgccacgctgcamgtgctcctggtggacggcttctcccagccctacctgcckctccctgaggcggcmccggcccaggcccaggccgactcgctcaccgtctacttggtggtggcgttggcctcggtgtcttcgctcttcctcttctcggtgctcctgttcgtggcggtgcggctgtgcaggaggagcagggcggcctckgtgggaagctgctcggtgcctaagggcccctttccagggcatctggtggacgtgagcggcaccgggaccctttcccagagctaccagtacgaggtgtgtctgacgggaggttccgagacaaatgaattcaagttcctaaaaccggttatccctaatatccaggcaaaaggtcttgggaagaatagtgaagaaaactccacctttcgaaatagctttggatttaatttttagtaagaatgctatttacatttgcatgtacttttttagttttatgtaaccatatcaatattatttagtcttaaactagttacgttattatgcaatacgactaattgtatttttaattttttcttttctcccccaattttttttttttttttgagaccgagtctcattctgtcgccctggctggagtgcaatggtgtgatctcagctcactgcaccctccgcctctcgggttcaagcaattctcctgcatcagcctcccgagtagctggcattacaggcgcccaccaccacgctcggctaaattttttttttttttatctttagtagagacggggtttcaccacgttggccgggcaggttttaaactcttgacctcatgttccacccgccacggcctcccaaagtgctgtgattacmggtgtgagccactgcgcccggccttttttttttcttttcttttcttttttttgatacagagtcttagtcacccagactagaggtcagtggcaggatctcagctcactgcaacctctgcctcctgggctcaagagaccagcccacctccgcctccaagtagctgggactacaggcgtgcgccaccatgcccggctacttcttgtattttttgtagagacggatcgtcaccatatttcttaggctggcctttaacttctgagctcaagagatgcactcccctcagcctcccaaagtgctgggattacaggcggccaggcctattttcaattttcaagtattgcatatcattgtgaataacattgtaaatcctttttatattaagtaacaggtagttaatccatttctaatgaataattttaaggttttaatcctttccaagtgtacaataatttactgattattatttcttattctagaaaactgactttgatttttctcttaggttgttttgttttgttttgttttttgagacgatgtttcactcttgtcgcccaggctggtgtgcaatggcgtgatctcggctcactgcagtctctgcctcccgggttctcctgcctcagcctcccgagtagctgggattacaggtgcaccaccacacccagctaattttgcatttttagtagagacggggtttcaccatgttggtcaggctggtctctaactcttgatatcagtgatccgcccgcctcagcctcccaaaaagctgggattacaggcgtgagccaccgtgcccaggctcccctagtatttttcactgtctgcatcctatgatcctaaccacctgtgtattgtagtttcttcatgggagaagtcatatctgcccttccaaccttattctaacattctatttattcatttaaaaagccacatcatctagttctaaatcacagcatttaaagagaaacatttcattattaatgtgctcatggtaaattaaatattattttgtgatcaatattatacttcaatactaactttgtgcttgtattattttcttaaatatactacacttacttggctaatatttttaatgcttttgtgtgtgtatatatatatatatgagagagagagagatcatggcttataatccaaacaaaatgtaataaactgcatgaaaataaataggaatattaaaacattttgataattttgggatgaggatattggtggactgttggaaagatattcacttttccttttattttgtaaatttatttcattattttcaaatgtaaaaatcaagatgaactaaaggttgaaagaaaaacaaggcctgcctcagtggcttggctgggtgggttagatcacacctgtaatctcagcactttggaaggctgaggcgggcgggtcacctgaggttgggagttcaagaccagcctggccaacacagtgaaaccccatctacactaaaaaatacaagaagtagctgggtgtggtggtgcgtgcctataatcccagctactcaggaggctgagacaggagaatcacttgaacccaggaggcagaggttgcagtgagccaagatcttgccactgcactccagcctgggtgacagagcgatactccgtctcaaaaaaaaaaaaaaaaaaaaaaaaaagaaagaaagaaaagaaaagaacagaacaatattttctttaatttccagtctccttctattgagtggcttcttctagaattacctcaatacttctaaatgatatgtttttgctgttaaatcttgctactccattttacattttaatcacttcttgctatgtattttttaaaaaagatttaactttcttttcaactaatgtaaaccaatataagcactgcacattccctttctcctattctcccaataaaattgttacagttttttttttctttttgacagagtcttactctgtcgcccaggttggagtacagtggtgtgatctcagctcactgtaacctctgcttcccaggttcaagtgattctcctgcctcagcctcctgaatagctgggattacaggcacccaccaccacacctggctagttttgtagctttagtagagatggggtttcaccatgttggccaggctcgtcttgaactcctgaccccagctgatcctcctgcctcagcctcccaaagtgttgagattacaggcgtgagccacagtgcccagcctacagttttttttaagttaaactaatagtgtccatattgctaagctttcttcaaaatacacattagtgtagtgtgattaaatttcctttcttgagaaacatttttcctagaactgaaaattgttttgtacttacataattttccatttactaatattagtttctttacattctctaatttgaatctctttcttctcaaaatattcaaatatatcagatacctgtcaattatgtttatttcttggtgatcttgcacccagatctctacttcattcatactggttgctctataggctgtcaccctaggactttaaaaaatatttttctttgttggtccttttttataagatccagtacattcttctttcttagtttactcacttattttgttgatgcacatctctcagtaccttcataaaaatggatacagaggaaataaaactttttgagagcttgctttgttattttctttttttttatttgattgatagtttgggcataacattctaggttgaaaataattttccctcagatttcaaaagcactgctccttttattgactgcatatagaattgctgttcagaagactgattccattctgattcctatgtctttttatgtgattccccccctttttttctttctttctgtgagcattgaaaaaaattcccctggtcttctgaaaataccttagtactggctctttattgattaatctggttatatcgctatgccctgttcatgtttaactttttttttttttttaagatgatgtctcactgtgttacccaggctggagtgcagtggctattcacaggcacaatcacagcaccctgcaagctctaactcgagagctacttctgcctcagccttccaagttgctgggactacaggcatgtgctagaccccttggctaatgttcagactatcaattttatttctgagaaattttggttgggcatggtgactcacacctgcaatcccagtactttgggaagctgaggcaggattatttgaggccccgagtttgagaccaccctgggcaacatagtgggaacctatctctacacaaaaacaatttgttaaaaggaatttccttggtatgttttactcataatttctcctctgagttttctggattctcacttcaatgaaaatctcagttaaatattagacctcctagattgactctataagactataagccatttttcctttcttattttctctttgcctctcattccattttttggacaatttatttaatcactcaatgttttatgtataagtttttctttatgactgaaaaatatttacttttaagagttgtttttggttctctgaatgtttttcatggcatcctgtcatagatttataaatgtaatattttctctcatttataattaatcttttctttaaaaatgcattaggcagtatcattattatatatccattttaaaagtgaaagtgagtctaaggggagttaagaacttgtccaaggtaatatagctagtaaaaagcactgaagtcctaatctagtcttcatcttacaataggaatatgtacttcatatagttactatttagattaagtggataaatacatacttcatacagctactatttagattaaatggataaatgcattatgaggcacttagaacaatgagtagcatagagtaaatactaaataagtattagcttttattagattttctttctctgggaatattaaccagacattttcaaaggctttcttctgctttctatattattgttccttttttttttcttgatggtagcgatggtggtagttttggtctttctatgttatgttgcaggcatttcctcaaatgccttggctatcttctcgtattttagaaggatgatatatcaaaatgctgacaatcaactctgtgagcgaacagtacctgttgatggcagggcttcattctaatataaccatgctaggataagtctattaccttatgagatgccaaatattaatatgtgtcttcatttgggctttcatattctccaggttagaattctacaatatacactatggggatagactaggggtcaggcatacactttgtgtcctacagtctaagagtattgcatgaaaagggattagaagtctcaccatgcaaaatgcaaaggtttgcttactctccctattttcagtttgacacctcacacttgtgctcagctgtgcctagatccccaagactagagaaagtcccattaaatttctccagagaataaactttctattttctggctgtgagttatgtttccatctatgtagggtgatgagaagaacagagaattcaattatcctctacacatacttccaactaataacttttttccatccttaactgacttcagtcttcttaaacatctggttcctccagatcttgcgcttaaaagagattatgtttcttgtgagtatcttcaatgcaggaactttactttaggggcactttttggaactgctaagttaattgctcttccacctgctttctgtcatagaaaaatgtatgtgttcacttgtgtattcttaatctttgttagttcctaccattttaattacttttctgccattttagtgcatatttttttttaaaaagagaggttaattgtgtgtgctcaattcatctacttttcaagttttacccttctgtaccaattactatttcaaccatgtatccagcttacatttttaagaatattaattgaatttaacattttaaaatgcagacttgttggattcttctcccatccattcttagtgcactttaagactttctatagtgaatatcactgatgagcccttagcatctgttgcaaacagtctccctcattttgtaccaatgaggtactttggctaggactgaaaccttcccaagcttaagaggtggtcccagacaggattaaaacacagtaatggccagagacaggtctttagattctaggactaaaatctccaactataattctatacctcttgaaacaatgattgcttcagtggcagacacatgatcttacttggtctaattagagtgaaagttaggtttttgttctatgtttagggatagactcttactttctcttcctgggctgaaagagaaaacagatagctacagttgtggctacaataaattttgggaacctaaggcaagtcagctttaggaataagagtctgctttaaattaaactaacttgctcatgcttgtgtacttatgaatttttttgtaaattatgaaaaactggaactaaatgatgggtttacataacatgttccaccccaatctcttgcttcattttctgcctgttcacaattcattgctattaaggaaatctacagaagtgcctttttatgctgttgtgttgacctatatatgcctcatctcatggttaatccagtttcataacttcagaaaggatttctgagatgacctttcctttaccttatcacgtaaggaaagccaagtagtaatagaatttcattcagcttaacaatcacttataccctgcttgtttcaggcttacaattgtctcagaaacactatgaattcctgggagccagggatcacatcttgtatctgtgtttaccacaactgaacacatttggttgtgagaagagtggggaaagacactgaataaatgctttaaaacaaaatcatcatcacaaactataaagaatataaaacgattattatggaagataaaatatatttttaattacttcaacagaaggaattatttaaacgcaatatttatttgcttctggaggacatttatgtaaataaaatttaggtagtgttcatcaaactgtgaaaatctgtggagacgcgtggtggcgctgcaggataatatcaagaaaaaaattaccctggaggatgttgtagaccctgttatccagtacacgcggagaactgggaagacagaaagaacaatcctttaagggagaacctagaagccattcaacaaggttaaaatctttaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtagg

SEQ ID NO: 12515 - DNA, 91576 bp, Homo sapiens
aatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggactaccagtagatgggactacaggcacctgccaacacgcccggctaatttttttgtatttttagtagagacggggtttcaccatgttagccaggatggtctggatctcctgacctcgtgatccacccgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtacatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgagaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatagtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcgatcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctagatctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacacatatcctcattctctccttttcttctctttggcagtttgacaaaatctttagggggaattggaggaaacattaatctcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttcgaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatccaattcctcactatcctctcatacaaaccctgtgtaatacaagttctactcccataattctatgaacaaaacaacaattgatacatagatttgatttttaaaatacattttctttaccttattctaagtgtaacatagggtcaacatagaaaaagaaaactgaaaagcacaaggaaagtgaaatatctataatcttaaccattgttaattttgttgtgttccaaattagtgtatgtatatatatatatatatatatatatagcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgctcactcacattggctgacattttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacgcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggccgacatttacgcaggatctggctgcgttcccaaaagaagcgtgaatcgtgttttcgggattgagcccagtcagcaaggggagggcttactgggcgccccaggtgagggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttgagcccaggaggagaagactgcagtgagctgtgatcatgccactgcactccagcctggatgacagtgtgagaccctgtctcaaaaaaaaaaaaaaaaaaaaaaagccaaaaaatacatgcttaaatacaggcttattgtgcaaaatgaacaaaataaaaggacaactgtttttaatattttgttatatttccttctgactttattgtgtttcatgtgtatctatatccaaattatatttaggatcttattccatgtacagattgtacgttgcatttcttctcttaggaacattcattcaacgaatatgggtcttgtatgtctggtgctgttacactggtaggtaataacagacaattcctattttctttatcctttttttactatttgtttacacacgtacatgcaggaagataagcagggactttttttgctcattgttaagtgcttaatgccgggaacacagtaggcaatcaacagatgtttgctaaaatgtattgggagtggcagacattaaccaaaacataatagtaacaaatatattaaccagggaagtgttctggaggaaaggagtataattttctgacagcatttaacaaatgactggggggagggaaggctttgcttctcatcaaacagacaaaactctgccactttggggcatctgtgctttctgttccctcagtcctggaacgttctccccatgacctgctgcataaatgggctgtttcttctgcaagctcagctggaatgttaccgcttcagagaccttcttggaaccccccaactcaggttgaacacatacaacccagttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggcttagagcctaggaaaaagtccctcctgcctccaagaggaaggttctttaaagagctatgctcaggatggtctttctgttgtacctaaaaagctagggcagcagcagctgagggccagaaaggatctgtctcccctgtttatgttgactctgcagggcttccagtacttcagtcttgcatctcactgatcattaaaacgttcattttgaaggagggtgatgggattagggagcagtggtgttaagaagaaaacgaaaggacttttttttctttttaaagattaatgtttagaataggcttagtactagaagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtgacagagtgagacccggtctcaaacacacacacacacacacacacacacacacagacacacacacacacacagaaaaaaaaaaaaaacctggaagttgaagaagataatgaaagcaatttgaaatagaggaacatagaattataaaatgaatagggtgcaacatggaagataacaaaactaaaaatgaagagaaggaaaaataaggttaagtttgaggttgatagggttaaatcaagacaggtatgaaacctagagaaagtaaaaatgagaactcacgatgctaggcagagagaatacatgaattaaaataaacattcaatttttggagcaactcactctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggagataggcagcacaagaaatggctaaatcttctttctccattgttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataattacctgagagatccatgcaggggagagtccaggggaaggtgactgatcactgcttcccagggggaggcagaaaatgcttcttggaggagatgatgggtggattaaagaagacaagagctgagcaggagttgtagctaccggccagggaggaagggtattcagagcagaggaagcaaggtgagcaaaggcaccaagatgtgacactgctggactgccaagctattcagtgtggcagagtagggtaaaggagacaacaaagaagggagaggaataaatcacagggtgagcagttctaaaaagcaacagtcttgtcaggaataaacaatcaccatcgtaaactcagactttgrtattattccctgtccttttagggcagcttgagcccttttgtttgacttagcacaacgtgactccaaactagggttgttttaatttcccragacacagtagtaggcaatttcttgaggacctaattgcagatagagtttgtcggtctcagcatgtgggagctccagatgaatggcagtaatgggaagcagtttggtagtggttcagcagtgtggcctgggaacctagttgactggcctgcctcctgggtctgccaacctaactggaatgtattcttgggttctgattgtgatgggatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggatggagagatacccagctaggaggcagctggttatcagtggtaatgaagtcacagaagtgtatatattctcccagggggacctgcagaatggaatcacaggaagtcctcctacagactcatcagggatattaccttggtatgagccagaggacaagctgaaaaccagagtggtttgctctcctaaaagccaaggagtgagaactcttcaggcagaagagagtgagggcagagtgatcagtagctctcacgttatcaagagggtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacagagtctcgctctgctgcccaggctggagtgcagtggtgcaatctcagctcactgcaacctctgccacctgggttcaagcaattcttctgcctcagcctcccgagtagctgggactacaggcgtgtgccactacacctggctaattttttgtatttttagtagaaatggggtttcaccgtgttagccaggatggtctctatctcctgacctcgtgatccgccsgcctcggcctcccaaactgctgggattacaggcgtgagccactgcacccggcccagtgtagataattcactttactaaaactcacctggaactttggggaaatttctgactgcacctatcttatgatataatggcacctactgttgaggtatagtattgtagcttaatattaattataatataaaatatctagaaaaaataagtcaagatactgtttttctgggggtaggcatgtttagtttgaaattttccataggaagaaattcagtcctctgaaaacgtattgccaataagtgcattgcaggacatgatatataaagaaaatattggacagtgtatatatggagaattttagaatttagaatatgacatgaaatgaaggtgagatttcacttggttagaattttcttgaccagtctctcaacctgaggcaggaccatgaccagggagtaagaaaagaaatgctccttggagatcaaaatagatctatctactttggtccttccactatagaagaggcctttgcattctgttggccctttaggcttttacttgatgtctccatcatcttattttgcaagcccacagataatttgaggaagatgagttgccgcagtagaaatgatagggagaaaaaaaaaactacaaaaaacagaaataaaaaattctaaaaccacagcaatatagtagctttattataggacatgctggataaacaatccaacagctacctcagggagcttctgagagaatgcatgatgcaatgatcagtgaggcaagatcaaattgtgtttgatgttcaagaaaggaaaaacaattcatgtaagtctatccaaagtagtaaatgttttatatttaagtagtgtatattcacttgtcagatgctcagttcacttatctgaaacctatgaaataaagtcttatattttagaatatttgagttcatatttattttaatctatgaaatccactacatttacttaataatcacctcttaccataacatttcttgagcacccacaaggtgggtagagtgtagtagaaaaagaagaacatggtccttgacccccaggaacttgccttttaagagaagacaccctgaagtgacaagctgttataagttagtgttttaaactatggaagaacaatctgagcagagtgctctatactgtagatgacttcttagaggagaagttacttttgaaatgaatttagaaaaatgtggagaaagatgcatccatatatattttaagatcaaagacattaatgctgtctcttcagtttattgtcgaatgtttattcccaaacaaaccaaaagctaataggatgttacttaaaacatgcaaatcccatttcctccactactaccagcactcaggtaaaagcatggaacagtcatttaaaatcttgccaagggccttcctattttttctgtactacctgctgccagaccacagtccatggctgatgaaagtgatatcagtacttcatcttcatgttcctattctcttatccctagatgcctatgaggagccaccaacatttgaagctatggagctcattggtaaaccaaaaccctactatgagattggggaacaagtagattataagtgtaaaaaaggacacttctacgtacctcctcttgccacccatactatttgtgatcggaatcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctccaagaaatctttttcttggcaatagattgcctgggtgaacatgaaactgaaatttgcccttataataggtaaagaaagaaaataatatgcccwtgcattcaaarycgcaatgcagaattttgaccttgattccaatctgtttagaaactggattgaaaaaatctcaaaattattttcttttaggaaaaacatgtccatgtataggtgatcctttacatggccaagcagtccttgcaaatgggacttatgagctaggttatcagatacactttatttgtaatgaggggtaagtaagttcctccttagaggaaataaggaaaatgttagtaattttattttcgttttgcttctcttcttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaagctctcagttgaaaaaccttatttctgagactgctacaatgtgaagcatctcaagaacaggcactgagcactcggtaatagcctttgttctgcaggacttttaaagtcmtrgatattggggatactggacatttaagtgaaatgtgcttttagagagtaaatgtaattttcatagattttctattgctataacacaatacgtgagactagataattcataaagaaaagaatttatttggctcatatttctggaggctggggaattcaagggcatggcagtagtacctggcaagggctttcatgctgcatcagaacatgctggaaagtgaaagggaaattcagcacttgcaaaaaagacaaagcacaagggaggggctctcgctttataacaacctgctcttgtggtaacgaatccaagcctacaagaatgaagatccactccctcaagaattaatgaagaccctctagaaaggcattatccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagtttttaaaatttggtcaagtagaaatattggagtattcaattaatagttacatagagcttgctaggcactatgagggataccaaaagtttaagacatggaccctcctaaaagaagttctaaccttattgagaaacaatatatactgagaggtatcaaaccaaaatactaaatgagaaataccaaataatagaattaatcatgttattacactaagagtccagaaggaggagagattcctgtgaatttaaatcagggaagatttcactgagtataggtgtatactcaatgaaagtattcctatactcaatgagctactcctagaaagacattctgttctaaataatattaataggagctaaaactcgtgtagcactcactatgtgccaaatgctaacttatctaatctcctaaacaaccccacgagctatgtactgttatccccttttaatcaattaggtaactgagtgagaggaactttaagtgatttacccaagctcaagaaactagtaagttgggaagcagagactctaatccaggcattccagctctagggcctgttctctctacagtcttgtccttactgagcaaagtcgtgtgagaaaacgcacagaaatgaatgtgtaatgtgattgcaggaggcagcaaagaggctgggtggaacggcacagcagatttatttagatgtttttgctctcggccaatatacgttcaaatagagaaactctttatttgattaaattgcagatttatttagcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattacttaattggtaaagaaattctatattgtgaacttaaaggatcagtagcagtttggagcagtaagcccccaatatgtgaaagtaagtaaattcttttttttttttttttaattcagaccagtagtcctcaaagattttttgcctcagggcaccttttacattttaagattaacaaagatcccaaagaggtttcttttatgtgggttatatctrttggtatttatcatattggaattcaaactgagagattttttaaataagtattgattctttttgtttttgtttttgtttttcctaagagagggtaccagtatgtttcccaggctggagcacagtggcacaatctcaggtcactgcaacctcagcctcctgagcagctgagactacaggcatgtgccaccatacctggctttttgtaacttttgtagagacgtggttttgccatgatgcccaggctggtcttgaactcccgtgctcaagcaatctgcccccgtgggcctcccaaagtgctgggattacaaatgtgagccaccccacctggcctgattaatttgtaagaatagatgcaatacaaattaacatatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctcaggcctgtaatcccagctctttgggaggccgacgcgggtggatcgcgaggtcaggagatccagaccatcctgtctaataccctgaaaccccgtctctactaaaaatacaaaaaattagccaggcgtggtggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatchctatacacttataaggatgagagtgaaaaaagacaatatkttggtggtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactgggtaatttataaagaaaagaggtttaattggctcgtgattctacaagctgtacaggaagcatgatgctggcatctgctgggggtttggggaggcctcaggaaacaacaaccattgggaaaggcaaagggggagcaaggtgtctcacatggcaggagcaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgagatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaccagcttgtagaaaccctatattgacaaattcactgaagacacagaaattttactaatgctgccttaatcttttacatttctttcctctttttcttcaattttaagagattttgtgcacatgacctccaaaaataaaaaatggaaaacacacctttagtgaagtagaagtatttgagtatcttaatgcagtaactgatagttgtgatcctgcacctggaccagatccattttcacttattggagagagcacgatttattgtggtgacaattcagtatggaatcatgctgctccagagtgtaaaagtcacctttcaatttatttccttcttcatctgtaagtactctggaaatattttgtaaatagttttatctacaaataaagcaggtgtatgtgcttcctcctcctgtgtaattggatctaatttattttaatacaggtcaattcaagccaaaaaatagttctagctagagttctctatttttcacccccacatgttcttgggatttcatttcatacagtgtgaactactgtgtaatctgcatgagttagaagtttttgtttgaaagaccaaaaaaaataataaatcaacaaacactggcttaaaaataagaaaggtggttcttgtattacaagaaatctaagagttctggctttggtagtggtagactgtaacagactaatgctctcaccaataaaaatgataaactctggataaaaaataattttcttaaagaccagagtgaccaaaagtatgaagactccacaggggacttgcccgtttaaacaaagaaatcacagaataacagtgatttaaaagtatatacttcccaagtatgcatgaaacattctccaaagtagaccatattctagacaataagacaattttccacaaatctcaaaaaattgaaatcattcaaaatacattatctgatcacaacagaatgaaagtaggaatcaacaacaaggccaatccccaaagaaatgaaaagtatagaagacactcctaaataatccatgcataaaaatagtagtcagccgggaaattagaaagtgttttgaattgaatcataacacatcaaaatatccaaacatgtaggatacagctaaagcattgcttacaggggaatgtatagcataacatacttacgttagaaaaaaaagaaaagcctcaaatcaatgatttaattttccaccttaagaaactaaaaaagaagagcaaattaaatcccaaactagcagatgtaaggaaatgataaagatagagccaaaatcaatgaaactgagaagagaaaaaaaaaaatagagaaaatcaatgaaaccaacagttgctacttggagatcaataaaatgtgtaaacctacagccagactgacaaagaaaaaaaagacacaaattaaccaatactgagaatgaaagaagtggtggtcaagcacggcaccccagccagcttgaagaccctgcactcctgcagctggcaggggcagtcactcctggacttgtccttttagaagctccagctttaccacttgctggtggagcccaaccactgccgcagggtcctcatcaccaacacgcctggcagatccaagaggagatggcccaggatgggatgtggtgaacagcagcacccaagagtgtggggtgcgtgtggctccactgcctggtttctgcagagatcctgtgccagtgccctgtgcccgccacacaggagccagagggggagcaccatgccccccacttcggagactgctgcacgaaggggccaggtatcagacctttgctgtctcacctcagcactggcaccaggagccctgcaaagcagcatctgggagatggacagccagggggaaaataaaggaagctttcagaagtggctagatgagatatttgaaatactgaaaactaaaaatcccaactgcatggaagagctggcctcagatgtggtcagttcttacgacaacctggacacacagtgctgacccgcatgatgggatgcaccaagctgggcccctgcaacgcacttggaggcttggccctgccaccgccccacctcccagctccagctacaattgcagtctgacctgggcaagcaagagcacatggtggagatcctgatggagacctgagccacacgtgccacagtgctggccagacatggaggatgggatcccgccaagggaactctggccagcctgtagcccactgcccagccttgccggctcctctgctgattcctgcatggtctgcagccccaggcccattcccttccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaagttttgtatgttttgagcaataaattgtcttaagatatatattttaggttgcttcaagatagctgaataggaacagctctggtctacagctcccagtgagatcaacgtagaagacaggtgatttctgcatttccaactgaagtacctggttcatctcactgggactggttggacagtggatgcagcccatggagggcaagctgaagcagagcgggatgtcacctcaccaaggaagtacaaagggtcaggggacttccctttcctagccagggaaagctgtgagtgactgcctggaagaacagtacactcctgcccaaatactgtgcttttcccacagtcttcacaaccagcagaccaggagactccctcctgtgcctggctggggaggtcccacgcccacggagccttgctcgctgctagtgcagcagtgtgagatccacctgggatgctggaacttggctgggggaggagcrtccgacattgctaaggcttgactgggcggttctakgctcacagtgtaaacaaagcgccagggaagcctgaactgggtggagcccactgcagctcagcaaggcctactgcctctctagattccacctctgggtgcatggcatatctgaacaaaaggcagcagacagcttctgcacacttaaacgtcccagcctgacagctctgaagagagcagtggttctcccagcacagcattcgagctcctataacggacagactgcctccccaagtgggtccctgacccccgtatagcctaactgggagacacctcccaataggggctgacagacacctcacacaggtgggtgcccctctaggatgaagcttccagaggaaggatcaggcagcaatattgactgttctgcagcctccgctggtgatacccacgcaaacaaggtctggagtggacctccagcaaactccaacacacctgcagctgagggacctgtctgttagaaggaaaacaaagaaacagaaaggaatagcaggtggtgatatcccctttatcattttttattgtgtctatttgattcttctctcttttcttctttattagtcttgctagcagtctatcaattttgttgatcttttcaaaaaaccagctcctggatccattgattttttgaagggttttttatgtctctatttccttcagttctgctctgatcttagttatttcttgccttctgctagcttttgaatgtgtttgctcttgcttctctagttcttttaattgtgatgttagggtgtcaattttagatctttcctgctttcttttgtgggcatttagtgctataaatttccctttacacactgctttaaatgtgtcccagagattctggtatgttgtgtttttgttcttgttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctgttcttttacatttgctgtggagcgctttacttccaactatgtggtcaattttggaataagtgyggtgtggtgctgaaaagaatgtatattctgttgatttggggtggagagttctgtagatgtctattaggtctgcttggtgcagagctgggttcaattcctggatatccttgttaactttctgtctcattgatcgtctaatgttgacagtggggtgttaaactctcccattattattgtgtgggagtctaagtctctttgtaggtcactaaggacttgctttatgaatctgggtgctcctgtattgggtgcatatatatttaggatagttagctcttcttgttgaattgatccctttatcattatgtaatggtcttctttgtctcttttgttctttgttggtttaaagtctgttttatcagagactaggattgcaacccctgccttttttttgttttccatttgcttggtagatcttcctccatccttttattttgagcctatgtgtgtctctgcacatgagatgggtttcctgaaaacagcacactgatgggtcttgactctttatcctatttgccagtctgtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttccttcagaagctgttttagggcaggcctggtggtgacaaaatctctcagcatttgcttgtctgtaaagtattttatttctccttcacttatgaagcttagtttggctggatatgaaattctgggttgaaaatyctttyctttaagaatgttgaatattggccctcactctcttctggcttgtagagtttctgctgagagatccgctgttagtctgatgggcgtccctttgtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgttttccaacttggttccattctccccatcactttcaggtacaccaatcagacgtagatttggtctttccatatagtcccatatttcttggaggctttgttcgtttctttttattcttttttctctaaacttctcttctcacttcatttcattcatttgatcttccatctctgataccctttcttccagttgattgaatcagctactgaggcttgtgcattcgtcacatagttctcgtgccatagttttcagctccatcaggtcctttaaggacttctctgcattggttattctagttagacattcatctaattttttttcaaggtttttaatttctttgccatgggttcgaacttcctcctttagctcagagtagtttgatcgtctgaagccttcttctctcaactcatcaaagtcattctccatccagctttgttcctttgctggtgaggagctgcgttcctttggaggaggagaggcgctctgatttttagagtttccagtttttctgctctgttttttccccatctttgtagttttatctacctttggtctttgatgatggtgacatacagataggtttttggtgtggatgtcctttctgtttgttagttttccttctaacagtcaggaccctcagctgcaggtctgttggagtttgctggaggtccactctagaccctgtttgcctggatgtcagcagcggtggctgcagaacagcggatactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctcttcaaagctgtcagacagggacatttaagtctgcagaggattctgctaccttttgtttgtctgtgccctgcccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcgagactccgtgggcgtaggaccctctgagccatgtgcgggatataatctcctggtgtgccgtttgttaagccattggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagttggaaatgcagaaatcacccgtcttctgtgtcgctcacactgggagctgtagactggagctgttcctattyggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactgggcagttttatctggcaatagcaactaaatttatagcaactgaaaggcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcrgcagaagcaagagactaattgtaggaagagcattagcctgcgyagactatgcttaattaacatcatttctgtggtcttcagtttccatttagtttaatgagattgttgaactcaaatctcaatcactggattctaatttgtttatatatttcctatctccctaatattttaaaggatctaggggaattatgcacgttaacatagtaattagaataccattttataattcctataaaagcctgttaactggtagcctccttagttgagtcctgtaggttttgaggggcaggaagagatggtttttttagtggactgatatatgagcaaaacaagattgcatatgaatttaatactcaataaggtatccaggcttactcacatgctcctagtgggtatatgtactaatactaagtttgttgatacagtcttttgaaagagttaactataagcatttcataaagtgtttataaaacactgatctagcttagtgtttgagagcagaggagagaattgcttgtgagaaaaagtttataaaaaagagaaactacaggggtattttttgaaaaatgacaaatcaaaattcctcatgggattgtcagtcattttttgtcatcagtaagaggaagaataaatagcaagataatgatgttaaggtagatctaaatgtgctaatgtgaaaaaatgtccaggaagtcctaagcggaaaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgaracggagtctcgctctgttgcccaggctggagtgcagtggcatgatytcggctcactgcaagctctgcctcccgggttcccgccattctcctgcctcagcctcccgagtagctggggctacaggcacccgccaccatgccaggctaatttttttgtatttttagtagagacagagtttcaccatgttagccaggatgatcttgatctcctgaccttgtgatccatctgccttggtatcccaaagtgctgggattacaggcgtgagctgtagtgaccattcttgtacatgcatccttacatacttgtgcaaatatatatgtagattaaattatttttttttctagttggagccttgctctgtcacccaggctggagtccagtgacatgatctcggctcactgcaacctccatctccagggttcaagcaattctcctggctcagcctcccgagtagctgggattacaggtgcgacaccatgccaggctaatttttgtatttttaatagagatggggtttcaccatgttggccaggctggtctcgaactcctgacctcrtgatccaccygcctcagcctccaaaaatgctgggattacaggcgtgagccaccatgcctggcaaagaatgacactgggtgtattaaaaagtatgataagtgacatgatcacagtagacatttcctccaatagaatattgggagaaagcctaatggaaaccaatgaaaaataagaaacacacgtagcctttggaacatagcctttctcacctagtggaggaggagctgagacttgagtaagacagtcagatgaagtaaggcagtattcgggaatgtttgtgtgagctaagactatacatcctgagtgatacacgtgtgttggaccatgtatacatgggtctccattagtgaagccgcactgagtagagaatagttttctacctaaagcatctttactccatgatgaatcagttatgcatggaggagaaagagctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggtttatggctataactgtgttttgacataattggctttctttatagtcctacgtgatttacttatrcattacaaaaaacagctctgagaagggattcataattctgaccagccaggcaaaggtgtatacatgatacataaagatattaagaacccctcatgactattcacaatagcaaagacatggaatcaatttcaatgcccatcagtgatagactggataaagaaaatgtgctacatatccaccatggaatactatgcagccataaaaaagaatgagatcatgtcctcttcagggacatggatggatctagaggccattatccattgcaaactaacgcaggaacaggaaaccaaatactgcatgttctcacttataaatgggagctgaatgatgagaacacatggacagatgtgggggaacaacacatactgggatctattggagggtagaggataggaagagggagaggattaggaaaaataactaatggtactaggcttaatacttgggtggtgaaataatctgtacaacaaacccccatgacacaagtttacctatgtaataaacctgcacatgtacccctaaacgtaaaagttaataaaagaacccctgcatggatatggatcatgtatttccattcagatcttcctttcattaattttacatgcccctcttcaacagtctcattgattcctgtgattttgaccatctcccatccattatcttttacaaaagtcctcttgtgccttttttggaagtccattttcataatcaacaaattacctatattcccaatcttttcctaaacattctcacacctcctggccttcactaaaccccatctgtcccatgcccacatctttctcagtttaaaaaacaacaacaatgaaaaactttcgctgcttaaccttgatggcgctatcccttccccacccaatggtttcctattgctactgtaacaaattatcttgtggtttaaaacaacacaaatctattctttcacatttcaggagatcgtaagtccacagtgagtcttacaggatgaaaaccaaggtgttgaaaagactgactccttctgaaagctccagtggagaacctgtttcttgcttctaaggggcactagcattccctggctcatggcagcaacactctgagctctgttttcatcattaccttctggtctattaccttcctcttataaggatccctgtgatcatatcaggttcacctagctactccaagatactctttccatctcaatatccaactgcaaagtcctaaactgcaaggtaacactcacagattctgggatgtaggatgaggacattttgggggaacattattcagcctaccacgcactcctccttttctctcattcttggattgttttttattgttattttttaaattggctcataatgattgtacacatttatgggatacagcaaaggaaacaacagagtgaagaaaaaaacctacagaatgtgagaaaatgtttgcaacctatgcctttgacaaggggttaatatccagaatatctgaggaactcaaacaactcagcaaaataaaacaaataatattatttaaaagtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaatagagacctcttatacactgttagggaatccaaattaatatggccattatgggaaatagtatggaggtttctcaaaaaattaaaagcagaactaccatatgatccagcaatcccactactgggtatatacccaaaagaaaggaaaccagtatgatgaaaagatatctgcactctcacattcaatgatgcactattcacaatagccaaggtatggaatcaacccaagtgttcaccaatggacgaatggataaataaaatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggttaccagaggttggggtagggagagacaatgggagatggagagagattggttaaaggrcacagggtcacagatacataagaataaattcayccttgaatacttaaccctctgccctacatctgtcactcctacatccatattcattgctaatcctggggctaactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaatctagtctccatactatacacagatttacattttttgaatatatatctaattgtccttccctttttaaaaatcttacaatggcatgacatctcaattcacgataaggaaattggttcttcacattccctgtgcactgtacacatcgcctgcaattgcccttcaacacagagagcaggcatttcattagctgaccttcccacacacattcttgcaaagaggaaaagtcaagcagggtgtttggaggtgagttgccatcatccaccgcctttgtctgkaaggaagcgyagggcctcacacgcgggatccatcggaagcccaagcattgtcaagctctgctgctgcacctgggtcagcaaggtgggctctgccagcgaaactcgttagaaacaatgcaaatggggagtaaacatggccttgcccatgaaggggaagctggtcaaaagcattttgtcccggaaccccgcagccctccccatgctctgggcgcggagcacaaggattggtcactcctctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcgctgcctctaggtaagcgtggagttcccacgtgcaggggcttaagtcgtgacgagcgcagtggaaggcgcagatgctgagcgggtgccgcacgaaattccttgcctttgtgtattcacagcctcggctggctatagccgagcgtggcgtcgatcctagcgaaacgggacttggggatccgacaaacctgagttctggtcctagaaacttaactgtgaggcaagttagcacacctaagtctgtttgctcttctgtaaaatggggacactggtatctctgcattgtggagttgctgcctcagtggcataaagcctgtcgagtatctaacacagggcctgtccccgagtccatttctatcccccaaccgttacctctgcactttgctcccagtggtgtttagacaagcagtcctagggatgtcctgcatggaactgtcctcgtcccctaccccaagccaccaccgccatcatcatgatgcacttgattgacagcatactttaagacagatgcatgccaggcacttggggattagaagagcaagggaagccccagaacatgcaatgtaaccgctgcaggtagaagggacagtagatatgtttacaatttgcattttagtgatgtgtttagtacaaaataaagcctattataactactatggaaattttgaggccacatctcttcctttttttaacttcaagtaggtaaacatcttcagttagaacccttctattattagttttgggctccccagaagtcttcttggttgcctagactcactggcaacatctcacttgaagtgacagtcttggttgttttggtcctgtctcttcctgacaactcagggttcgtccttctctgccactagacgttttgcattcattatttgagtgttccttcttctctaaaagagtaaggggaaaagaaaaccaagttcccccaagagttgttattaatatttgatcttcttaggcaccagaaagtaacctgtctagtgaagagatatgataaaacttacaattttatttttaggagagaagcatgcccagtaagttaagcaatctgttgtcagtgcttactgaggttctcacaataacctccaaatgtgaaacagcctaaactaaactacctagaaattttgttgctggagtaatttcaattttaaaatgcttatggatgcttccggtgtgcacagtcctttggaatttaaaagaaatgtaagagaaagagctatgctcccaaggtgtatgcatatagaagtaggtggtggagttttatgaaatctactttttaggaagccagtgttctggtttttccagactctgctacttaccaactggggctgtggacccagcaacttaagtcacatcactgaccttcagtgtccacgtgtataaaatgagcatgactgacatcctgatttctgagagaggtattttgaaaatcaggtggggtagtgcatgtgacagcgttttgtaatctgaaaaccctcatgcatgtctgaaaaaccatgactaagcagtcgtgcaggactgcaggatcactgaaaagggagaaatctcaactcctatgatcaggaaagggtgagggaaaagagtatgactttactagcacttgaagagtgaatccagaaacaggttgcataggacagtttatgggaatatttatatataaaaaataacagaggaactaggattgttttgtcattagagggtactcctactacccatgaagtggtatggtgctatttgaaagagaacttagattagctgcaaatagatattgcaaacttagggcaactactgaaaaaagtgaaaaaaagaagtacaattgatatgccagtaaggaagagtgaattgcatcatataaaatgctcagttaaaacaataaacggggccaggcgcagtggctcacacctataatcccagcactttaggaggcagggtagataacttgaggtcaggactttgagaccagcctggccaacatggtgaatacccatttctacaaaaatccaaaaattagccgggcatgatggtgggtgcctgtaatcccagctactcaggaggctgaggcaggagaatctcttgaacctgggaggcagaggttgcagtgagccgagatcatgccactacactccagcctgggcgaaagagtgagactctgtctcaaaaataaaaataaaataaaataaaggtcaggaaaagaatgcaagacaaaaaatagaaacagagaacaagagaagaaagacaacaaatagaaacaagtaacatattaaaccaactatatcaaccatcattttgagtgtcaatgatctaaaggcaccaattgaaacagatcatcagagtcgatcaacaaacaaaactcaactatatattgtgtactccctataagaccattttaaatatagacaatatatattaaaagtaaatgggtaaagatataccatgctaatgctagtcacagaaagcaggagtagctgtgttaatttcaaacacagcagacttcagacgaaggaaaattattaggaataaagagggtcatcatataatgataaaggggctaattctccaagaaggcataacaatatctaatatgtatccatctgacagagaaacaaaatatgtggggcaaagctgatagaactgcaaggagaaatagatgaatgcactatcatagttggagacttcagcacctttatcttttctgatatcagaaaagataaaggtgctgaagtctctttatcagaaatgggcagattcagcaggcagaaaatccataaggacatacttgaactcaacagcaccatcaatccacttggatataattgacatatacagacgacttcatccaacaacagcaaaagacattctctggctcacattcatggggatagaccacattgtgagccataaaaatagtatgctaattaagctttaccagggagtgtttaacatagggtagactctggcgccctcacatggtcctcatgtaggatctgatttggttttccctgctaggtaaaggtgcaagatagaaagaagggtaattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaagtatcatgaagacagttgaaatacagctttacattcactattgtgaccagaggaactcactgtggctgttttttgtccccttagatgtcaactaatgattgtgttaagtgatcatgattaacagagcatttaaaatgtttattttatctgttttacatttcaaaaatttatatttaggcatataatttatatatttgtgtacatatataatttattactttatatttttgaaagtgcatgctctttttttaagctgacagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggctgagtcatacaagaaaaaacccgaaatgagataacaaaatatacccactagaatggctaaaatggaaaagattgaccaaaccaagtgttggcaataaagtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaattaacatatatttatacaattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacaggtcgaaggttgcctagagaaggaagtggatgtttggatgcattacagaaggacatgagggaactgtgtggggtgaagggtatgatggaaatgttcattgtcttcatttggtgatggtttcacagggcatatatataagtaatcaaattgtacactttaaatactcatcaaccattttatgtaatacatcttaataaagctataaaaactttttaaacttatggtaggtcttgagtttatggagtttatattaatatatttatcataagaaccagccacaaattgagggattggtaataaagagggaaaggaaactacatcaagcattctttgttgaaggctcatatgttccttttttgggctactaygcaaatttatattattacctatactatgcatwtactactataaaggtaagaatattaggtaattaaggggaaggaacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagacccactaaatcagagattctggggacatagcgtggactcttcatttttttttaagttttataagtaattcttcaattatttgatcattgcaacaaatatgcattgagtgcttataactgagtgttaagcacaaggactaggtattaatttagaagtacaaaaaacatgtcatcatttgccctcaaattatacatatctaatatcttttgagagaaatagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatagacaggccagggaaggcttcgataagaaggtggtattttagcaaacacctggaggaagaattgaagtcatagccaagataaaagtgcatcacacaaaaggaatgtcatagacaggggaaaaatgtgtgtcttcaggaaactgaaaaaggggaaagggccaccacaccttggtgaggggacccagtggtaagagatgaagcaggaaacatagacaagggcatctttgtacaaagccaaaagttggttcttttaagtctaataaaattgacctctggcctcaatctacccaattaattagtggaaggtgtgggaaggaacagaaatgaaaacaaaacaaacaagatatttccaaaactagagtaagatgctattctttttcaacagatatatcttcttgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacattggtggctgctactgagggccaaagaggagatgtgtactcccactgaatctgagtgtccactgagtgtgaaggtggatggtaaaatgcatgagtgtatcttacactcatactttacaagaaagtatgataaatgaggatgggagagaagctacaacacaggcacttactgattaactaaaatttgaagctgtgaattgcagcttcccctttagtgaaagatgatataaatagcttagttttcttcaaactagcagagactttttaaatggatggatgctgattttttttttaaaaaaagagcccatttctaaggcatgttttaaagcaggtgtcctcaacccctggggcataaaccggtactgtccggtggcctgttaggaactgagcagaacagtaggaggtgagcggccaagcattactgcctgagctccacctcctgtcagatcactggcagcattagattctcataggagcagaaaccctattgtgaactgtgcatacgagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgttaagatggagtcttgctctgtcacccaggctggagtgcagtggcacagtcttggctcactgcaacctctgcctcctgggttcaaatgattctcctgcctcagtctcccaagtagcttggactacaggcacatgccaccatgctctgctaattttttgtatttttagtagagacggggtttcaccatgttggccaaactggtctcgaactcctgacctccagtgacccacccaccttggtctcccaaagtgctggaattacagacatgagccaccacacccagctcccttggctattagtgaagtcttctttttcttttttgatcacatctatgcagtatatttgagagaaagaggaagtagagtgggaatttcagcagggcatggtggctcacacctgtaatcccaggactttgggaggcagaggtgggcagatcacctgaggtcaggagtttgagcctggccaacacggtgaaaccttgtttctactaaaaattcaaaaattagccggatgtgatggcaggcgcctgtaatcccatctactcaggaggctgaggcagggagaattgcttgaacctgtgaggcagaggatcgcaccactgcactccagcctgggtgacagagggagactctgtcacaaaaaaaaaaaaaaaaaaaaaaaagtatggtaatttctccattaacttcgatgctgctgtggtcttgatccccagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaaytcagtctggacaagtgctaasgacaagtgcaaacgtaagtaactctggagtgggaaccyctctgttagtcaaacatctgtaagatctgattcaatttgttcaaattttgtaactgagttgcatacaacaattagtttgctaaggtgcaatacatatgagaattattcttgtagatcataccttgttactgctttgagttcctggcaccttcattacaagtttatttcatgagaaaccgtcattgcaggacatgattgagggaaaayccccattcactgggggtctcccaytttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcatgtgttcctcagtaagctataggcaggttgagaccttatgtactaaaaaaaaattcagtttactctacttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcatatatgaaaagtgtggcattcattgggtgggaaggaagaaaatgggggaagagtatagtcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatcaagatattggcagagccagagccagatccatagccatgctccctccaaaacctgtagggatggatccttctttgcttcttccagtttctgaagccccaggccttggcgtgtggcagcagaactccagtttctgtctctgtctgtcctcacatggctgtcttccctctgggtctctgtcctcctatgctgttctcttatctgtgcatgtctgtgtccaaagttctttttttttttttttgagatggagtctggctctgttgcccaggctggagtgcagtggcgagatctcggctcactgcaagctccacctcccgggttcctgccattctcctgcctcagcctcttgagtaggctgggacaacaggtgcccaccaccatttttttttttttttttttttttgtatttttagtagagacaggatttcaccatgttagccaggatggtctcgatctcctgatctcatgatccgcccacctcacggcctcccaaagtgctgggattacaggcatgagccaccgcgcccagcccaaaattctctctttcaataaggacaccagtcatattggattgcggcccacactaacaacttcatcttaacttgattgcctctgcaaagaccgtatttccaaataaggtcacattaataggaactggggattaagacatccatatatttcaggggtgaggggaacataattctcatgcattgctggtaggaatgcaaaatggcaccatgactttgaaagacattttggcagttttgtataaaaataaacatactcttaacatattatccagcagttatcctccttggtatttatctaaaggaattgaaatctcaggttcacacacaaaaaaatctgcacacagatgtttataacagctttattcataattgccaaaacttggaagcaatcaagatgtcctttagcaagggaatggataaactgtggtacatgcatacaatagaatattattcaataccaaaaagaaatgagctatcaagccatgaagagacatagaggaaccttaaataatgaatcttctttcactattactaagtgaaagaagccaatctgaaaagcctatatagtatatgattccaactatacaccattctggaaaaggcaaaactatagagatgtaaaaagatcagcagttgccaggggttagggaagaaggggatgaataggcagagcacagaggattttgagggtagtgaaactactctgtatgatgccataacagtaggtacatgtcataataaatttatccaaagtcatatgatgtacaataccaagagtggaccctaagataaactatggacttggggtgaccatgatgtgtcagcgtaggttcatcagttgcaaaaaatatttaccaccctggtgaaagatgtttataataggggaggctatccatgtataggggcagggagtatataggaaatctctgtatcttctgttcattattgctgtgaaccaaaaacttgtgctaaaacacaaagtctatttttttttaaactacataaaagtaaatacacaggcacatgtgcataaacagacacgcacacagtcgagtacaggtaaaacaggaaatttgaacaaaactggtggatcatacctgtctcaatatcttgagtttgatgttgcactattgttttgcaaaatgttattattaggggaaaattgagtaaagtgtacctgggatctttctgtgctattccctacaactgcatgggaatctgattatctcaaaataaaawwwttttttttttaagttactactaaatttccaagggsatgggcttcctaccaaagaattgtatattgtgaaattaaatcattcgaacttaaaacaattcaaacttatagctgggagaactttaaattattctgagccatgagaagactgtggctatgcagcctgagtcatgcagcaggcagctgtaacttctgcctttttatcctgtgaatagttaaaaccaaatggcgccagagataagacccactcagatcactacgccttttcagggagcaataatcttccttggaatgtagcaatatgtaaccaatcaaagtgatgtaactatgcatggtcccatatggaaaatataatcctgctaaaatttctctgtctctgcctatgtaagtgataccttacgtcctccactttggaatgctgaccccattcatttggagttggtgtcttccaggtggctacccttaagctgtgtgctcaaataaactctatccttaaatatattttctgaatctcattatttaargttaacaatgtgctaacctaaacaattcacaggatttgttttttattctcattttttcctaacccaaccacctgkttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttcctcacaaacattctgaatgagaaaagttcaaaccattatttgttcaagtacttaatctactttgggacacaagtttaataaattaaaatattcttctatctgttccctttgatcagtgaacataaagttatcctttgactcatatttaaaatgttcagtactacaacactgaacaatagtatggaggaaaaaaaatgccaatttaagtttgaacttgcttcaccattcctatcccaacccccatgattagaaaatcaaaaagaacactttgagaaataacctcagtggggtcaaaagccagagtctccaggatgtcttgttcttaagacaaatagaaggaggtacaaatataggattgcagacttgtttacttcatttgttctctatttgtgtgcatgtgtgttggcagtgcaattgagaatgctttcatttttggtggtgtactagaaggcattaaaaaacaaaatgagaagtgggaattgaacaatgtgaatacatggacacagggaggggagcatcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaattttaaaaaacaaaatgagtccaggcgcagtggctcatgcgtgtaatcccagcactttgggaggctgaggtgggagaatcacctgaggtcaggaattcaagaccaccctagtcaacatgatgaaaccccgtctttactaaaaatacaaaaattagccaggcatagtggcgtgcacctgtaatcccagctacttgagaggctgaggcaggagaatcacttgaatctgggaggtggaggttgcagtgacattgcactccagcytgggcgacaagagtgaaactctmtctcaaaaataataataataataaataaccaaaatgatatcgaagtcactaataattacaacataatagctactataatgtaacaatgtgtcaagtgtctgcagaaggacccactgttgtctcactattcatttgatctccatttggcactgtttcgttgtttgaataaagctttatgctgccaggttttcctacatatttgtaaaacaaagttctcagccattccaataaccatgactgttacttgacattgcttcattcatgtatagtactatcaagtttgagcctaccctcactatgactagtttggcccaaccatctatcacaacagagggtctcaggtgaagtaaaataaatgttataaattcttccaaatttatggcacactttgaacagtttgagacatactaattgagaattgctaactttaacattttaagtataaaataagtgttcagttctttttggtcagcttggattgcctttggttctagttataaatcattttctttctttctttctttctttytttctttttttctttctttttctttctttctttctttytctttctttccttccttccttccttccctccttccttccttctttctttctttctctttctttctttctctctttctctttctctctctctctccctctgactctctctctctctctaccccgcccctttctttcctactgacaaggtcttgctttattgcccagactggagtgcagtggcatgatcaacactcactgcagcctcaatctcccaggctcaagcgatcttcctgcctcagccttctgagtagctaggactacaggaatgtgccaccatgcgtggctttttaataaaawttttgttgagacagggtctcactatgttgcccaggcttctctcgaactcctgagctcaagcagtcctcctacctcagcctccaaacgtgctgggattacaggcgtgagccactgtgaatggcctactttgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactcatctttgatttatataaaaatgtgtcataagataataaaaaagagaaatcccatccaactgagaaggcatggaagagaaaatgacaaagtcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccractcattggttcctcgtctgccacatgcatcrtctcaggcaacactgtcatttgggataataaaacacctgtttgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgtcttttctaattctaggggcctaaatacgtaaaaggcttcaaacttgattttacttcaataaacttgaaattatgttggttctaccacctccagtataataatcatcctgcttggcaaatcagtaaagattttaaaaattgatactcttcaaggttagcgaagctgtggaagaacctggactctcatgtaccacgagatcaacacatcctcttgaaaggccccatgcactataaacctcagaagtgggcatgtattttaacctayttcttaraatttrtacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattayaaagaattccctaagaaacatraaatagctatgcagaatgaaaataagtatatccatacactggcatggtattcagccataaaaaatgatagcataaagaagcacttaatgactagaaagagatgtgttttatgtggaaaaagaatcagatgaacggcatatatggcaagatctcattttattaaaaaaaaatacacctatgtagtgagggccaggctgaggctgagagaaatgcagtgtataacatctttgtcttactcttctctttggataacttggggacttctttacttttcttcttggtatttaaaaatgttgttacttttactagaaagtttacgagcttcagaatctaaatttacaaatgacattggtcacacatttattgctgtttatccactttaagaaacagttttgctattttgtaaaacaaattgggaaaccttccatcttatttgaaatctgtaataagataacatggaattggaataggaattttcttggaaatattaaaaaaaattagtaaaatagaaaaaacaaacaatataataatacacctatacctatatctatatttttatctctgtttctasttctgtaaactctctatacccaaatcctggtaaatggctgtaagtcttcttggagaagactaggggaagatttacaatacatgcttttgactgcgtagcatggtgcttcctcaagagaatccagtctcccatccgttggtgctgctctgggtctataaactattcaagtctaggaattgttgatgaacaatgaacttcttttgcaataattcaagtcagacttcaattcacttgacctaaatctcttatgcttatacaaatcaaataacaccttagtcggctatccctctacttcggttttagagactccatgatcaattagcccaataacaatgttctcttcagtcaaatcattctgattgctgtttcagttctaatagccattacaattgtctctggcaattaagtgctgccaattggactctgtcaccctgagctcctttggtccccaagtgaattcagagaacccagttcaatggcaacagttcccactgtcattcctggcctacagagaatgagccatcgcagaggatgctgaaactccccgtgtgaatgtttttctcaagcctccagtaaaaggtctgtcttctgaaccctccactcctgcatgtgcctcaccagctctatccaaggatgtgactttcagagtggaatggctgttgcttaacctctgcctctcaaatatcaggctaatttctcatgctgtaaccctagtccagaaccatacagagaaactaagtctggaaaacttaattccaaattggcctggttgacactgtacaaaaccaccagataattataattttatttaactctttgtcttcttttctttccttccctccttcccttctgcctgcctgcttgccttccttctttgcttgcttccttcctttctccctcccttcctccctcctttccttccttcctccctccctccctcccttcctccctcccttccttccttccttccttccttccttccttccttccttccttccctccttccctccttccctcctttccttctccttattttctttcttctttaccacacggctaggaccaccagtataacattgaacattggtagcaatagatgtcatccttgtcttgttccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctcttttttctgttaatgtaacaaactgttttgagtacatttttgaaaggcaaataattttgaatttcaattttacattcttaaaatcaactaagtcaatacttaatcatttttatatataacaaatacccttttataatacattttatatgtttctattaaagtataattcatgtatcataaaagttaccttttcaaattacacaattcagtggtatttagtatattcataaagttgtatattacggtctgaatgtttgagtccaccccaaatccatatgttgaaatctttacccctaaggtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagacattgggcaaccagcaccgccaattaattccggaacactttcatcatcccattcctgttttagagattagactgtaattttctttcttgtaatgtcctcataagattttgatatcaaacttatgacagtcttataaagccagctggtagtgtttcatatatttgcttccttgtaagagtttatataaaattggtattatttcttctttaaatgtttaaaagaattcactggaaaagccatatagcctggagtttactttgttgggaggtctttttttattccaacaattttcttgtaccatgtagactttttgctgaagtataacatatatatgtagtaaagtgcacacatcttaattatgcagttcagtagatatttacaaattaaatgcacccatgtaagtggcactcagattaagatatagaacattatcagcaccccagaagccttcctgatgccctttcccagttatcttcccaaagtaaccgctattctgatttataacactaatagttttgctgcttcctaaattttataaaggaatcaaaaaataggtactcttctgtgtccggcttctgctcagtgttatatttggaagtcacttttgttgctgcatgaaggatggtcagtttttttattattatattgtatttcactgatgatcttgagtaccttttcatatgtttgtgaagggcctattccaaacttttgtctgttatttactggtttgtctatgattttattgttttgtagaagttgtttaaatattctcttgttttctaataaatgtaacacaaatgttgtctttcaggctgtggcttttctttttctttttcccttcttaatgatgtcttctgttgtagtaagttctacattttaataatattcaatttatgggtctttttttccagttactgctttttctattctacttaggcaattgggccaggtgaggtggctcacgtctataatcctagcactttgggaggccaaggcaggaggattgcttgaagccaggagttcgagaccagcctgggcaacaaagcgagaccctgtctctacaaaaaataaaataaaattagctgggctcagtggcacatgcctgtaagtcccagctacttgggagcctgaggtgggaggatcccttgagcacaggggttcaaggcttcagtgggttatgatggtaccactgcactccagtccaggtgacagagtgagaccctgtttcttatggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttacttggtgattcttggcactttgcattaccatataaaatttagaatcagcttgtcaatttccacaaaaagaatcctacttgaatttgtattgagtttctattgacttagtacawcaatttgtagacattaacaaatttagttttgaagtttaaatttatgaacatgatatatcctcccatttttgaagtcttctttaatttcttttaaaaatatttgttaatttaccttatagaagtcatgtacatctttcattatctttattactacatattatttttaaaattttattctctatttacttcttagatatgcactggtttcacctcagctccagcaattttattaaatttacttttaaattgaatagtttttctgtatatcttttgaagttgctgcataattatgtcatctatgaatctgacaaagtttttaaatcttttcctttcttatgtcttttgtttatttcatctgctttattgcattggctagaacctccagtacaacattgaatagaagagatgatacaagccttttaatggttatcacaaatcatgatgtatgctgtagatttttgtatgatatcctttattagattaaggaaactcccctttacttctgattgctaaaagatttatcatgaatgttcattctaattgatcactctgcatgtattgagattatcatgtttctttttcactctgttaatgtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaaggtaaacctcactttgatcattgtatcatcctttggaaatattgctggattcagtttcataatattttgtttagaaaatttgcatttatgttctcaagagatctttggttataatttggttttattttaatgtccttatcaggtttgggcatcaagattatgttgggctagtaaaatgtgttaaaaattgtttatttttttctagtctccggaataatttgtgtaacattaatattatttttccttatatgtttggaagaattcagcaatgaagcaatctggacctgagggtttgttgttgttgttgttaggttttaaattagtgattcaatttctttaatagctataaaagtattattttatatcgtattgaattagtttgggtaagttatatttttcaaggaatttactcattttatttaaattttctaggttattagcataatgctatttattatatcctcagaaatcctttggatgtctgtaaattctgtagtggtactcctatgctaattaatttctgatattggtaatatctttttgcttctttttccttaattagttttactggggctttatcaagtttactaagcttttcatataaactacttttaactttcttgttttttctttaaagtgtgactattttctcttttactgatttctgcttattttcttctactttctttaagctttgtgtactcctccactcctaaattcttgatattgattagataatttgttttcaacctttatttttctaatatatacatttaacctatacatttttctctaaaactattttacttcccacaatctttatatttttattatcattgtacataaaagttttctaatttaccttttgatgtcttctttgacccataggctatttagaagggcattgcttaatttctaaatatttggagatcttctagttatcattctttcattaattcaatcatttgagacatggtttatggcccagaatatggatgattttggtaaaatgttacatatgcacttgaaaagactgtacagttattttgtttcattttctagaaatgtcatttaggaaaatgtggtttagaacagactttttttctccctccacttgttctctcagttatggagaagcatgtgtaaaatatctgtattagtttcccagggctgctgtaacaaattaccacaaacttggtggcttcaaagaagagaaatttactctctcaacagtttggaggccagaaatccagttaagatgtcaataggattggttccatctgcaagctgttctgtgcctctcttcaggcttccttccagtggctgctggcaatcgttgatgttccttggcttgtagatgcatcatttcgttttccgcctccatcttcaagtcgccttctcctctgtgtgtgtcctttgctcttctggctcctgtaaagacactggacatggatttagaagccaccctggcaatccagaatggtctcaactcaagatcattaatttgattgtatctacaaagactctccaaactgggtcacattcacaggtttcagagattaggttaggacacagatattttttaaggaggacagtggttattcaacccattacaatccccaactatgactatgaatttgcctgtctttcctctttgttctagcaatctttaagcaatctttactttatgtattttaaacatgttattaaatgcatgtttaaataattgcatttgttaaattttttgtttattctttctgctgaattgactgttttatcataatgaaatgtctctctttacctctcataatacttcttgccttaaaatctactttgtacattaatatagctatatcagctttctttcttgtatttatattatatatatttcaaatcttttactttcagcccttctttgtcttatatttaaagcttgtctgttataaacatcatatggtaaagttttgttgttttattcagtctttctttgttgttcattagtgtttgaaacatttaaatttaataataaaaagttaaaattataaataaataaatttaatctagttactgataagtctaactcttggttatttgttttctatttgtttcatgtgtttgtgcctttattcctcatttctcacatttttgaattcatcaagtatttttattattctattttccccagtagcttttaagttatatttcattttttattcttaaatcactactctagagacagacatccttgatttactatagtctactaaaattgtgcttttaccagtctccaaacaacgcaagtacccaaactattaatatttaattccatttgtgtcctcctcctctttttgtattgttgccatacgttttgtaaaaagaaaagcttcagctgaattaaatttaaaagagtttaattgagcaatgaacgattcgcaaatcaggcagccttccaagccaaagtaagctcagagactcctgcccagctgcgtggtggaagaggatttacggacagaaaaaggaaactgacgtacagaaaacagaagtgaggtacagaaacagcccgattggttatagctcagcgtttggcttatttgaagacagttcaaacagttagccacatttgattggccaaaactcggtgattggcataagagtaacctacggtctgtttacatcttcactcgttataattcgcagtttacagagaaacctttaggctgagcttaaactatgtaaggctttaggctaaacttgatttaacaatttacatatgttatatatttcaaagacgtaattgttgttgttgtctttataaaaataatatctatttatatttacaccgtagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgctttatacaactgcctcctggtgaccacctctccatgggacagctagataaaacctacttgactagcgtccctgccctctgtgccctgcatggacttcgcagttatgctgccgtgaccacctctcagtcgcagcatgactgcctggaacatgtgcctgctttctttaaactcaccaattagaactccccatgggagataccttggcttgtagatgcaagatgctgggtcatactctggtccccaataaaggcattggccgatggatccccttctctctctctctctacgttcctcgcactgaccaacctctttgtgatcttcaggcgtgccatacccccagcccgtaataaaatctttactkccatcttgtgtttcttgtaatgactgaagaggttttctctatcataaagatcctaaatgaaaacatacccgcatatgagctctttctggtgtgtttccttcttattgcaattctatcaatcctatatgaaactattttccttcagcctgaaaaagtctctttggcatttttgtattgtagatcttctgacaacaaattctttaaacatttttctaattgtggttcctttgaaggttattgtctatgtttcctgctgcttttatggattacactttaaaatagattttttacaatattactatgttgtgtctaggtaagtatttctttgtattgcttgggtttatcttgttgcacaactggagtgcagtggcgcgatctcggctgactgcaatctccacctcccagattcaaggaatcttcccacctcagccacctcggtagctgggattacaggcctgtgccactattcctggctaatttttgtatttttagtagagacagggtttcaacatgttggccaggctggtctcaaacccctgacctcaggtgatctgcccacctgggccacccaaagtgctaagattacaggcatgagccaccacgccaggcctgtatagctttttgaatctgtaatcttgcatcagtcttggaaatttctcagttattacttcttcaaatgttgtttatgtctattatctcctctcatggcaggacttcacttaaacatgctaggctttattcttctatatcttggtctgtatgtttaacatgcatttaaggagtttttgtggactaatatatgaccacttttacacagatatcatgttattatatcaaacttagatttgagtaaatgagttgataagttttatacctcttgtgtgttgtgaaatattgaaattacatttggaagcatctgttacttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttcctactgtgtatatttgtgtcttctctcttcccttatactttatcttttggcaaaggtttttatattttatttttctaaaaaggctaacctcagttattaacaaaaatgcaaattaagaaagcaaatgaaaagagtaggagaacactgtataaactctataatactataatcaaagggctatttaaaatgaaaagaatgtggatggagttaataaatgcatgcaaatattataggaaatcatataagtaagaaaggcaggacacatcatattatccccaccaaaattacaactttgtaaaaatgtacctacgtgttagcaaagaataaaagcaaataatgaatgtaaaaatagttacagtttagtgactcgtgagatttttgtcattcattatttaaattgactgtgctcttcctttcccaggaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaagggccctgccagtgacatgcattgctgttggatcaggagattagtatttgttcagggggagggatttgtgctgagcagggtcgagaagcaaattttctaggtagtgaacatgaaattcagaaggtgtgtgtacatgcagatgtgctgaaatgaagaagcaaagctaaacctggacaaggaacgtgatgtttctttggagttcttataagcaaatctattaattacctttgagtataataactgctgatagaaaatgagtgattcttccagccaggcaccataatacaggctacatgtgaattttaatccttaaaacaaagttattaggtagttaccagtttttctaggtttgtctgttttgttttgcttgagacagggtcttgatctgtcactcaagttggactgcagaggtgagatcatggcttactgcaaccgccacctccctggctcaagcaattctcctgcctgagcctcycaagcagctgggactacaggtgcatgctaccacrcctggttaaattttttatattttttttatagagatcgaatctcaccatgtttcccaggcttgtctcgaacacctgagctgaagcaatccacccacctgggcctcccaaagtgctgagattataggcatgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatgcaggctgtattagactcttctcacattgtataaagaactacctgagactgggtaatttataaagaaaagaggtttaattaactctcagttctgcaggctatacaggaggaatgactgaagactcctcaggaaacttacaatcatggtggaaggcaaagaggaagcatgtatattttcatatggctggcaggagacagcaactagggaggtgctacacattttaaacaagcagatctcaagagaactatatcacaatacagcactagggtgatggtgataaaccattagaaaccacccccatgatccagtcacttcccactaggctcctcctccaacactgggaattacaatttgacatgagatttgggtggggacacagagacaaaccatatcacagctaataggtcacaaagatgttagaagggcaggaaaatcaggcagcctccctagcaataggacgaaggcagagttaccagagatcagggagctgctgtggctcccagtctacacagcacaggagcctggagggatgctcaagtggccagcccctcccactgagcaggcagctccctgaaagctgctaatgctgcaggagccaccacagctgccagaatgcagctgatattgctggagccaaagtcattggcatcgctagaattgaagctgtagctgctcactgaagtcatctatactgccactgcctgagccacctctagaagtagaacagactctgccatcatcctgctttttaatttggtatatatgcctccaactggaagaacctaaccagagcccagctatcaaggaagacaaatgattatagttttaaggtttccattgctagcagccaaaagacagtgcagaagtgtgaggctaggggccaacagaaatttaaccagcacagcacctcaatattacatcaccaggcattgattagtcaagggaaacactgggtgatgagccctgaaaatggacattacagcatcagagtatttacaaactccctaaagaagtcatttttctagtccaatcccccatttgatgcttgagaaagctgaagtccagaaaagggaactgatctgctcaaagacaaactgaaattattttttccattttataacagttttatataatttagttgagacctaaatgtgttctgacttcctgagttccgatcaactatattaagagagagccagcgctgcccttacaatatgttgtgtgaaatagacactctcattatggtgacagtaggtcttttagattttgttcgacagttgcccaccttctcactggagtgaaatgaatgactaggcagcaccttgctgcatagcatgaagggaggagacccatagttctttaccaccctatgtcaggtggccgctgagagaagacttgaaaggagaagagaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctagaaggaactgtccattgtgaaatcttagttgcatactttagatgtaaaacaatgaattggggatacctctgttttagtcacagttgtgcaatgtgtcagttctatgagtgatggcaagacatcttcctcgccctgtgtatttagtttgttatcaatgtaataaggctgttattctaccttttttgttacatatagatttgtaattattattcccttggccagtttaacagtgagagaaaagttattttcacacaattagcagtactttgtttctctctccccagtatgtcagccacctccagatgtcctgcatgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctccacatgccagttatttctgttcgtttttctttttttccagtgaaatcctgtgatgacttcctgggccaacttcctaatggccatgtgctatttccacttaatctccagcttggagcaaaagtggattttgtttgtgatgaagggtgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaaaaatcctattttcaaaattttagaatttcaaaacagcaaatagaatatgagtaatttaagagtctcagaaaaaattgcaagtaacaaaaaacttattctaaagagctaggatcatttaagaatcatttcagtaaattctttaaaccatcagtaatgaaatttgtaataggactgaaagtgtaaaaatcagcattttaaaaaaatccagtcatatatcgtctggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatctctgttctctcgccagctatttcccactttaccactccaaactgggagctgttttacttgctgttccagggtcagagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttgkctggaatggaaagcctttggratagcagtgttccagtgtgtgaacgtaagtaataggagtaacatttcaggccaatctctccycttcatctgttcagtatttgacccaygacctcccctaatgtggttcttcaattttctaatctgaattattgatttgaaaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttctcttctttccttccttcagttcttttttcccttcttctctccctctctccttccttctttttcattttgttctccaatcaatgtgcagtcagtctacaatttgtgtatatatttgataatactcaagtatcaaacatgcctttatttaatcaattatttattgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacagggtgagcagtttgagactccataaattctcaaaatatgtacctaaataatttatgctgagagattcataaataataagtcatttttttaaaatgagcctcatatgttcaataatcagtagactactgatttctcctagtctacccatttataatttccccaatagaagatagaactttgcttcatttcttgattctaatgattggaaaacatgtttctttagaaaaccatgaaattttactaaaatgtttatgttcttagaaatgtacttggacatcttacagtgctttttagagtaaaattttggaagaacataacttatatagagatgcttgctgtctaagaaatccagtgctccttgaggcagcatgacaaatgtctgttctactatcatgcatgaaagctcattgattggactactcaagctttctcttatttttcataactctggtagttaaaataacttcttccaaatgccagttctaatgaaaaatgccaattagaaatgaggaagagactattataaacaaatcagtagatgctagaaaggagtaacaacttgaaacctgacccagaaagtaaaaaaagaaaataaatcatcaacagacsttgacattttcaaaagcaaagcaatctgaatccatttggagttttttataatggcctgaatatgtttcaattcactgtggcagggctattgttatcactgagactgatgatcaatatcagtaagtaatcagtgaaagttttcacctatttaagatgattagcacacatatatacatttgwgaaatatttcccaagaacgtaggcyccttcctcagcactgtgtccccaggatcctgatgagtggctgacacaggataagtgctaaattaakaaakattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattttgataagggatgcaaggtctctacacagatctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggctccaaaacattttctttcccacaggtaaatcatgtgaaactcctccagwtccagtgaatggcatggtgcatgtgatcacagacatcyakgttggatccagaatcaactattcttgtactacagggtgagttggcagcaacatctcttggttccagagttccagcacagcaatactaccttctagccacatctcaggaaggaaactaggctgttgccacctgctcttgagaggtttgaacacaggtattaactcctgattgaaatgaacaaagataggagaagattaggggaaaaatctgtgtccttgctggaaaccagggcagtgcacacataaakagtatgccgttcactggatgggaargaaaaaaaattaggagtatagtagtcaaagcacacaaacaaccctaacccagagtagacattgctggaagaaagggaagggcatgtagcagctgtgtgagagaacaaatcttaatgataacagcatgatcgcttgctagggctgccatcaaaaagtacaggccttcctcattttattgtacttcacagatgttatgctttttacaaattgaaggcttgtggcaacgctgcaacaagcatgtcagttggcatcatttatccaacagtgtgtgttgacttcgtgtctctgtgtagcattttggttattctcacaatatcccagakgttttcattattatcatgtctgtgatagtgatctgtcttcagtgatctttgatgttactattttcattgtttggagtccctacgaactgcacccatataagacagaaaacttaataaatgtgcatgctttgactgctccatggacaagacattccccttctctctccctctcttcaggactccctaatccctgaacacaataatactaaaatgaggccaattaatagccctacaatggcctttaagtgttgacatgaagggaggagtcatgcatctcttactttaaatcaaaagctggagatgattaagcttagtgaggaagatatgttgaaagccaagacaggccaaaagtcaggcctcatgtgccaaacagctagcgagttgcaaaggcaaagcaaaagtacttgaaggaaacttaaagtgctattccagtgaacacatgaatgataagaargtgaaacagccttattgctgatatggaagaagttttagtggtctagatacaagatcaaactagacatatttccttaagctaaagcctaatcctgagcaaggccctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaattaaccaggcgttgtggcgggttgcctgtagttccagctactcgggagtctgaggcatgagaataacttgaacccgggaagcagaagttgccgagattgtgccactgcactccaggttgggtgattcctgaggtttaaggaaagaagtcatctccataacataaaggtgcaaggtgaagcaacaagtgctgacatagaagctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagccaatgctcactgaccattctaaaagccctagggcccttaagaattatgctaaatgtaccttgcctgtgtctataaatggaacaacaaagtctgatgacagaggtatgtttgcagcatggtttactgaatattttaggctcactgttgagatatagtgctcagaaaaacagattcctttcaaaatgttacatacagctcattgactttgtatccaatcaggcaagagctctgatggagatggacaaggagatgcatgtagttttcctgcctgctgacaacagcagccattctgcagcccatggctgagcagtaattttgactttgaagttttagtatttaagaaatatattttgtgccaggcatggtgtaatcccagcatattgggagaccaaggtgggcggatcatgaggtcaggatttcaagaccagcctggccaacatagtgaaaccccgtctctattaaaaatacaaaaattggccagcatggcagaatgtgcctgtagtcccaactactcaggaggctgaggcaggagaatcacctgaacccaggaggtgaaagttccagtgagccgagattgcgtcaccgcactccaggttgggcaatagagggagacttcaactcaaaaaaaagaaaaagaaaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattccgaccctcatggatgactttgagaggttcaagacttcagcggaggaaataattgcagatgtgacagaagtagcaagaacactacaattagaagcagagcctaaaggtgtgactgtattgctacaatatcatgatcaaacttgaacagaagaggagttacttcttatggatgagcagagaaagtagatttttgaggtggagtctcttcctggtgaagatgccatgagcattgttaaaatgaccacaaatttagaatattacataaactaagttgataaagcagcagcagtatctgggaggattgactccaattttgaaagcagttcagagggtaaaatgttatcaaacagcattgcatgctacagcaaaatcttttgtgaaaggaagagtcaatgtggccagttttattgttgtcttagattaagaaatagccacagccaccccagctttcagcaaccaccaccctgatcagtcagcagccatcaaccttgaggcaagaccctccaccagcaaaaagattgtgacttattgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaacctgcaatatctttgaggaatgtctgtaacacaaaatgggtggcttaatacaacagaagtttttggagttctgttctatagactggaagtccaaaatcaaggtgttgggaagaccatgctccctctgaatcctgtagggtaggatccttcattgcgtcttccagcttctggagccccaggccttccttggagtgtggcagcagaactccaatttcttctgttgctgtcctcagatggccatcttccctctgggtctgtgtcctcatatgctgttctcctctctgttcatgtctgtgtccaaagttttctctttttataaggacaccgggcatattggattagggcctaccttaatgacctcagcttaactggattgcatctgcaaagattgtatttccaaataaggtcacatccacagggactgggggttaagacttcccaacatatttgggggagacacaattcaacctataacagagtccctttgaaaatgtcaagtgtcaggtgctcacagcgcatggtccagctgttggtgctcacccttgctcagcacacagtggaggctctgcctcaatctcactcttcacgggaacagctaagccaggtagtgagtaggggctatgtttgtgccaccgcaacaaacacagaaaggaagcttgtggtgtccagcatatttgccagcctaggcttcagagaccatagcacctagaatctgacaaaataaaattggaataaatccaaagtcctcttttcttttttgagcatttttaaaaatacaattgataaatttcctaactgttccttcctcatcttgcattgtggaataagtgcgaacctccctgcggcatgaggcagaaaaccattgagcttatgacaaaaaacaggaaatacatgtaaaagagaccaattttaaaaaatcaggagaaattttacaaaagagatttactgccaggaaaccaggaaaactttcagaacactctccttttcctatttttaacaagactcagttgtacaaataattctgtgaaactagccatgaagtttgcacacgaatgaatatatgtagtcagtgtgtttatatatttcatttcatatatgtgtcatatatatgtgtgtgtgtatgtrtatatatatatatayayayatayatatataaaacactgaatattgcagaaaattaaagcaaagagtaagaagagttaaccaaattttccctcaatgcagtgggaaaagatgaaaaggagaagataggtgggcacagtggctcacacctgtaatcccaacactgagaggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcacccctgcactccagcctggatgacagaatgacaccttgtctaaaaaaaaagaaaaagagaagacgtatgtaagacagtgtcaggattcaaattatgtattaaaaaaattccagaagggtaagcaaataagcccatacctagccatcactagggaaatttctgtgtttcagggatagagaaaaaaactcagattccagaaataaaatgtgaaaatgtaatacccgcaaaagaaataaatttattgacaccacattgattctacacaacactaaattgtagaagatagcacttctgttgagccaagctaatattcacatctagaggctccagatacacattaaagaataagcaaagacacaaaaattgtaccatttaagtatgtttcccargcaattaataagcaaatttttaaaaaggagaatgatgaattsctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgcacacatataaaattaaattcctaattggaaaaaatattaagtttaatttccaaattattagaataactaaaacagctgaatctatctgttccatatagtaaggggagggaaggaaaaagaatagcaaggaatgcatttgtctctgtcatcggaaataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaamacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattacacacacacacacacacacacacacacacacacayayattaagggaatacgcaaacaaaaaatggcagaaataatatgggaaaagacagaacttaagaaagaaattgtcaagcaggtctacaaaatrattgttttattttggtgccaggtacagtccacaatgaagtcaagatattaagaagtaaagtggaccaggagaagttagagcagaaatatctcttttcaatagtgagagcagaaaaagaagtagaaaagctgggaacaataggtaaagtttaggctaggccttagacttctcctatattgtaatccctctggtttgccacatrtgcatgctgtcaggaagttgatgaggtatgkamagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagttgtcctcctagaattacaaagaatgaatctcatccctcttggaaatggtatccttctgatatttgaagaatccagtcatatccttaaaatggctcacagcattccaaacttccaccttcacctagaaatgctttttttcttatcttaaggtgtaatttattttaaactagtcttgagctaatttaaatagcccccaatttcatcctctgttgggtgaacacctcccagtttgaagagcattttctttggtgaagtcaacaaatacaaagtcagtgaaagaaaccgcatatcctctctgcaagctgttagtatcacatcagatattcaagccatgcagctctttcttccttcttattctttgtctaaacaggatcatgccatcttccctgtgagttgtttggaagatgagctttctacattttggggagcaaagaggaatgagcaattgcaagctaataaggaatataaaatgtgtataatcctgggtttagtgatggtgtgaggaaatcagcaatttcaaacccatctggtgggagrataagtgggaacaaactttgtagaagggcaatatactggctgggcactgccctacagtagagtaggacacagtattcagttcttccaagatcagatgaaattgggtgcattcagggtggtatggctgtagatcagtatccagttatttgtattacttctgaatctgtaagtatcatgtttattatatgtaatattgtatatttgtgyttgctttgtctttattagttctgccagagcttttgttcttattatttaataaagatgttatactgggccaggtgtggtggctcacacctgtaatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgcaatgagccatgatcgtgccactgcactccagcctgggcagcagagcaagaccttgtctcaaaaaaaatgctatgctgtatgctttattatattaatatccaatagaataaagacacatgccttctatatagagagaactaaattaataatggtgagataacatagttaaattctcatttagcaggagaaatataaatgtgtactataggccaggcacagtggctcacacctgtaattccagtacattgggaggcccaaggtaggtggatcacttgaggtcaggagttcaagaccagcctggccaacatggtgctaccccatctctactagaaatacagaagttagctgagcatggtcgtgcatgtctgtaatcccagctacttgggaggctgcagcaggagaatcatttgaggccaggaaaggaaggttgcagtgagccaagatcatgatactgcactccagcctgggcaacagagactctgtctcaaaaaaaaaaaaaaaggaaaaaaatgctctataataatatatggacacatttagcaaagtaatgttaactacgaagagcacaactcacaatattataaaattgtaagaatatatctgtacattagtaaatattagatgagaatgatattgtgaatatttacttccggtaatttgggatttcagaaaagctattagcataatttacaataaagtataattttaagaaaccatgccgggcacgatggctcacgcctgtaatctcagcatttggaaggcagaggcaggtggattgcttgaggccaggagttcaagaccagcatggccaacatgaccaaaccccaactccaccagaaatacaaaaataaaccagatacggtggtgcgtgcctgtaatcccagctactcgggaggttgaggggggaggattgcttgacctgggaagttgagattgcagtgagccatgatcgtgccactgcactccagcctgggcgacagagcaagactctgtcccaaggttttgttttggtgaacttgcggtctcttttcccaggaattccttgtgggctaccccccaacatcaccaatggatatttcattagcaccgacagagagtattttcactatggatcagtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattttccttaaatgaagttgtggagtttaggtgtcagcctggctttgtcatgaaaggaccccccgcaccgtgtgcaatgccaggccctgaacaaatgggagmcrgagctaccaagctgctccaggggtgtgtttgcctgaggcctagaagggccctgcaagtgacatgcattgctgttggatcaggagatgagtatttgtttagggggagggatgtatgttgaggagggtgggaaagtaagttttgggggaagaagcatgaaattaagaatctggggtgtgcawgcacycatgcatatgtgtcttcattttgaaaagcaagaccttaattagccaagaaaactggtattttggactcacctattaatcaattgtcagggcaaagtaccagctgcaatctctctcaattatattgaaaaattatatggactttatggtcagctgtgccctaagcactttgtatacattatctcatttattatttaaaacaacactgtcttatttaagggcttgtgtttttgatggctcatcttgtctactgatgccacaatagctggcttagcagcggagtgggaggtgttatggcagatacatagggacagagaaagagcttacaattcttctaccaacccatgttagccttgtgcaaccactgagctgggaagacaaacagataaagggatataaagacggatgtaccgaggcaggagatgggcagggcttgtgttctggtcacaatcctgctgaccaaaacagaatctggcctagacaggatgaagtgaaaaaacagcagcaacaggcagatggcgatgaaagcaatcactagctgccctcatattcccatcagcactgtgacagtttacaaatgccatggcaacgatctggaagttaccacccctttccaggaaagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctgagtgaggtggctcgcacctgaaatctcatgaggctgaggcaggagaatcacttgaacctgggacgcggaggttgcagtgagctaagatcacacgactgtgctccagcctggatgacagagtragatatcacctcaaaaaaaaaaamacacaaaaaacaagaaacaaaaataatttacatgtaattgaagcgggcttacaggagtataaatacagttgcctgccaggagctcatatgttgctgactctgggcacattgcctgtgagttagccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatccagagctaggagaaaatacttcatgccctgtagatttacaggtgaattttgggccatgtgctagggagaattgtgttctatttctctaccttttactaactatgaggccttcagcaggcataggatatagcaaaagaaattcccccataactaacargtactctggaactgtcctttctacaatgtgtcagcygcctccagaaatcctgcatggtgagcataccctaagccatcaggacaactttttacctgggcaggaagtgttctacagctgtgagcccagctatgacctcagaggggctgcgtctctgcactgcatgccccagggagactggacccctgaagcccccagatgtacaggtgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtggagaatcactgagttaatccaattaaggagctgacctagtagataagaagtacccagagagattaatttatggaagggtagttttgaaataagcgttaatccaattaaggagctgacctagtagataagaagtacccagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctcagccactttgccagctggtgacctctggccagaaacatccctgtccaggccttgctctacccaggatcaatgcaggagacacctcatctacttggcccacccaggccgtgccaggcttgtgctctgatgcagagcccatggctgccgcgactacatgctcagcctctgggagggggtgtgtgagtgagcaagtgggggttccagctggccgcgccaagcactggcacaggagcgggctccgtgcaaggcttgtggctggaccaggcatgtcacactgaagggaatgtgttggtgcccaaacaggggtccccacgaccccgaagcccagagggggtgtaacagcatggtaatagctcttagcatttgataatgcctgcagcccaacagatggcggtgtgttaacaactctgtcagttccatcgccctgctcaggcctgcatctccaaggctgacttggcctgcatctccaaggctgacttggcctgcatctccagggctgactggacctgctggtgcttcctgttgcatggaataacttccctcccctaggagacggcaaagagccactgtattacagccttcttcatacctgcgtttggtgggtcctgagttcttgtcccgcatccaagaagaacaagcttatgctgacaatagaagggtgaggagggtggagaagagttttattgagtgacaaaacagcttctcagcagagaagagacacaagggtggaccccagatgaagtcagggggtyattctctcagtgtggctggttctggagcctttatggactcagaattggaagtgtgtgttaattggttggtgagtatgcaaaaaaggctaaaacaaagccaccactcaaaggtgggcacaacagtgcaaaaaaccaattagggaagagcaggtatatgtgaaatagatgaagagtggggatcaatcagaggaaagcacacccaacaggaagagaggttctcaagccagtccatggatttacctggaacttgtagctaggctttaaactgtcttcagcttgaaggtcgggtttcaccgggatccgccccatctgcctgtgatttgtctgcctcctgcttctaccactgtcaagtggtattattcgttgcttatgtgtatccattattcttggtgatacagtatgagtctgggggataactagattgagcaattaaggagttatttttaataatttccaaggattctttggcatttacaaagtccaccacctaataatgatttccaatttcagaacgattttagatttcagaagggaagcagtactcaatagtaagttgagcatttcagggtggcaaagactcctcccctgacccttctttttttcttagaacacatggttcagcatgcttctgtgagcctctttctggcctgttacatttggagtggcgagaagaacagatattcctggctttgcttaccaaatcaaaagctgttctgcctcatgacccactaatgagaataagtgggatgtcagagagccatcaatgaaagatgacacctgaaggttatggctcttgtgcccatggagaagtctggttctgtgttcatgccttctgtaggtgatgctgggctatgaagtttatatggcacttcagctctgattgctttgccagtcacagggtaccatggttctttagaataaattggcctttgagtttctgtcagctactgaagaattcagatccctaatgaactaagacttttagctagacctgaacctaagacccaaatgatagtcaaggaggaaatggtagtgaggaagctgagcatctattagtgaagaaatcaagggagagatgggaattgctcayacatttgctaccacttttttttttctttaggttctgattaaaaggcaggtctgctagtcattgtgtcttggctggaaygaaagccctttggaatagcagtgttccagtgtgtgaacgtgagtagaaagaactaygtagtttggatagctctccttatttttgttttccagtgttttactgcacggaatcacttgtctggatctttacttaactaaattactgattaaaatacttctctgttggaagaatttcaagaagggtcttgtaggacttttctgacatttgttactaatctgtaaatcacttagtttaatgactgtttaattttgtggggaatgtgtggcaagaaactaaatgacataaaagtgcagcacattttagtcagtcatttatttttaattttcttataaggagtaatctttcttacattttttttttcttttttgagacagttacccaggacagaatgcagtggtgcaatcacagctcactgcagtttcaatggcctgggctgtagtgaccctcccacttcagcctcccagtagttgggactacaggtgcatgccaccacacctggctaattttttatattttgtagagatggagtcttgccatattgcccaggctggtctcaaactcctgggctcaagctatcctcccaycttggcctccaaaagtgttaggattacaagtgtgagccacygtacccagccaaattyttatgttcttttatcccctcacktatcataaacaatttagtcagcttgttttttagcctgcagtattgaatgacatagggcttcccatgtgctaggactttccatgtgtagaaaatgcaatgaagagtaaaagaatagtgaagccacctccctactttcctggagtatattttcttgttgggaagaagactaaaaacaataaaataagaaaacaaaattctaaaaattataatatataaaatggtagttaaatagggatgttatggagaaaataaaacagagttatatgataaattagtacagtggaaggagccgggatgacgaatcagtgtctgaaatgatgaggtgtcctaaatttccaaaccatccgcttaaataaaatatcccaaaattcagaaagaattcagaaactcagataaaagtacatatttgacatactaagacattactgatttaccctattctgtctattaaagcaaggcatgatttttttaaaccttttttttcttattggaaaatgtttactttaatttgcattgtgttaaaataacttacagaaatcaatttggatattttatggtgagtattatggtgaagaacattcaatacctgaggaaactcaagtatccaacaaactcaacccttacagagacacatagagctgaaaataaatatataaataaacttaggaaaaacacaagtaaaattcaagcatgagaagttaatcattgtttgatgtactaagtcttttatgtacacataattccgataaacttgggtatctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcctgatgataacagtcttgaatcaccaagaaacatttacattgctaaagatgatagttcatgactattaaagttcatagatttccttggaacttatggtctctgatggccaaaattttgtctgtcttgaacctcattgtcaactcaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttacagatttaaattccatccaccttagttatagtctttctaaaagaaaaaaaattatattcatagcactgtcgcaggtcactaatatttcagtcatcttaagtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggtcagtatccgcttccacatatcctaaatgggttcagaatatgtaggtgagaaccttcatatttctatagtgacagtcatttttgcttgtgaaaatggctttgctgtaactgtcagagacagaactacctcccaagtgaatgacaaatgggttctagataggcacactgtctcaattattggtattctgatggcctttggggtgaggagggtgggatggtaaggagagaagagggtggacagtgaagagaattggtgaggtccagattttgtagagaaatttttgaaagtactgaaaacaaatgctaaagaatgtactcttttattctacccctactatgagttgtctttatcctggagagatggatgtgctgcgcaaaaagtacatgatgatgtaatttacttcagaactgataacgctataaaagtaatttaagaaattcagatgtagggatttatactttttatgttgtttccaagggtttgttcaagccgctgactatatttagttggtccttcacctcaccattaacaaagggaactcgggaggccctggagaagcagagtctgagactgtactcttagccttcatagctccttcctttgatatattactctggctttaaacgacagtacttgacaaccgtagatgcatttgtggctgtgactgcccacacaagctccatcctccagtaaggacagaagagcattgaattataaaaggtgttgactttttaatgtgttcttttgagatggagtcttgcactgtctcccaggctggagtgtaatggcacaaactcggctcaatgcaacccccgcctcctgggtttgagcaattctcctgcctcagcttcccaagtagctaggattacaggcacccaccaccacacctggctaatttttgtattttttagtagagacagggattcacaatgttggcccggctggtctctaactcctgacctcaggtaatccatctgcctcgactttccaaagtggtgggattacaggcatgagcctggtgctgacttttttgacctgttggctaattggacttagaacttctgtatgttgaaaaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagatcacatggacacaggaaggggaatatcacactctggggactgtggtggggtcgggggaggggggagggatagcatcgggagatatacctaatgctagatgacacgttagtgggtgcagcgcaccagcatggcacatgtatacatatgtaactaacctgcacaatgtgcacatgtaccctaaaacttaaagtataatttaaaaaaaaaaacattaaaaaaaaaaaagaaaaataaataacacagtagatagatgagaaatatatgggaaacacagcaaagggttaatagtgttatcttacaggtagcagtagtggtggttgtggtactagttgtaaaagttaatatataatgaatacttagtaccactgttagataggctggacatggtggcttatgtctgtaataccagcactttgggaggctaaagtgagacgatcacttgagcccaggagttcaagtgcagcctgggcagtatagcaaaactctgtctctacaaaaaataaaaaaaattagctgggcgtggtagtgcatgcctgtagtcacagcttcttgagaggctcaggtgggagaatcccaagcctgggaggtcgaggctgcagtgagctgagatcacaacactgcaccccagcctggacaacaaacaagactctgtctcaaacacacacacacacacacgcacacacacaagatagcttctaatttaattacacaacaacctatgaggaggatagtattcttattgtctcattttataggtgtagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaaggtcccaaacaccagataatgggcaattcttaagttggatgaaggagatacatacaaagaattagaatgggccaaataactattaaccagcaggttcttggaactcagagcttagtgtaaactcctcgtgaattgggctgaaccacataggaactccttttgtctctctgaactaagactcagactaaaagcagtcccctttgccttcttgttcctagtctctttaccctatctagtcttggcctttgacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaagaatatcttgggatactcagatcccctatctccccatttcaatggcccagttacatcagaggcctgattcatttcaaaaccttcctcagagcaaggggtaattgccaggtaccctttaaagccagaattaatacatataacccatatttaygctgtctcaagactaattagcatggtgttgcatgctagacaaataagttcaactccagaaaacatgtaaaaactaacagaagtttcaacttgaatatcttaagagaggcttaaagaaaaattaaactatgtgacactcattaaaatgtccccaaatcctctttacccatttccattacccagtgtcccattcattaaagcaactgctttcctagagcctagcttctctcagttccacccagactgtctctcaatagtctccccaccttctggaccttcttagttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaagaaatgcaaaaataacaaagtaccctttttttttattatactttaagttttaggatacatgtgcacattgtgcaggttagttacatatgtatacatgtgccatgctggtgtgctgcaaccactaactcgtcatctagcattaggtatatctcccaattctatccctcccccctccccccaccccaccacagtccccagagtgtgatattccccttccgtgtccatgtgatctcattgttcaattcccacctatgagtgagaatatgcggtgtttggtttttcgttcttgcgatagtttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatcgctgaggaatcgccacactgacatccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccatcttgaattgatttttgtataaggtgtgaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgataaagtaccctttttttaaattgtccattaaattaacgacaaacaggtttttatgtgaacacccaataaaaagtaaggatgtaatgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaataaatgcacaatagaagtcattgaatatactatgatgcatctactagattatattagtttgcctttgttgtaacttatatttctagtatataaatatgtgaaaacataccagaagagaatgtatcaaaacacattttgggtactaggatttggggtgatatttttctttagttctgtattataagttttcttctgtaattgtattacttttacgagaaaaatattaatttttaaagtcttcttggcagtggctcgcgcctgtattcccagcactttgggaggctgaggcgggcagatcacgaggtcaggagattgagaccatcctggccaacatggtgaaaccccgtctctactaaaaacacaaaaattagctgggtgtggtagcacgtgcctgttttcccagctacacaggaggctgaggcacgagaatcccttgaacccaggaggcagaggtcgcagtgaggttgcaccactgcactccagcctggcgacagagtgagactttgtcaaaaaaaaaaaaaaaaaatcttctctgagtgcagaaggtaaaatgagagtatatgagtgaaatcaatggctttttataaaaaatattagtctgagtcctgaataaaaatcaggataaattgtcactggctgagaagtcctgttcaatcatgttgcatgccagagtgatgtttttgtgacttttgtcttccttttaggttcacatgatgctcttatagttggtaagttttatgaagtgtttgctgaggaattctgtcatctttaacagtaagtacctacttataatgaatgcaatgtagaaagagagatcaaaatatcttgagttataaattcaaatagaaagaaaattatgatgagtttaggccaggatatggtgaaactggcatcgtcatatgccaggttattgagtaaccttcctcaaaagttctttactatctttgaaccactacaaatgcataatcgttcaacagtgtcaaaaagtatttatttgaatgtggtgggagaatgaaacttcttctttgggttataacctggagtatgcttccagatggtgattgtgcccatttgtacaaatagaaagctacaagaccagtcttccgagcccatgtctgtgatctgcctatgtaagaagaatagttttgtaatagagtttgcttccaagggaatctctatggcatagtattcttacatccctttttatacatctggacactgagacacggagggtttaggtaacttgcccaagaccacagaatggggtagcctgggtctaagcaggcaatctacctatcagtggagactgtgcactttaacaatcaataaatggacaaaaggacgtaaatatataattcaacaagagagaaaattccagtattgtcacagtgaaatgcctgtgtgttaagccttaggcgagagacatgggcagggccatggagagccagtggccagctgtcccatcgcacttctcacttacttgtggaaaggctgatggtggactaaaggttacaaaagaggtcagctcaccccttaactataataaccctgtgggagtgagactaatgctatagaaacccagagtaaagcagaatgtatagttacatcttttaaaaaaaaaagcattggcaatctgtagtgggactggatactaagatagaatttaaaacctgtgagttatattttccacgcatttaattaccttgttttactgcctaggcactttacttggtacgatcatctttattttaatcatcattttcctctattggataattttcaagcacagaaaaaggtaagtatagccatattatcccaagaaatgtaaactgtacttaccccctcttggaagtcaaaagaaagtaaaagacaaacaaacccattgctacataaacagatgtggtaattcttataaagaaggtccttgacacacagtatagacaaagaggtattcacactaaaggaagtatataggatactaagaacaattaaaaaataataataataacaaaaaaccagcattttggccaggtacagtgactcatgcctgtaaattcagcactttgggaggccaaggtgggcagattactagaggccaggagttcgagaccagcctgggcaacatggtaaaaccccgtctctactaaacatacaaaaaattagccgggcgaggtggcacacgcctgtaatgtcagctgcttgggaggctgaagcacaagaattgcttgaacccaggaggcagaggttgtagtaagctgagattgagctgttgcactccagcctgggcgacagagtgagactacatctcaaaacacacacacacacgcacacacacacaaacacatagcattttaagcaagaattgagttttacagaaagagaaagtaggcagaaggggtttttaaaaagttgttcatgaggctgtttgatatcctagttttgctaagacattgcagatactgacctctaagcccagatcctatcatagcactagaagttagattgggtcacttatggcacacataggctgccagtggggaagaactgagactttccattgggtattttaatatatgaacaaatattttgtaattacaattaactttttttttttttgagacagagtcttgctctgtcacccagcctagagtgcagtggtgcgatcttggctcaatgaaacctctgcctcccgggttcaagggattctcctgcctcagcctcccgagtagctgggactacaggcctgtgccactacgccaggttaatttttgtatttttagtagagacagttttgccatgttggccaggctggtctcaaactcctggcctcaagtgatccacccgccttggcctcccaaagtgctgggattgcaggcatgagccaccatgccaggctaccattaactttttacacttgaaaaaaaattccaaaaattaagatctgagtaaagaaatgtctttgacagggaagagaacatacgcagcttttgtactggttgactgaaatataacaacatcaatgaggccagaatcaataatatcaatgttataaggttgatgagcaaattctatatccataaaaaactgagggccaggctcggtggctcacgcctgtaatcccagcattttgggaagctgaggtgggcagatcatgaggtcagaagttcgagaccagcctggccaacacagtgaaacccccatctctactaaaaatacaaaaagttagctgggcatggtggcgtgtgcctgtagtcccagctactcgggaggctgaagcaggagaatcgcttgaacctagaaggcggaggttgtggtgagctgagatcgcaacactgcactccagtctgggcaacagagcagactctgtctaaaaaataaaaataaaaaaactgaatttgcaacttttaagtgaacagttttctacaggaaatattctaaacaagtacagtttcctacaatgagctttacagcaatcgaagttttcgtatttcacagagatttcaatacactttttaaaaagtagtttgtcatagtagatcttgctgtaaacaacctagtcaggaactcaatttcatgggaaaatagtgaattggttgacatttaaatttaaatcattatccttcctaactaatgttctctatatcgtatggcttgacatatagatgttctttgctcttttctattacaaaaagaaaagataagtagctgggcactttaccttaacaaagtacttgtgtcaatacatttttctcttaaagtttcttgttaggtaccactataatttgtgagttatttttattttttttttgagacgagtctcgctctgtcatccaggctggagtgcagtggtgcatctcggctcactgcaagctccgcctcccgggttcacgccattctcctgcctcagcctcccacacagctgggactacaggcgcccgccaccacacctggctaattttttgtatttttttagtagagacggggtttcaccgtgttagccaggatggtctgatctcctgaccttgtgatccacccgcctcggcctcccaaagtgctgggattacaggcgtgagccaccgtgcccagcctatgacttaattttttttttttaatttactaagtctgaattaaagaagttggggcttctaattttctgtatctataccagtctctagttgaaactacacaagggaaatgattatctcttccttttgaaaatattcaagatactttaatatgttgaagatatttgagtatctccacccttctaactatgtcattcttcattccttatggcacattccttgttaatcaactagagggtcagattcccaagcctaactattgatttgtttcacctacataatttaagatcatttcctcatattaatcatcttcaggcataaacatgactcaataaccatttcataaaattatttctttagaaatgattatcttgtatagtttaagcaacctcagagcatataccatttcttcacattttccatctcgtaaaacctgcctactttttcatattcttttaaagtgtaatgtccatggcacaaccattctctctctgaccagtggctaccagaaatgtggcagaaagaaagatcatgatcctcgttagacttaaaggtcagggaggtaaacctcccaaacatctatgtaacccacactaaaacctattctatatgtgtaatccaggaaaatttttaaacattttctaaacttttatttttgacctgtttcacttcttgggattgtaactgtctgacgtgttcttcctgcctgtcatacagacaaaaccaattccctgagatcatggtatattgcagtaaagaaagagatgaattaacacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctagttgggggccacaggaccagttgagtcatgagtcacaggtccaggtagagtcagtcagttgccaaatgcaaaaatctgaaaaacatctcagaagaccaatcttacattctacaatagtgatgttacctataggagcaattagggaagtcacaaatcttgtgacctctggccacctgactcctgagcagtaatgaattataagaactatgcctatattttagcagagttcaggtccctctcctaatcctaatcttttggcctttcattagctttcaggccctgagcaaggagggagctagttttaggaagagactgttattatccttgctccaaagttaaattataaactaaattcctttcatggttagcttggcctacacccaggaatgagcaaagccggcccacctgtgaggctggaagcaagatgaagtcagtcacgttagatttctttcactctcagaatctttgcaaaggtggtttcaggatagtgagtgcatttctctaacaaaacaccattgattttcatgttagaaataacatatagctaaaattggaaaaaagaagtaataaacttaaataatcagaaggcagaggtcccttcttttggaaggagttgggctaattaatcatgcagtcatacctccttgagtgggtgtggccaataagctaagtcattgtggctatgtgaggagggccaattattccttatctggagctcaagctttcctcacagaaagagaagggcataaagggcctcatggcaaagaagaaggaagtcatgtgggaaacacagaatatgagtggagagtatcgtagtggtcatcaagtaagaagagccgtttatcctggagctaaaaaagactgacagatatagaatagtgtagaacaagatggcctgctctatgggagagccacaatcacaccaggactagacagtagcaggctgatgtatatctcaaacactggagacaattcagaaactgcataaacagtctgaagacttactaagaaactaaaatgaggctgggcgcggtggctcaggcctgtaatccctgcatttagggaggcctaggcgggtggaccacctgaggtccggagttggagaccagcctggactacatgataaaaccccatctctactaaaaatacaaaaaattagccaggcatggtggcgggcacatgtaatcccagctcctcaggaggctgaggcaggagaatcacatgaaccagggaggcggggttgcagtgagccaagatcgtgccactgcattccagcctggacaacaaaagcaaaattccctctcaaaaaaaaaaaaaaaaaaaaaaaagaaagaaagaaagaaaaaagaaactaaaataagacagaaatagaagtaattcacacacagaaatcatctcaccttctttaaaatgctcctcaaggaggcctactttaacgatcctagtaaagatggtatgactcgtatgacccccacccccacattcccaatctttcttatcctgctttatttttttgtatacttatcgtttattataattaattaaataattaagtttcttgtttattgtctctctccctccatgaagtcggggatttttgtcctgtcttcaccaatggatacataacaaatctaaactgtccccggaacaaagagagtctcaataaatacttatcaaatgaatgagtgagctaaacactactaagagtgttaccacaaggggaaatttctgctctaattaattctctaccaagttaaacagtgcatctttaacttgtcctaagcttactccaggtttcaaggctgctccttgtactaatataccaactgtctcagtctgttggtatagatacttgggcagttataacagaaactccatagactgggtggattcaataagcatttaagctgggtgcagtggtactcacctatagtcccagctactcgggaggctgagggaggagtactgcttgagcccatgagtataaggccagcctgggcaatatggcaagaccccgtccctaaaaaacattatttcatttctaaaaaccaagcatttatttctcatagttctggtgggtagagcgtccaagatcaaggcaactgcaaattcagtgtgtggtgggactcactttctagttaatagacttcaatcttttctttgtgtcctcacctcagagaaaagcagtgagggagctcttgcgggtctcttttctaagggaactagtcccattcacaaggggtctttgagaagtaattagatactataaattttcaacatataaatttggaaggattcaaacattcagtccattgtacaaacactgaatttgataagcacatctgcttaaatgatatcacatgtgttgatttcatgtgcttttccacctttgtttctaaattccgttaacccatctctgaattcattcaaccaagactctctcccagacaactctagtccaaaataatgtctgtctttgaaactcacatttcctgactatactattttaaaaataaactgggaggagccaagatggccgaataggaacagctccagtctacagctcccagcgtgagcgacgcagaagacgggtgatttctgcatttccatctgaggtaccaggttcatcccactagggagtgccagacagtgggcgcaggtcagtgggtgcgcgcaccgtgcacgagccgaagcagggtgaggcattgcctcactcgggaagtgcaaggggtcagggagttccctttcctagtcaaagaaa

SEQ ID NO: 12516 - DNA, 21872 bp, Homo sapiens
atttatttatttatttatttatttgagacggagtcttgctctgtcatgctggagcgcaatggcacaatctcggctcactgcaacctctgcctcccaggtttgagcaattctcctgcctcagcctcccgagtagctgggactacaggtgcgtgcaaccacgcctggctaatttttgtatttttagcagagacggggtttcaccacgttggccaggctggtcttaaacttctgacctcaggtgatcgcctgccttggcctcccaaagtgctgggattacaggcgtgagccaccgtgcccagcctatatttacttttaaatggtcctgaccaactaaatgcatttcataatctattgaaaaatactgactaatgaacacatatatacttgaatattattttatgtctttccttgggtttctctctggtttaaataacatcaacacccttactctttcctaagaactgtttttaaacctttcaataatttagcatggtctttttccagcttcttgcattgtctccaaactaagactctaagaaagtcttggtcgttgccaagagcatgtggattacttcccagtaccaagacttccagctccagctcgatccagctcttgccctccatcagtcagatgggctttccaaatgacacaactccacatccacctgcccttgggaatcttctatctgtttggcccccaagtaattcactctaggattagaaaggatggccaggtgaggtggctcatgcctgtaatcccagcactttgggaggccgaggcaggcagatcacccgaggtcaggagttgaagaccagtctgcccaccaatatgatgaaaccccgtctctactaaaaatacaaacattagccgggtgtggtgcacatctgtaatcccagctacttgggtggctgaagcatgagaattgcttgaaaccaggaggcagaggttgcagtcagtcgagaccatgccactgcactccagcctgggtgacagagcgagactctgtctcaaaaaaaaaaaaaaaagaaaagaaaagaaaagaaaagaaaagaaaaaaaaaggaatcagtcccttctcataaagcatttacattcgagttgtagtttcagggtccttgtttgtttcccatctgtctgtctgtctgtctctctctctcgaccaacctgtgtagagtgttttgcgaaaaacacacatgtacaagttactagattgactcttttttttttttttctgaggcagagtctcactctatcacccgggctggagtgcagtggccatgatctcagctcactgcaacctccgcctcccgggttgaagcgattctcctgccccagccttccaagtagttggaattacaggcgcgtgccaccaatcacggcaaatttttgtattttttagtagagacgaggttttgccatgttggccaggctggtctcgaactcctggccttccaaagtgctgggattacaggagcgagccaccgcgcccggcctattagattggctctttatccctgctgaacatctctagttcttcttcgactcactttgaatcctggaagcaccactacattaaatgtctcttcatactaataagaattttcgtccaaatcgcgcaatcacctccagggccaggaaaggggacccccggtcgggagtgcggactgggcgtggtcactgaccccgagcgtcccctccttctggctgacacgcggctgcagacgcaggagcctcctgctggcgactggagtgtcactataaataattgaggccaacacccgcggagtgacattccaccccggtaggcctggcctacagctcccagcaagcctcgcgcaagctcgtggactccatctcccggcgggccggcactgccctgccgggcggtcaatggcccgctctgagtaggtttttccgtttttacctgacagctgagaatgtctggaagcggaggggcggtagcagcctgcctgggaatgggccaccccgaatcccgacccgaaataaatgcaccagcatgctgacgcggtaaaacaggagccgccggcaatagcagtttcaccctcatcccactgagggctctatgttggctcccgcccccatcccgacaaccccctcgcgccttggcggtgattggtgaaaagacacatcaatctcacttcaagctgtgattggaggatatgttgtcagccccctccttttggaactgtgattggagggaatcgcctatccgcccgccccctgctctgggcggagccgagcaggaagtgggcctggcttttgccaggtgctcctgtgggctccgggtgacgtccaaagggtgtggcccgactggccctccaagctatggagtatccatagtaacgcgtcagccgccgacctcgggccattttcccaaggctccaggatctctagatgtcccgtcgtctcaagggcgtgtagaacgcgggttttgggggaggaatgaacaaaaatcgactgggagttttttcaaaacacgtacatatgccctgccacccaccccgctctcctaggtgcgtcagaactgctgggacatctgtcacgtgaaggggtgggttgcccctccacacctgtgggcgtttctcattaggtggaaggagagacttggaaaagaaagagacagagagacaaagtatagagaaagaaaaatgggcccaggagaccggagttcagtttacggaagatccacgccggcaccagcctctgagttcccttagtatttattgatcattatcgggtatggcaggataataggataatagtggagagaaggtcagaaggtaaacacgtgaacaaacgtctctgcatcgtaaacaaggtaaaaaaaaaaatgctgtgcttttgatgtgcatacacataaacatcacaatgccttaagaagcagtattgctgccagcctgtcccacctccagccctaaggcggttttcccctatctcagtagagataggctttacaccgagacattccattgcccagggacgagcaggagacagaagcctttcttttatctcaactgcaaagaggcattccttcctcttttactaatcctcctcagtacagaccctttatgggtgtcgggctggaaaccttggacaatacctagctttcctaggcagaggtccctgcagccttccgcagtgttttgtgtctgggtacttgagattagggagtggtttgagattagggagtggtttgagattagggagtggtgatgactcttaagaagcatgctgccttcaagaatttgtttaacaaagcacaccgtgcacagcccttaatccatttaaccctgagttgacacagcacatgtttcagggagcacagggttgggggtagggttacagatcaacagcatctcaaggcagaagaatttttcttagtacagaacaaaatggagtctcctatgtctacttctttctacacagacacaggaacaatctgatctctctttcttttccccacagtcacgtgtacttggggaagaactcccccggtgattctgacactcttgccctacgcctcagccattgagaactattggtatggagggcctgtaatttatcaaggcgcggcctcagatctgtctgcctcgcagataccttcctcacccgggtcagaatgacttgcctcaggctcctgccaaagagtttgcaccactcgtttcttccctgtaattacttgtttgcgtatttgtctccccactgggctgcagcttcttgggtagtggctctgttttattcatctgtcctcttcccttccaaatgcttggcaaggaaaagtgccctttaaaataaatcgacttgaattgggagtggtggtagggaggctgtcaatgagaatgaattcagggtgaaactaggtaggacaatgtcccaggattagtttggggttgagctggggagctcttggtgtatgggggggtcctattgtgactatggtggaatagccacgatactgagtgacattgggcgagtgaggtgggggagagactagacaacaccccacataacccatcttgacagatgtctcagaaagattatgggaatttcctggcccctctgcaatgtgggattccattttgctacctctagaaggacagggtcttgttttcatagctctgcctcctactctgagataaaggcatgcaagacctgagctactactacaataccccacacagaaggagaaaatcaggcacatctggattcaagttttgtgggtgattccatgattgcctccagtgaacaatctgggaagcacagtgtccatatcgccatttcaggggtactggccccaacatcagcccttaggcctaagccctagagaccttgacacctggtggctgagtcagtatctcagtaatgggctttagaaggaaacctggtgattcagggcctcaagaatggcgttgggcaagccaccagaccagctgcctgggtctcctcctccttgttgaggtgacaacaaggaactcagttcagctcctccctgggtatccaaattatccttccaagtcccagactcacagctgtcctcccttctgattcagccctgatgcttttcagggggtcccagaagtgggatccggacttgagagaatgtcacagttgaaaatgataaggatgcaaacggaatggaactttcagagaaccccaattttctactctaagttctccaaaccaactctcaaatccaagatagctgcctttcctttcttcacctcctcttcttagttttccccaacttggctgcaaagtcagcctcccctcttctcttccttagcacctcagaccaataaaacatgcaaccttttcttattctttttaaaaaatttatttttgaccaggcgcagtggctcacgcctgtaatgccagcactttgggaggccaaggcgggtggatcacgaggtcaggagttcaagaccagcctggccaacatggtgaaaccccatctctactaaaaatacaaaaaattagctgggtgtggtggcacacacctgtagtctcagctactcaggaggctgaagcagaagaatcacttgaacttgggaggcggaggttgcagtgagccgagattgtgccactatactccagtctgggtgacagagtgagactgcctcaaaaagaaaaaaaattattttgtttgttttttagattttgtagagatggtgtttccctaagttgctcaggctggtctcgaactcctggcctcaagtgatcctctcgcccgggcctcccaaagtcctgggattacgggtgtaagccaacatgcctggcccctttacttcttcttttctgttttggtcacaaaacatttctctgttgatcactgtagtgtgtgtgtggagggaagtgggggaggtacactcttaagaaatgaaatagttaacatcttggccctaagatttgttgtagagatggagtcttctcattctgttccccaggctggtcttgaactcctggcctcaagcaatcctctttcctcggcttcccaaagtgctgagattgattacaagtgtgaggtactgcgccctgctacaatcctttaataggatgtttttggggggggtggcagggggcaggatctagctcactgtaacctatactgttccagtgtaacctgcaccaagccatcctcccacctcagtctcttgagtagctaggaacacaagcacacatcaccacacctggctctaacacgattttgctttttgcttttgtcattttggctgctgttctttttatctttcattcattcaaggtctgaagatggagataataggaatcttctcatctcaatgtgctctttggcccctcctcttaaactgatgcccctctcaggccctgagggatttggcctcaggttgccctggaaggggtgtgagtgatcagacaggtgactgagagctgggacgcctgaggcctgcctaggctgagtcacctagtaatgttgttgtcattgttcctgttgaagtcccagctcagtgtcacagacctttgtggaagcaacaacagctcccatccttccaacctttctggagaagccgtggcctgatggtgagccgaatgggctgggrggggagaagaaggcggctggggcggtggggagatctggggcccggatcggtgcccctcctccccatgccactgccacctcctcctcctccttcatgccggggacctgggggagggaggatctccatcttctctctgtcccctgcccctcatacaagaagctccccctcctcattttcccctcccaccgcagggcccccttgctcagtgctacaggggacaggggcttctcagtcttgccacagtgctctccctatcccagccacccccccaacacaggctcaacctgcaatgacacctgcctctgcatctccctcctggggatcccactccaccccacccctggccccggcaacccccactccctcacagcagtgcccccaggactctcctgggctgcgggtaggccctttgatccctgaacaggattatgagcggctggaggactgtgaccctgaggggtcccaagactcacccatccacggggaggagcagcaacccctgcttcatgtccctgaagggctccgaggtatgtgtgtgggtgtgggtgggagagggttagtggtgcctgggagctccagtacttaccccaggctgggcctctggcagcgggttgagaacgtggagaattgatcacatgccaggggctgacactctcccctctgtgcccaggctcctggcatcacatccagaacctggacagtttcttcaccaagatatcctttgcgctaggcctgcagaggtggcatgggaaggtcctcttggagctggcactgttcttggcagggagactccgtgagggcgtcatgggtgggagacttgttggggctgaggggaggtgtcctcaggagaggccccccgtgcctcaggcttgttccttgacacgcagccacatctacagctaccaccagcggaatggctttgcctgcatcttgctggaggatgtcttccagctggggtgagacgcttagcccgggcccggaactcrgtcccctgggcccatggcttccttctgtcattttgcttccttaattgtgccagctgcttccatcccatgctttccygagcagcccaagggctcagcaggggcagggtcagggaggataaccatgggctgctctgggggctggggcaggagcccacctggctgtccctgatcactgcagcatcccggyacccccmcttcctcccggcagacaatttattttcattgtcaccttcacaaccttcctccttcgatgcgtggattacaatgttctctttgccaaccaaccaagtaaccataccagacctgggccgttccacagcaaagtgaccctgtcagatgccatcctaccctcagcccagtgtgctgagaggttagtgacaacctggtggggccctgggggtgaagcatgggcagtgggtagaggagtagaygggagccccactttgtcccgtcatctagatcagcagttctcaaagcttttggtcttaggaccaaaaatacacttaatatactttaagttgtacttaagtgtattaagttgtacttaaagtgtattaagtatatcttttttttttttaagacagagtttcactcttgttgctcaggctggagtgcaatggtgaggtcttggctcactgcaacctccacctcccaggttcaagcaattctcctgcctcagcctccccagtagctgggattataggcgtgcaccaccacgtgtatttttagtagagacagggtttcaccatgttggccaggctggtctggaactcctggcctcaggtgatccacccactttggcctcccaaagtgctgggattacaggtgtgagccactgtgcccggccttttaagtgtatcttaattacagtgcattaagtgtatcttaatacacttaaaattggttgagaatcctgaaaagcttttgtttatgggagtcgtatctatccacattttaccttataaaaaattaaaattaggccgggcatagtggttcacacctgtaatcccagcactttgggaggctgaggcaggaggattgcttgaagccagaagtttgagatcagcctgagcaacaaagtgagaccacatctctataaaaaataaaaattagctgggcttggtggtgcgtacctgcagtcctagctaagcctagtcaggaggctaagacagtgactgtctctgatcactgcagcatccctacaccctcctccctcccagcagacgattcattttcattgttgccttcacaaccttcctccctgaagcatggattgcaatgttctctttgccaaccaaccaaataactgttccagacctgggccgttatttggcagggagataggagctatgtttctactgctgcactacagcctgggtaacagagagagaccttgtttcaataaaaaggaaaaaaaaaaaagaaggaaattgtagctgagaacaactttaaaatgtaagagtgcggctgggcgtrgtggctcacacctgtaatctcagcactttgggaggccgaggcgggcggatcacaaggtcaggagatcaaaaccattctggccaacatggtgaaaccctgtctctactaaaatatacaaaaattagccaggtgtggtggcgggcgcctgtagtcccagctaccctggaggctgagacaggagaatcatttgaacccgggaggtggaggttgcagtgagccaagattgcgccactgcactccagcctgggcgacacagcaagactccatctcaaaaaaaaaaaaaaagagtgtacaagcacacatttcatcagctgtcagtgtgatgtgacatgttcaygtgtcttgtagcctctggaaaactccactgtactctcagagtacaagaatgaaaacatcagaaagcattagtattatttggaaaaagtttgactttgcacatttgtgaaggccacttcagcacccaccccctgccccgggctctaccttgagagctgctggtctasctagatccccctcctcatgatggtttttcctcactcccgaagtctggtctgcctctttctcaggcgcccacctttctcccccactgcccgcccaaccccatacaggatccgctccagcccgctgctggtcctcctcctggtcctggctgccggcttctggctggtccaactgcttcgctcagtctgcaacctcttcagctactgggacatccaggtgttttacagggaggccctgcacatccccccggtgagctgggtggctgtgtctgtgcagagggtgccgtgagagggtgggcagaggagaggggaagaagtgggactgtacaggtggaagggccaactggaaagagggcagaaagagcgaggtcttattgacacctgccctaggcccagaataatgtcaggagggggctaccaccacctagagagcatggcccttaccctaagggagtttagtttatttagatggctcatataagatgacatatagttacatgtttgtgctaaaaacattgattagagaaaagagaaagggcagttatctggcttttcagagctggaggaatttgggttgggcttcggaagggcaggacaggaggggaggggagcacattctaagccccagtgcaggaaggtggggaaaagccatgagcttttggaagctgcagtgaggagatggacccatcagcctaaaacagagccttcaaagccatcccccgcattgcaggaagccactgcattggcctgtcactgtccactgcttatgctctgccctttgtttcctcaccatcttgagtctgctcctccctcctctgtatctaagttctttctttgaggcacagcttgaaagtagccttctgcagcttgcttcccttgctcccctgggaggtccggagccctctgcacagcctttatgtgcagcaaggggagaggtcttagaaggcccctgagcagaggagagggaggaggccrgggaagcagaggtggtgagagcggaagctggacctcggattggctctggcgggagactgctcacccgtctcgttctcctcctcccttctttcccctcctcccctgttccttccaggggaagggaagggaagacactgggatgtactggagaggccagcctgggggacttgactaacctggactgggaaagctgagtgaaactgggctgaagtgaggtttgcagccttcaaatgagatctgacagtgccccactgccagatgtggacatagcccaggtcctgggaaggcttctggtgacagagccgaagatggcctggagtcgggtggggctgggagtgtaaagcatgcccaggcagaaggtggggaggattctgttccagagttggtgggtgcactggaaatgggaaggagagattctcccacgaactgccagacattctggttttttgtttttttgtttgttttgtttcttttgagacagggtctgggtctttcacccaggctggagtgcagtgctgtgatattggctcactgcagcctctgctccccagtagctgcaaccacaggtgcacaccaccacgccctgctattttttgtatttttagtagagacagtgtctcaccatgttgcccaggctggtctcgagctcctaagctcagacgatctgcctgcctcagcctcccaaagtgctgggattacaggtgtgagccaccgcccctggccagccagtctgttttgtgtgtacaactgagggggcctcaggcccttaaggagctgagaagccaggtccagcacctggaggcgtccccaggaagtgcatgactactggccacatgaatggcagggatgatgaacagggcagtttagaagaggatgaaggaagtagggcgcgcccttgttagtgacagggttaagggagggcagaaagagaaaggtgggagagggggacgatgtagcttggtcatggcgagtttgtgatcgcaaactcagtttgcgggttttcaggccgcacacttaggggtgtggagcttgagcatcactgtggagaggaatggggggtcgctggctctcatcagtgcccctttcaggaggagctgagctcggttccctgggcagaggtgcagtcccgcctcttggcactgcagcggagcgggggcctgtgcgtgcagccgcggcccctgacggagctggacatccaccaccgcatcctgcgctacaccaactaccaggtggcgctggccaacaaaggcctgctgccggcccgctgcccgctgccctggggaggcagtgcggctttcctcagccgcggcctggcgctcaatgtcgacctgctgctcttccgcggtcccttctcgctcttccgcgggggctgggagctgccgcacgcctacaagcgcagcgaccagcggggcgccctagcagcgcgctgggggcgcacagtgctgctgctggccgccctgaacctggcgctgagcccgctggtgctggcctggcaggttctgcacgtcttctatagccacgtggagctgctgcggcgcgagcctggcgcgctgggggcgcgcggctggtcccgcctggcgcgcttgcagctgcgccacttcaacgagctgccgcacgagctgcgcgcgcgcctggcccgcgcctaccgccccgccgccgccttcctgcgcaccgctgcgccccccgcgcccctgcgcacgctgctggcccgccagctcgttttcttcgcgggygcactcttcgccgcgctgcttgtgctcaccgtctacgacgaggacgtgctagccgtggagcacgtgctcaccgccatgaccgcgctcggggtcaccgccaccgtcgccaggtgcgacggcagatgcccggggtggtggtgtgtgttggtttctctgatctggggccatgtgaggttccccccgaatccttacctctcccaccactggggccctctagccctacatcccaccgcgcgtcctcctaatcgcaggccccttccccccacggatcccgcctttcaggtctttcattccggaagagcagtgccagggtcgtgcgccgcagctcctgctgcagacagccctggcccacatgcactacctcccggaggagcccggccccggcggcagggaccgcgcctaccggcagatggcgcagctgctgcagtaccgagcggtgagggtgggcgcgacggcgggctgaggaggaagttgtggggtctgtctgcgcggagggtctgtctgcgcggagggtctgtctgggagagggcatgagacaaacggactataccaggagtctagggagtgactgggtggggaggcttcttgccctggcgagggtcgctggggactgcttggtcctgataacgcgcgtgggcccctcagcgacccctgctcagcctcaccgctgcttccccaggtctccctcctggaggagctcctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggacaccctcaggtcagagccgttccctggccctgggggtttgggctgggtgggagttcgcttgcctctcrggagcagacctgagttccagccctggctccaytgcttgctacctgtgccgttgagcgggtcacttcccttcctgtgctctcgtgccytcgtctgtcagatggcaacaatggcaatgtgctctccagagcacagccaaggccaggcttgtgaasacacagattatgtctgtatagcctatratggagttgctggcacatagtaacgtcagtaaatgggagcaaagaccacctgggggtgaggaatgggcttggccrgtgggtggggctgagtaaggactggtgcctggaccaaggctgtcaggatcaccctgggcaaagcactgaggctcagccctatccccgagctggcaatcagtccaggggtgacgaatagatgacaggcccaggttctgcactgctgctgtatttttgggtgatggtgaacaagtccccattgtggtctgtttccttcacgtggaagatggggcagtgtttcctgtcccacctgttcccataaggctcagtgttcttagcacctgaaagactgtccttgctcacagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcrgcccctccaccccgggggtgctcagcaactgcacctcgcccctggtgagtcccaagcctggcctccccttctgccttcacccccacaactcctctccaaacccttcccctctaggctcaccttaggtagtaacctgcctcaccagcccccgcccccagcctgctctcctgccttctttaggcctctgcttcctccctactccrtttctgtcctctcttctgactccctctttggctttccctctcctcttgcacccagcctgaggccttcctggccaacctcttcgtgcaccctctcctgcctccgagagatctgagcccgacagccccctgtccagctgyggccacagccagcctccttgcctccatttcccgaattgcccaggaccccaggtgaggagtggaggctgagatgcaggggcatgtggaggggggtgggctgatcctgtaggagtggggagctggggcgctgaggggggattcagaaggggagtcctctggggtgtggcgggaggagggcatgacttttgacstgcttcatgttatgttccagctctgtgtccccaggaggcactgggggccagaagctggcccagctcccagaacttgcttctgccgagatgagtctccatgtcatctacctgcaccaggtgagtagaggggtgcccaaaggagaaatgtggagagaaggcaggtgaacaacatggagactgaggtggggtggagtctacggaagggtctagcagagtggcaggaggaggctgaaaagccctctgcctctagcccaggtgcttggccctgccctccttggggtgcagccctcattcctcctcctttccatgcagcttcaccagcagcagcagcagcaggagccgtggggtgaggctgcagcctccatsctgtccaggccctgctccagcccctcacagccaccctcrcctgatgaggagaagccatcctggtcaagtgacggtgaggagggtggggcctgcaggggacagagcctggtggacactgggcatcatggaactgcccagctgatggcctttttcaccaggctccagtcctgcctctagccccagacaacagtggggaacccagaaggcccggaatctgttccccggagggtttcaggtgaccacagacacccagaaggagcctgaccgggcctcttgcackgactgagaygactcctcagggtcagyattgcctcctgtgaggggagggagaaaggacggcataggtagttggtttggagtccgacttgaagcgatgggagcagtggtgggaatttggggtgatgggaggtggtcatctctggaatctagacccctggactgcttgccaagagccgtctcctcccacaggtaccctggcttcggcagccacaggagattggagggtggagtagaaaaacacaaggagtcattgttagaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccagcagcactttcaggttccttggggcttgtaggggatggggacttgtcagtggaaagacgggagggatgatgtttttggacttcagtacgggtgtgatgtcccaggaagtgggtgtggctccccatcctgtatgaaataagcagtaaagcttgctcatggctgttgcacatctctgtgactcttgtttctggcaggccccactcctggcagctgagtgctgcacctgccttctcgatyacgagcctgagaactgcacgggggagcagcccagactggctggaaaccatgttttcagagtgcagggtcaagtggcgtgtaggactctgtyaaaagaatgacccctttccccaccacatacccacaactgcacaggttaaaacagaaatcttgtcattttataattgtaatccacgccgggtgcagtagctcacacctgtaatcccagcactttgggaggctgaggcggttggatcacgaggtcaggagttcaagaccagcctggccaagatggtgaaaccccgtctttactaaaaatacaaaacctagccgggcgcggtggcaggcacctgtaatcccaactacttgggaggctgaggcaggagaatcacttgaacttgtggggtggaggttgcagtgagctgagatcacgccactgcactccagcccgggcggcagagggagactccgtttcaaaaaaaaaaaaacaaaaaaaaaaaactgtaatccacatgagctggggtaggcactttagtagttctcctaacatctggcacagtcccttatggtaaatcttcaataataaatacttgatttagagattagactttacaggtaagatactcctgagagaggcaagaggaatctaacattcgactaagaaacaggaagcgggtggcagtaggccctggggtaccgctgctgggaggggccttccagattaaggcggacccaggcccgaggcaacaggcctagagagggaaaagaggcgttttgctccttcctggaggaataatgctgaatccttgcagcctctggacagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctgggtgcgtatgcggcttgtcacctcctgggtgcgcagcgtgagcccgaaaatgtcttcgtggtagcgttgctgatcctgtcggaaaagagcacagtggatcagaacccgactcggagaccttagcaggaaccccgcacgctcaggcccggcccgcccctccgcacccgcagcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgtaggtctgcggggcggcggggttagggcgggccctggtgggggtgggcgcgggggcgcagcccggggctgctggctggccctggacgtgaaagtctccggagcgggcctggtggggcctgcgtgccctggggcggtgtcaacaggggcagagccaaaggggcggggcaggggcgggaggaggcgggcctagaggggccggggcacaagggtgggccagagtgtgcaggggtggctgagtggtcgtgggaggccacgggagggccgtggttggtgtgccccgctggagagcgcgagtcctcccctctctccctatcttcaggttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcatattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccctctctttcctatttcctgccttccagccccacccctctgtccctagattgtgtgactcccttcaggcagtcctttagtccccagcctcacctttgctctcaatgtcatgcagccgctcctgccagaatccccggaagggggcaatgccagtgcctggacccaccaggatgcagggcaagctgggatcgggtggcagccggaaggagggagccctggcaggagagacactccatcaggtcccctttgcctttcctgctccaccattctcaccatgcagggtgggtggagcaaggaggacccaagttcttcccatctcaaaaaaaaattaaaaaaaaaacaaaaaacaaaaaacaactctacttgctgaaactccttggatctgtggtttctggagattgcaccaaaggaaatatagttcattttggattgaagaatacttagatgactcaggggatttagaaaacgtgggaagggtgaaagacactttcagttcataatgggttcactaagtgtgtttattttaagtatccttaatagtggtatttagtttatgttcagtagatgggtacggtttatttgtagtttagccacctgggtggatttgaatcaccaggcccagctgatggcagcctaggaactgttctcagtcctaccaggacttttggttcctggctgcgagagcgggcaagacttctggacacagcatgaaggaagggtctcttaaaatccttcaccctcggtccgggcgcggtggctcacacctgtaatcccaagactttgggaggcggaggtgggaggattgtgaggtcaggagctcgagaccagcctggccaacatagtgaaacaccgtctctactaaaaatacaaaaattagctgggcgtggtggtgggtgcctgtaatcccagctactcaggaggctgagacaggagaatattttttttttttttttgagacagagtctggctctgtcgcccaggctggagtgcagtggcacaatcttggctcactgcaagctccacctcccaggttcacgccataggagaatctcttgaacccgggaggcggaggttgcagtaagccgagatcgtaccactgcactccagcctgggcgacagagcaagactccatctctgggggaaaaaaaaaccaaaaccttcaccttctttgagtccttggtgacaccaaggccaaagggtggtcttaaccctaactagtagttctccctggattgagtgaggatttagtgactgtagttcccaggtgccatgctgcccaacatcagacagcccagggacatagagaggaacacagaagctttcagaaagccacagggccagccggtttgataccagctctggctctgggagctatagtttcagggcagaactctgagtctaaatgaatgagagagccaaagcttagccagagttctgaagtgacctaatgacaccacacccttgacatgttacagagctccttcctgtttccagtgacacccctcaccagtgacactcctcaccaaagctgccaccctgaccctgggcagctccccaccaagtcctccatctcacttacccccggatgaagcagggcacagggtctccgggcttgagctggcttagccacgtggagcagactccatagtgcagggggcccagcccatctgggggtgggaaggagaggccggtgaggggccagagaggggccggtcccaaccctgctgtggccaggcctgctcctgcttgttgcctcaccctgagtcctgtatgccagcacagctacagtgaggtggatctctcctgggtgggtgctgggtgccgagctgactgagtagtaccggggctggagcagaggcagctgggtgaggagcagtggggcaggcagcgccaccgacgggaactgctccagcacctccagcagcgtggggcagcggaaccacttccactcctcgtagcgtcggggatcctggcggggcaggatgcagtgggttggaggccccatagcccttcctagtaacctcccttcttgacccctcccccactgagcctctttagggtttctccctgctcagttcaggccaatagagttttctctaagacctggagaatccagccatgaattcctccctgaggagctgggtcttaaagcaccagtgcatgtcagccaggagaagaaagtccaggggggactttgcatgggggtttcctgccactggggtccccccagctcatcccgtctctctagcccctgtgcctcattggggtggcccccaacctggctgagggcctccagctcctgctgttccctgggctcttctgccaaggtgctgagcagccgcaagagctgagggctgggtggggaggtgatgtccaggaagaaggtgagagcctggcgcagcgtgcacgggggcagccgggggtcccgcacccagccggggggagggccacctggggatagtgcacagggagctctgaggacagggcccagcaggactgcagtacctgggctgatgtttgtgttttggtgactgttagagagcctgcccttgagcagcggggtcggcctgtctaggtagcctcagtgtattgttcgggggcccctggccggactgggttggtctgggctcctctgcctctgactccacccccttattttaaataaagcccaggcattgatgtggcagcaaatagccccagtgccagctccagagcaagctagattgctaggggagccttggagaggagcccagagggaggggacagccttttggtgggggtgcatttgagggtgtggggatggtccagcaacaaggccagcccggcagtgggcagcacagccagctctgagcctgcctgctgagctgtggaggaggtggccaccccctgggtcgggtcctgagctcctggaggcctggggccgggggtggggctgggcatggggctggtgtgccctgttgcttcccaggctgcccctcaccagggctgcccttctccagctgctctactgccacgggctcagtgggcgccggcgggtcctccacgcggctcagcagcgcctccacaaggccgggccggttgggcgggcagacacctatgtggtcccccggctggtactgcagcccctcctggcctccggtgtccaggcgcaccaggatggtggccctcctgggggtggggagaggggcacttatggggagtcagagaggggtgggggcgggagaatgtgggaggaggagggtccagggtcagggtgttcaggacaggggttggggggcggtaaagccgtcgtcctcacgtggacttgctgctttgcaggttttccactgagcggattgtagcctggaacatcttccgcctgtgcacgtggatcagacctgggggcggggaggggcaaatgaggcagcctgagctagggagcagggcctggccccagagtgctttagtcccggggtgtgggggcctcagagaaccagccgggttagggtgagggcagggcccacctggcagcaactgcaggccctcggcctgggcgctcagccggtacctctggcgcttccagctccgtttggggctgaagatgtctcgggcggcggccttggcatcctctcccacacagaaggtctcacaggcggcctgcgggacaggccggtgagggctgaggacctcccgccaccaggggtcgccctagtgaggcgcctgggcggcttcactgcgtcttgctcctggggggttggcagccccagtggctgaggccggcgccaaggacagcaccttttccgccagcccatttcatggattggccgctgggcccagggacccggctggctctttctctgcacgtcctgattggtgcatcgttccttatctggtgcgtgttaatcccgtgatccgagaagcatagtgcttggcacacggtagctctgtgaaggcgtctgtg

SEQ ID NO: 12517 - DNA, 138910 bp, Homo sapiens
aatcaagctcatttttagcacacttggttgcgttagttgtacttttcaattttcaatattatacaaggcatatattattcaaccttttcctgaacaagataatactaatatactgcttacggacagttaagtaatatatttcacactatttggtgacttttttttttaacctatgagacttactgaaatcagtacattatggtcacataatttaaagcttggctggcttttttttttttctttgctgataattcaaattctgtactttggcaagcaaaagaggtacaacatcaccttggagttttacaatttaataatgcatactttaaaattcatgataaatcatggaaccccactatactcactaattcaactattgatttctttttgagcaactgactttatgatttatccttaaaagtaaggaagtataccagaaggcaaaaggataaatccacccataaatactagagtctaagttattttcctgaaaaggtgaaaagggaatttctggtctttatcttttcccttatcaccttcaatcacacactttacactgaaattacttgtctctgtctcttcaacaatatactctgaaactttgtttaatatactttttgtctatttctgcatatgggagaccaatcttggattcccaccaaaaatggcctggttaccaaaatacttcttcattcagtagtttggtgtaagtgtttgggtgtatgtgtctatatgtgcattttaactccaaagaatgctaccttcagaaataaccaagatgcagtatgtatataataattcattgggccctttaagtctttgactcaaaaaaatctcccagaagctcctgcatagcccactactcatgaagaaccgctgggtatggagcacacctcacctgatggacagttgatttatgctcaccttaaacgctaattgagaagcagcacaaaagaggaactggaaaaaaactgaattttactcctcatctccgaagatgtgaatatttctaaaatttcagcttgcctcttgcttcttattggcaagtttccttggcttgtaaattttggacagcactatcaaggagctccatggactctctgagagtgacattgactttaaatgacttgggtttaatggttagaccataactgaaattcattttcgcaggctcatttgggttggccctgaaatcgcactggtgagccaggatggagatgaagagaaaaagctgcatcttagaaagttcttcgccaatgcaccgccttttgcccactgaaaaaatcatcactctgctggtcaggtccttgttgatgaggccatccttgtccaagaatcgagctggatcaaagttctccgggttaggccacttcactgggtcatgattcacagaccactggttgacaaaaaccacagtgtccttgggaatgtggtagcccaagacagaggtgttggcagtggtggcatgaggaatagtgacaggcacaaagctggagaagcgcatggcttcataaaggaaggccaggacatagggcaggttgggctggtcacccatacaaggcagacggtccctccccacgacctgatccaattctgcctgcactcgagtctgcacatcaggatacctgtttggtgtttaatgtggagagagaaaagcaagtgagcaaaattcttatttcatctagaaagcacattataatttattttaattccactttttcttaaataggctatctagctcagtgactaaattaatatttctgggaaaaaaaatctaaaacagcttcctaatttctcactaaattacaagatggactttaagaattatatttcctgtaataggccttgcatgactaatgctgtctttcccattataagtcaaaaaactcttaagttttcccagcctcaaaaagcacaatagtagataaggctgacttttccattgggtaccgcagggacagtgcctagggctcacaacactttttaggggcccatgaaaatatttttacgtcttttacaatcttcagacctaaaaaaactcacttttaggtagaagaaaatattttcatacatcattttaatgcattcatctttatatcagggtagtcatgaaatttaatttttaatttttttatagtataaggaatctacaaaggcaaaagcacccagggcccacgaaagttacaatgtgaaagtaaattttttttctccctcatttccctggacaattccaacagacatgctgttctcattttatacaaagataattggtgtcctgatggataaagctacatactgtattttttaaatttgaaagcaaatacccaatgttcataaaattatggtacaaactgtagtacttattcactgttgatgatacaaactgatacaatctttttaaaaaacaaaatcttaatacgaggcaagagacatgaaggtaacctcttcccgcctcattttaaacccagtaatccatgcctagaaatgtattttcagaaaataatttaagagatacaaaaatatgtaaccacaacaggacctaaaattctaaaaattagccaggcatggtggtacacgcctgtagccccagctacctgccagacagcggcgggagaactgcttgagcccaggagtttgggaccagcctgggtaaggtagtgagaccctgtctctaaggtaagtaaatatataaaattaaaataaaaattttaaaaatgcaatcaaggccaatgaccaacattaaagttcaataaatgattatatataactatacattatcatagcaaaatactatatagccatcaaaaattaccaaaataaatattaaaagattagaaatgtccactaccttgagtcaaagtgttagaagtcaaaaaacaagtaactgattgtttgcaactccgaaaaaaaatgtatacacgtatgtgatgaagtggagttatttttagaatcgcttcttcaacattatattgcaggagtctgccaacttttttcatagaaacatgtatggtggggagagccagagagtatctattttagactttgtggaccaaaccctctttgttgcactactctgctctgccttgtgttgtagagtgaacgcagccatcgacaatgtataaatgaatgggcatgactgcgtcaataaaacgtatatacaaaaacagatcgtgtaatttgccaagccctgtcatacgtcttttcactaaaaaggaaaaaaaagtatcagcatattgaattgaaagtgacctccaaattgttttatttctttttgccgcctaattggagtactcggagaactattgtggttctaatgaaaaacaaaggccgtttcaaaagttaaaatgcctatctgcggatgcacaaaaacctatggaacctattccgggatttccttttccctgatctctggttgacttttctttattcgatttctgcctctccctcacccaccatgggtgtttctatgattttaatactaaaaagccattttaagtatacagaaacttttaatttgtgaaggtagctgtacagtatctaaggaaatatagattgcagtggattttaataaggaaagagtcattctctgccttccaaacacctttctgtggcgcctgcagattcagcatctccaactgctcacttgtgctccaagaaatgacacaaaaccaggatttctggtctcttcggcaatcaaaatttgccttgcgaaacatttgcccctagggatagtgtttccacagtaaatactacaggccgcccagttaaatatggatttcagatcaacaagggctaatcttttagtgtgagtattcccgtgtaaaacttacttttcttttgccaaatctggcaacccgacaccagggacctgttgaatccgtgcttagtagagaccaacgtgggcatcagggggtccgctaactgagccaagcgcaggggccagaaacgtctgcaggcgcctcctggatatcccatctgcctttctgaatgctactctgctttcgtaaaagtgactgcttcttgtcttctaccccggcatttctcaaactcctagcgcggaggttttataaacctagcgctgcccgctagttgtggccgccttctgaaagtttctgtgcgggttacctgtcggctggcccggcctccatgggcttccttggcctggaacaaagccctgacgggcggcccgcttttagcgccagggctgggcggcctcggatgcacgccgaggactagcctaggagaggctgctgtgtttaacatatttatgacattaccttttctttcggaactattccagttctgattgtaatgcgccagggagagagatatcagggctcatctccaagcatttaaaaactcttgtttttccggggggtggaggggtctttgcaaatgtgttctcactcgcaagcaggggaggggacgatagagacaagataggagaccggaggggtcggggcaccgctgggtggggcgcgtgcgcgtgtcgcagccctcactgtgagtccctttaccgacgcgatcttggttttgaggggtggggacctggagcgaaaccccaaacccggggccctgcttgcaaactcagcatattctgtctctactccgcctttttcagaggagaaaagacctggcccacgcctcccagaggctttacctggtgaagaggaggagcagccactgcagcgcggtggacagggtgtcctggctggcgccgaagatgtcagtgatagtggccggtacgttctccaaatccagccgcgcgccaccaccgtgcgagtccccggccgccttcttttccgcagagaggataaaggcgtccatcatgtcgcggggggcggccccgggccgaaggctttcgcagtgcctcaagaacttgtccaggatgaagttgctgaagttgcggttgagctgctcgaattcgcggaaaacggtgcgcaccgggttggggaagtactgcagccagggcatcacgtccaccaggctgcccgcgcccaccgtgcgcccgaactcttcgttgtggctgagcagctcacggaactcggggtcgtcgtggctgtagcggcagccgaaacacacggcactcatgacgttggccacggccacgacggtcagcggcctcgggtcgaggaaggcgccgtccgcgctgccgcgcaccagcagcgccaccagctcgcgcgcctcgctcagcacgtggccctcgaggacttggcggctgcgcggctggcgcgtgaagaagttgcgcatcatgctgtgggctgcgcgccgctgcaccttccagtgctccgagtagtggccgaaagccatgctgcggccgccggacaccacacggaaggaggcgaaggccggccggtcggcgaaggccgagccctgctgcaccagggcctggtggatggcgcgctcgccattcagcaccactatggggcagctgcccaggcggatctggaaaacgtcgccgtagcgccgcgccaggcgagcgaacgagaggtgagccgcctggcccaccgccgccgcgtttccgatcagtggccacgcaaacgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcagcgcctcggcagacagactgacctgcggggaggtgcggtttccagtggcgcgggacagccggctccgagaaggaactgggacctttgcctagggcaagacgtcaacaggaacccgcaggcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcraggccgcacggtgtccccagaaccacgctcggtacaacctgccccggccgctgckctcgacttgggagcgcgccycgccccgagcgcacgacctcccttccctctccgcgrcttgagcttgcttcccggaaagccagtgtagtggcagcggtttgcctcacagcgcccctggttggttgtttaaattttatcttaggttctcgcaaacaaattgccacctcagtggaggctctttggcatgctaaattttttccagttcttgcggcgagatcaggaatccctaaaagtagccgctcccccgccccggggccccgacagtgcttgggcacacaaaggctcctggggcgcagctggccctgagatttcccgcgtagaggccactccaggtggcgccgcccgctggtgggcgcggggccgcccaggctgcgatggaagccgttggcgcagggcggggagccaagctggggcgactgggggggcctgggggagctagcggggcgggacccgagcggggcggagagtggcaggaggaggcgaatctccgcgcyccggcgaactttatcgggttgaagtttctsstgtcgcctcccctttgcgtgcggagctgggctttgcgtgcgccgcttctggaaagtcggctccagtcatatccctgggcgctgcctgcggccgctcctcccgcgcttctcacggcacctgacacgcggaggcggcggccgagggtggggtgccggccaccaccacccttggcgtggggtgccggccgccaccaccctcggctgcgcacgcacagtcgcgcctgccaggccagcgaggcggacgcttgggccaccacccgcaggccgagcccgggcgcgtatcgccacctcsstgcgcaccggcggctctgtggtcttcctgggcgcgcttgcggtcgcgaagggggccctccctttataagggaagccggaggcgctygggcgggggtggcttcccccgcctggcgcgccctttcctacatgctgatgcataggattttcaagacagctaagagaacaaggacttcacgaggcggggggaagggcgaactcgagggaagaggtgggatgtatctggttaaccaggtaggaattgtactggcttcatcaaaggataaatataaaagtgataggttcaccagggacaaccctgcactttgagctccactcgcgctgcgaatctcgtgctattattgacctgtttacagatgaataaactagggttcagagaggttgcgtgacttaacccaggtcgcgcagccatcaagaagtggagccagggcttgaagccaccaagtcccactccagatccttcacataagtttacacggaagaaaattgcagataagaggcccaaatgccttctttcctgcctcccttaaaaaaaaaaatgcacgtggggctaggcgcagtggctcacgcctgtaatcccagcactttgggaggcttaagcgggcggatcacttgaggtcaggagttcgagaccagcctggccaacatggcgaaaccccatctactaaaaatacaaaagttagccggacgtggtggtgcacacctgtaatcccagctactcggggatcaggggggaaggcagcagaattggttgaacgtgggaggcagaggttgcagtgagcagagattgcaccactgcactacagcctgggcagcagagtttaagtgagactctgtctcaaaaaaaaaaaaaaaaaaaaaatcagctggaagaactttttaattattgtttttgttttcataattgagaattctgagaatagcagagaagaaatagtatgctaaccctttgcaattaaattgcttatgagggaggccaggggagtgtgcctcatagctgaccctggaatgactgattacattgtaaagaaacacaaaggagtgtctgaaragaatctgacttcttgagagattgaaaccagcaatcaatttgctgacctgataaaraaatgtcttttcgtgatggctttttttatttttatttttatttatttattttttttgagatggagtctcactctgtcacctgggctgcagtgcaatggcgtgatctcggctcactgcaacctccgcctgccaggttctcctggctcagcctcccaagtagctgggattacaggtgcgcaccaccacacccggctaatttttgtatttttctagtagagatggggtttcaccatgctggccaggctggtctcaaactcctgacctcaggtgatccaccagcctgggcctcccaaagtgctgggattacaggcatgagccaccgtgcccggcctgtgatgccttttattcggtatcttttgaagagttttctggaaatgatttcacacaccatgatggggaacttagatagtgatggagttttagtttttgagcagttgcattggtttaataataagcgttggtttcccagaggtgagttggcctacacagcctttgaaatgagtttcatagcaaccttcccatgtccagctttagcaagatccttgcctaataattcaagactctggtgcatgcatcaatctctcatagactttaatttagtagacgggaattatctatgagctaatgccaatcctgagctgttgacattcctgaaagcctttatcacaatacctctgccagaatgagagcagatggaagttgcctttaagtaaattcctatttttaaaaagtataaaacgaggttgttcctaagaccgcctgtccaactcctcaataatgccatctagtttttagatcaactagatgcatgctttcctgccatcgcagatagatcagatatatcctccaagctgtagttccttgggctcagctctttttctaggacatgactcaaaaatcagaggaastaggttggtaagtgctgtcagaaagataagcccttatcrgttatggcaaaccaaaatgactggctatggtaacactttttgcagagaatcttcaagcctggagttcttagggctttatggtgcaaacttcattgaatgccccatccggtaccctgataaggacttcggataaatccagagcagcctgttggcaccccgacccaactcaaggcagagccctgcctctagtgagaatctacgcaggctctttaattatcatcacaacttctcaaccaaagcagggacctaaggcccaggaatctcctttcaatcaacacagaatatgggcattctgccctcccaaatctcaaacttgaattgtttgttgcaaataactttcaaaaagaacagctaagctagagggatagtttaaagtagagagaggtttaaaatatcttatmttgtattgactcgaaggaacaacttaagcttgtttaagcagaacaggaatgcactggcccatgtgcagagaaggataaccgtgatgcttcacaggatacaaggacccaggccgctctaccggctctctgcctatgctggtctttgcttgggctttctctctttgcatggcaaggaagcagcttaaaattaacaaaacaaagagaaagagaacagctctcttccagggtcctagaaggactccagggggccaggctggcatcaggtttttaccctgtgggcaagggcttgttctgtcatcagaaaaaaagagatggcagaacatgctaggaagccaaagagctgacccagtccactccatgtatacatgtctgcccactggtttctttgggttggaggataacctaaggaaacccaaagccattattgttattattattttaaatcagcagatayatgcattgcccttagagccagtagcccagaaagctctgcccttctgctgtcaggctggaactcagttttcttcatggtcttcctctctagtgtgacccctaagtcagtttaatgggtagccactgtgcttttccagtcatctccaaacacacatacccacatgcactgaggagagtggaggagaataagccatctctggyaggctcttgacatttgggtgggcaggattcagtcatcaggcacatgctggtaggcaagaggagcagaaataaggagacacaccaagtggctgagggtgcgatagagggaggaactgtaggataatgcacaccaggggctggaccatgaaaggaatcttaggaattgataccaaaaccctgtgcctcacctgaaatgctccacttccttcctcctggcaatacacaggcagagaaccacagagctaatagaaaggtattttatctaatctcagaagccatcatttgtaggatgcacccttatttttatgtactaacataaagaaaggaagctaccaattataattgcatcatcgactctaagatacatccagatttcggagatgtaaaatggaaagttgagggtatgatttggagctgacaaagcattatacatttcatgcgcgtccgtgtgaagagaccaccaaacaggctttgtgtgagcaataaagcttttaatcacctgggtgcaggtgggctgagtctgaaaagaaagtcagccaagggagacaggggtggggcggttttataggatttgggaaggtaaaggaaaaaggggggttgttctctggcgggcaggagtgggggtcacaaggtactcaatgggggagcttttgagccaggatgagccaggagaaggaatttcacaagaaaatgtcatcagttaaggcaggaacaggccattttcacttcttttgtggtggaatgtcatcagttaaggcaggaaccggcgatctggatgtgtacgtgcaggtcacaggggatatgatggctttgcttgggctcagagggctgacattcctgtcttcttatattaataagaaaaataaaactaaatagtggtaaagttttgggacagcgaaaatttttgggggtggtatggagagataatgggcgatgtttctcagggctgcttcagcgggattaggggcggtgtgggaacctagagtgggagagattaagctgaaggaagattttgtggtaaggggtgatattgtggggttgttagaaggaacatttgtcatttagaattattggtgatggcctggatacagttttgtatgaattgaaaaactaaatggaataagagaaggagaaaaacaggtataaaaggtctaagaattgggacaactcaggacatctgattagagagtgcctaaggagattcagcacagtcctgccagcaaagattatttatttacttcaagagttaagagtggcagtttggggatagcaccaggagatatcagctgtgatggcttggagaaacagcgtaaaccggcagtgtaaataagagcagggcgtgtatgastrgttgagaacggtgaataggagtatgactagacagaagataatagggatgataagtttttttggggcacagtctaagttggtctggtgtctggaatgagactggggcctaataaaaaggagcgtctatacaggagctcaaatgggctgtaccttgtagcattctgaggacaggtctgacttctgagaaaggaaagtcgtaaaagtattgtccagtcctttttaagttggtrgctgagcttggtgaggtgtgtttttaaaagacctttagtccgttctacttttcctgaagacggaggaccataagggatataaagrtttcactgaatactaagagcctgaaaawctgcttggctgatttgactaataaaggctggtctgttatcagactgtatagaggtgggaaggctaaactgaggaattatgtctgacagaagggaagaaatgactgcggtggccttctcagaccctataggaaaggcctctacctatccagtgaaagtgtctatttagactaagaggtattttagtttcctgacttgggacatgttgagtaaagctaatttgccagtcctgggtgggggcaaatcctcaagcttgatgtgtagggaaggaaggggcctgaataatccctgaggagtagtagaatagcagatggaacactgagaagttatttccttgaggatagatttccatgatagaaaggaaatgagaggttctaagaggcgggctagtggcttgtactatagcatagcctgcctttgctggtgtgtggcgattaggcctggtggaactgccrtcaataaatcaagcgtgatcagggtgaggaacaggaaagaaggaaatatggggaaatggggtgaatgtcaggtggatcagagagatacagtcatgggggtcaggtgtggtatcaggaataatgtgggaggccggattgaagtccgggccaggaacaatagtaattgtgggacttaacaaagactgagtacagctgaaggagcyggggagcagaaagtatatgcgtcaggtrtgaggaagaaaatagattttggaagttatgagaaatgtagagagtgagttgagcatagtttgtgatttttagggcctctaaaagtattagggcggcagcagccgctgcatgsagacatgagggctaggctaaaacagtaaggtcaagttgtttgcataggaaggctacagggtgcggtcctggctcttgtgtaagaattctgaccgcactaaccatgcctaggaaggaaaggcgttgttgttttgtaagggattgaggtttgggagattaatcggacacgatcagcagggaragcacgtgtgtttttatgagaattatgctgagataggtaacagatgaggatgaaatttgggcttgactgaagtaatgggggctgtctgtgaagccttgcggcagtacagcccaggtaatttgctgagcctaatgggtgtcagggtcagtccaagtgaaagcaaagagaggctgggatgaagggtgcaaaggaatagtaaagaaagcatgtttgagatccaraacagaataatggattgtggagggaggtattgaggataggagagtatatgggtttggcaccatggggtggataggcaaaacaatttggttgataaggcatagatcctgaactaacttgtaaggcttgcytggttttaggacaggtaaaatgggggaatggtaaggagagtttataggctttaaaaggccatgctgtagcaggcaagtgataacaggctttaaccctttcaaagcatgctgtgggatgggatattggcattaatcggggtaaaggtggttaggttttaatgagatggtaagggatgcatgatcggtcaccaaggagggagtagaggtatcttatatttgtgggttaaggtgggggaatataagaggaggacgcaaaggaggctttggactgggaagaagggcagcaatgagatgtagctgtaatccaggaatagtcagggaagcagataatttagttaaagtggctcgccctaataagggaactgggcaggtgtggataactaaaatgagtgcttaaaagagtattgtctaagttgccaccagagttggggagttttaagaggtttagaagcctggctgtcaatacccacaacagttatggaggcaagggaaacaggcccttgaaaagaaggtaatgtagagtgggtagcctccgtattgattaagaaggggacggacttactttccactgtgagagttacgygaagctcggcgtctgtgatggtctagggggcttccaaggcagtcgggcagcatcagtcttcagccgctaagccaagaagatctgggaagcagtcagagagccttgggccagagttccaggggctctgggagtggctgccaggtgagttggacagtccgatttccagtggggtcccacacagatgggacayggcttaggaggaatcctgggctgcaggcattccttggcctggtggccagatttctagcacttgtagcaagctcctaggggaggaggttctggaggaacgcctggccgctgcrgttcaggcgtttggaagttcttgtgtgctggagatgtggctggggtttgtctcacagtggaggcaaggaattgcaacttttttctattattgtacaccttgaaggcgaggttaattaaatcctgttgtggggtttgagtgccagattctaatttttggagttttatttaatgtcgggagcagattgggtaataaaatgtatattgagaataagacggccttttgaccttttagggtctagggctgtaaagcgtctcagggctgctgccaaaggagtcacgaactgggctgggtttttatgtttgatgaaaacgctatctgatttgggataaagaaaaaggagcattaaccttgactgtgcctttagctccagccacctttttaagagtcaattgctgggcaggtgggggagggctagtcacgaaacgaaactgtaaggcagaccaggtgtgaggaggggaggtgataaaaggattatagggtggaggagcggaggctgaggaagaattgggacctagckgggcctggcgaggagcagcctggggaggtggggagaggtcagatgggtccgtagaaaaggaagattagaaagcctcagcgacgcttggggttgggactgaggggacaggtgggagggaaagaaggaagatttgggatgagttgcattgggaacagagactagagagggaccgatgtgtaaaagaatgcctggatgtcaggcacctcagaccatttgcccattttacaacaagaattatttagatcttgtaggatggaaaaattgaaagtgccgttttccggctatttggaactactgttgagtttgtattggggtcaagcggcattgcagaagaaaataagatgcttagattttaatttaggtgagagttgaagaggttttaagtttttgaggacacaggctaagggagaagaaggaggaatggagggtggaaagttgcccatagtgaaggaagcaagcctagagaaaagagagagtagagacatggagggaaggggtttgggggttcttaccttccagaaaagcgggaaaggggttggggcacggagaagaggttggggcacggaaataagggatgggggcacagagatwagaggttggggtgtggaaataagggattggggcacagagatataagaggttggggcgcggaaataagagattgggcgcagagataagaggtcggggcacggaaataagggattggggtgcagagatacgaggttggggtacttgcccctcctctagaaaagcaggacttgccgctcagggtgaaggagaaggggttggggatttcttgccccccagaaaggaggagaaggggtagagacacggagagaaggggttggggtacttgccccttccccagaaaagcaggacttgccgctaagggtgaaggaccaaggcaggcgtccctgcatggtctgacacctctgaaacctgggtgaataatcattgcagtccctgcaatgattaaacaccaagggaaggctgccttcccagtccctgaccggcgccggagttttgggtccacggataaaacgtgtctcctttgtctctaccagaaaatgaaaggaattgaaattgagagaagggagagattgaagagtggaaaggagaaagtggttgaaggacagtgagagaggttggagaagagagtaagaagaggccgcttacccgatttaaaattggtgagatgttccttgggctggtcggtctgaggacctgaggtcgtaggtggatctttctcatggagcaaagaacaggaggacaggggattgccctcccaagggaggtcccccgatccgactcatggcaccaaatttcatgcatgtccgtgtgaagagaccatcaaacaggctttgtgtgagcaataaagcttttaatcacstgggtgcaggcgggctgagtccaaaaagagagtcagccaagggagacaggtggggccgttttatatgatttgggtaggtaaaggaaaaaggggggttgttctctggcaggcaggagtgggagtcacaaggtactcagtgggggagcttttgagccaggatgagccaggagaaggaatttcacaagacaatgtcatcagttaaggcaggaacaggccattttcacttsttttgtggtggaatgtcatcagttaaggcaggaaccggcgatctggatgtgtrcgtgcaggtcacaggggatatgatggcttwgcttgggctcaggggcctaacaatacaggctgacaaggattctttctttgtattaagcactttytagatttcttggagtggttagcaccawgggtattggctaccaatcctcatttctattaatattatttcatgtagacaaatgtagacaattgatgttttctcaatcctatgtaaagttggtgagaaggtgatttagaagattctgctatttttattgacctaaattaatctaagaaaagatagtcacttgctaagtagttgcagcttaaaacaagtttcctactcctgctccccttccaatctcrttgcccatgagctctgtctggtattagtgaaagtgacagaaatacatgtagtgaaagctacatgtattctagttcctcaccaaaatgcatatttagaggtaaaggggtgtaatgtctgccacttaccctcaaatggctcaaggaaaaaatagaggggtttggggagaaggagagggagagagaggagaatgagaaagtaagtgtggtcaatgttaattggagaatctgggtaaatgggagttctttgtgattccttgaaactcttctgtaattatatcaaaattaaaagttaaatataagaacataaaaaaagatcttcccaacattttgatcttacattgccttcttagcttctcttgagggtttcttgtaagcaaggacagtggaaagaaagtgggattagtctgctgttcagggtcctgcatctgatgtgtcactcctggagttcaggactaataaaaagtttgtgctcaattgcagtctttctcctcagcactatggattataacctgtactttctgtgccgtccttgttctttgaatggcttgagtgtrtcttgtctcttttatcttaggstttcttcaattccttttgaaagcagaagaaatatgatataaggcagtgtcatgcccttagttctactgtgcccctgtgttaaggggcataatctactcagggttctatgtgcttcataaatgcagcaaatggtgctgtgctttaatggtttttcccagcatcattcccagttctttcctttggtttgcttccttctgcccttttccttccccttgcttcatccttctttcttctctctcattctgtctctcattttccctttctctgggtccactcctatcttcctcaccctcattccctcaagacctccactctcgtctcaggtgcccccttttctgttctgctgtctcccttcctctcttcattctctctcacacagaagagtaaagagtcagggcagaggggaaaagagtgagggaaataagaagggggagcagagagatacagcaactaagaaaaagaaaaagaaaaaaatacccagccctggggctaaaagatagtcayggtggtcagtcactttgtctgggctctcaactggtgtacttacctctcctgctcaacgtttgagcatgtgcctctgctgcttaatatttgtggggtgaagctcccaccgacttggcacagtgatgattccatacgaagggaagggacgccagggtctgtggttgtttttgtacgtttgttctctgagcttctactaccacctactctacttcctgaaatagacttttctctcctccttttccttctccttcttctttctttttttttcagagtcttgctctgttgcccaggctggagtgcagtggcaccatctcgactcactgtagcctccacctgccatgttcaagcgattcacctgcctcagcctccccagtagctgggactacaggggtgcaccaccatgcctggctaatttttgtatttttagtaaaggcagggtttcaccatgttggccaggctggtctcaaactcctgacatcaggtgatccacctgcctcggcctcccaaagtgctgggattacaaccatgagccactgcgcccagcctgaaatcaacttttctaacagtgaaagagggagcctactgtccacaactttggtcaatagggaaacactttacttccctaattctttgaccaaccatagaaaacctttaggcagatraaggatactagttttcctttttattttcattttctaaaaataaatatttaccaggttaccaagaaaatacataaagcaacaagtaaaacaccccaccaccaaaagaatgtacatttgggctcagctaagatcacaacatctagccatggacatgttgactggtacagcctccaggtttttggatggttagcatccagattctagtctttctttctctstctgtctgtctgtctgtctgtctgtctgtctgtctgtctstctctctctctctctctctctctctctcycyctctctccctctctctctctctccctctctctctctccattcacctcttagtttttagcattagatctgcattccctcacaggtttttttctctttccacaaatggaccaaaattccggttgaaaactctgggtgtatccagggtttgagaaaataattgatagttaaataacttaagtggttagtcctcccctgcatgatcccaacggagaacacaaaggctggatagttatacgtcagcttttttgaccattgactcccaacaggatttttcccttctactattgaagtgatcatttctcaactgttgtctgttctattgttggactgctttggttagaaagctgtagatgctagaaggttcttcccaatattaagaaaaattctggagtgaactttcttgccttctggtaaatctagagctattctttggagtgacataaagcaagactcattctcctttgctgtcacatgtttgaagatggaattgtgctgcttctgagccatccttccaccaattaaaaatgccccagttccttatctctgccttctggamaatgtgctttttcagtatgtccatctgagtatgggcctgaaactgaacatagtatcccaaatatgacattctgtctagcccaggggggtgtggttacttcccattagacatagtgttactttcaatgcaaacaaagtttttgccctgttttaatatatttgcatcccactattaaaacatctatattctactaagattgtgataagcaaaaatcttcatcctttaatataggacttggtagctggctgagtcttcagttgtacttgtattattgatttttcaaaaaaatactacatgtgagattttacatttatttctattaaatgcatcttgtggctttaggatggtgttctggcctacagaggccatgttgatactcccaggagcacagactaggacaggacaggaagactatccagggaaagcatggcccagtctggactacttctaggcaaaaatctttggactgcggtttatgttatatagttgcatcattatacatccagaatattatgcatattaaattatttttctattttggccagatatttattcttaaaacacacacacgtagtaacatagattcttgttgcaagagagtcaatcagtatataaaaatatgcagaaaaatgagaataaaatgagaaaactcacactcccaccccttcccagagtaaccatgggtaccatgtgccttctatttatgtacatgcatacggttgtacatatagakagatagatagatctacttcatgattttaaactactgcatggtatgaccatgacattattattgtcattactattattattgagacagggtcttgctctgtcacccaggctggaatgcagtggtgtgatcttggctcactgcaacctccacctcccaggctcaagcaatcctcctgcctcaggcttccaagtagctgggaccacaggctcgtggcagcatgcctggctaatttttgagtattttttagaggtggggttttgctatgttgtccaggcttgtctcgaactcctggactcaagccatcttcccacctcagcctccaaagtgctgggattataggcgtgagccactgcgcctggccaacattattttttcaaccatcaacggcgacttagatggtcatttrtgttgttctcaactctattattagagactccactgcagtgatttcacttttctgtgcaattctgaatccatttgcaaatgttcccccagtatcgattctcaatagaaatgcttgagccatagggatatatgcatatatgctacatcctcactgtcttctaaaaaggtttgccaattcccatctctatgaaccttggctttgtaccaagtagaatgtacctaaatacttttccttctataaaggatggttactttgacttagstttgccaacatggaacaaaacaaacaaaacaaaaattttacttgtctttcagacctatttcttctcttaaagaatacatatgcctgtgttcagattatctcctcttcctgacaaatgagggaaatccccagatgaaagctgataaaacattagacgggsgtrattccggacctccacatccctatggaacacatcacagaagccaggattggagagccaactccacacacctccatatcccctcttagatgaatggcaattctttacaggccgtgggcgcaggcccaaatgccttctgggcttgtctaatcctccagaggatatcaaaggcaatacagccagcatacccaatcattaggagtttggcttctgggaccrggcactcttgggtgtgagcaccagctstcttatttataagctgtaaccttggccatgttatttaacccttctgagcctgactttcctcacttgtacaagacaggtaatataccaaccacagagggtggttttgaggattaaatgagatattgattgtaagaaaacaaatagcatagttgatggcagagtgagcacccaataacagttagccattatcattattactactacttactaagtccttacttctgtccagtaaaatccaagacatggcaaggacttgaacctcrcaggaataaaaacatggcccacttggttcagcgtgacagctctcaggrtggcgtgccgttacccacctgcaaattcctaacagcccaaagtggcaccagtcacttcctccttgcgtttctcaggcagcacattgagtggctgctagcatcactccagagccagactgaatctgaatctggctctcctacttacaccggagtgacttccatgctagaaatcgcttctstgggtccagcttacacttaagtgaatggagatgtaaaatggagacgataccagtaccgattatgcagagttgyggtgaggactgaatgaactaatacatgtaaagcttttagaagggtgcctggcatgtggtgggtgctcaggcatcattagctgttatcattattctgtgggaggccatttgccgctgccttaagaaggctgatctcacagaaacatctgctgttggcagaagagctcagcaccaatagccaatttgtgtttccctccaactcccagatggcagctctgcagcactttctcctcatctaatttctcctcacccagacgcgctccacatcaggacccttaggtagtacagagacagttctttaggcagggggatgccatgttcccaaaagagcctgatgaggccatagtaggcctcttccaccaagctatgctttcggtcagtccctctgtgactgttacggatgctttgtagccctgtggcaatgaggctccaggacaacactcatgcaattccctgctgaggagagttcagaaaactccatgctgtgcagtgcaattgggaggaaactcaagggagtgctgtcgtgggacctcccggtggtgatttgtacaaatgamgcaacgctatccagcttcccagaaaacaccgcctttttttcttacattacagctctgagtcaaagtgtactgtggcctcagacctggggcatacagcycatttgacagccacaatgagggaaacagcctacttctggagcctgtaccagaaggcagaacgggagactcccagctctcccttactaaaggccagggaggaaattgtctcgaatgctctccagtccaaaatggaaagttagattcaatggtctgtactcttgggctgastaacctccgtttttccttttcccattgtgctgagtcagccacggggggtgggttgtgcattttaagggtttgaatgcagaaggaaggaaggcttcccagtttctgagccttgagaaggtggcactgtggcctccaaccagcagccatgcccccaggcacctcattctcctacactatttcagggactttctggtgcaataaggatgtgactgagccctgagcccccaggttaccagccacaccccagtggaatcccgggagctacggggtaaaatggaatcctcttccacagcaagtgcacagaaggcactcagggctggtgggaacctccatttctgccctcatttactctggactctgaacctaatacctgaggcttcctgcagcaaatcagagaggtgaagagcaacttacacgtatctttttttttttttttttttgagacagggtctctctatgttgcccaggctggtcttgaactcctgggttcaagggatcctcctgcctcagcctcctgagtaacacatatcactcaacaaggaataaacaccacaacaattttgagtaccacagtcggagcactgtgtcctgctaaatgtgaggagcattctcctctctgatgttatcatcataaggccagggcctgtggcttaagctcctccrttcccttagagtctcccacaccacacaacaagtttggagacagagaaagtagctaatatttccccctaagtgccaggcactgttttctattttttacattgacagtttcatttatttctcccaatcatcctaaaaatattggtatatttagcctgctttatatacaaagggattaaggctcagagacagtaaactatttgccaaatgtcacagaggttgcaagtgagaggggtcaggatttgaattcaggtctgcaggcaccaaagcccatctataccacaccagtacacatttgttgactcactgcgtatcatcctaagtcttacagaagccccacccctctaactacagtaactgtagaggtctctagtactgttatgcctattagggacctgggccaccccactgccttctcctgccctgtgagctgactccctccaggagcccaagaccacaacaagcaaagccatcttgttgccagagcctgatgcaactcacaccctcttcctcccctccccttgcagaatatccttggtatctgcccagcaatttaatctccacaatttacaatcaaatcttgggatggcttagaaaatcttcctttaacacagtggctggaacatgcagagagttggcatgcagcctccacatgggcttcatgactagatctgctacactcaaacccattatattgaaattaccataaaattcacactattccaatcctcagaaatgatggttttatttagaagtaagtgagcaaaagcaatgatttcataggccccagtgccaaaatcttagctcaatgtttctcaaatgttttgttttcagaacctcttcaaagtcttaaaaaatattgtagagtccaaagaactattgtttagctaagtatctatcaatatttataattctagaaattaaagctgaaaaacttataaaatatttgttagttcattaaaaataataaacctaatacatgttaacataaataacattttatggaaaataactagtttccaaaattacaaatatttagtcagagtgggcagttttaaaaaatattgttacaaatctctttaatttatgacttaacagaagatagcaggtgactcacatctgtttctgcagaaagaccccccagtaaatttgtaagagaatgagagttagaaatgcaaataatgttttattcccacagctgtaaccttgtgggtttcctggaaagggtctcaggggccatcccgacggggtgcctggaccacactttgagaaccattgtctaaacttaagagtgtgttttttgggccgggcgcggtggctcacgcctgtaatcccagcactttgggaggccgaggcgggtggatcacgaggtcaggagatcgagaccatcttggctaacacrgtgaaaccccgtctctactaaaaaatacaaaaaattagcctggtgttgtggcgggcgcctgtaatcccagctactcaggaggctgaggcaggagaatggcgtgaaccccggaggcggagcttgcagtgagccgagagagcgccactgcagtccggcctgggcgaaagagcsagactccgtctcaaaaaaaaaaaaaaagtgtgttttttgtttttgtgtgtgtgtgtgtgtgtgtgtgtgaatgtctcttcatccaagaaaaatctaaatgggctattgtcttggcgtaggaagtaggtgagggtgcggtggatttcagaaaaaataatgtcccagttactgattttaagagaatagccctgagacaagtgtgggcgcattgaaacaccactgcaaccctctaaactattgcagagttgccaccaccaggtgtctggctagaaagatgtcatcttcccaagacagctacctgcccagatgatgtaccttagccccaggaaggaggaggaagaagaggcagrcagaatgatgcccaaacccctgcggcccggagacgaggtrgtgcctgagtcaggaagctgggagagcccagctcagtggaagaggcatgtggatcctggttaggtgtgaagccaggagggcttcttagccacagcctgaaatcgaagcccaggatcgagccacagtctgaawtttttggatcgcagctctgccarttaaaccaatggtaacaataataatgtactgtcatatatgtaagaactgccatatatggagcattttgagccaggcaatgtgccaagcacttgacagaaatcatttcattaatcccacacagccaaccctttgagataaccattgccctcatcccttttttacagacaaataaagcaaggcaggaagagttggaattatcaatcaaggtcacacacactatgttggttgagctgaaatttgaattcagttccgccgggctgcaaaaactctctgctgcttcccagctgcaccagctaggcaaactcctgccagaggaaatctcacagttggagtgcagtaggcatagatttctcctacttaactggggggasgctgtagtcacagcgaagggaatattattgtgtcccatgggaagaaacatgaagacggagtggacgcttcattcctactccaatcagccatctggagggttcagggctgaactgtagtgggggcatcacaaaacttagggaggtgaggagcctcccttagggaggtgacagcctgagtacatggcccccaagctttcagatcccttcctgcacccctccccacctagctctgcacttggcattgttgctactagccaggaagtctgagatctgcgcaaaccccgcccttccccgccgcccccgtaagcactaccgtcccttcaaagttcagacgtggggtcctttggagccctgctccctagagggtcgcctggcacatggccacctccacatcccgccccttctgagctcagcctcccagaggtgtgaacttcttacaaacacacactatcacccaattccctggaaaaacaaacaggacaattgtgtgaaaattccattctaaggcatcctcccttctctgtaaccagaggctccaaggagttcagcatagcacgagcttttaatttgcgtgcagacaagcacaaaaggcacaaccggatatacctgttatttcccaatgacctgagagcccgaagtttatgttaagccttgggttatggcacagcttgcacgcaaggcyctgcagctcctgcaggcaattgagaggtggtggtgtacaggacagaggaacaactctgaagtgacagcacataatttaattccccctaagctttccaagcatgcagactgttccttttttgtcagcgtataacctaagtgatttgttctactcaggcaagaaatgtctaatttaaaccacattgcagctaagcccttagtgaagaaggagaactccttgaggcttagccgtgcgtggttaggctggtggtagctgaggcaaagcagacctctttcagcccctgtatttcttactcaggtcatgactggagatacgtgggttggggggctctaatcaccacactcactcttctgtctcacactkcatccctcgtgaatgggtttagttttagtaagaatgtttacaggagagtgttggctacatgtccccaacatcccgggtttgagtcccatctgagccaccaggagttgggtgacttcagggaaacctcttaaactctaaccattgttttttcttctctgagaaacaggacaaatcggtagtgggggtgcacagattggcacattttcgtggcaagcgatctggcttaggaagcaagagatctgtgctccagcctagctttgttcccaactagcagtggatttgcagcaaggaacttttctctgggcctcaatttcctcatctgtaaaataagcaggctggatgaaatggtctttgaagttccttcagctataaaatactatgtatgtcttaaatcacttggagtttgacaaaataatagttataataattttaattattattgtgatttcttcctacaatcccaaagatttcactagccatgcaaatcttttaaaattcttctttaaaagtacttttcttggccttactgacatgaagcaaagaaggattctaggcccccagatggtaggatttggggtagacattctgtgtctgtctcattccccatggaattatcaaatttcccccctagccacgccagactgctaaatggtctctaagtatagcctacatttcaaggctgtttcctcagccaaaaatgccccttctccttgtctgctgtgaaactcccttccttttaccctcctctttccattatgggacagttttctcttctgggctcccttgagcacttcacactattattccattgacttcatgctgttatttttggttttgtattcaatatatctttgctcaactagaccctcaggaactctgtcatctgtaccacccagcctctccttcccagccttccccagcacctggtacacattcatggaagaattaacttttgaaccctgtggatttcatcacaataggataagaatgctgcatgggtttaggatagacgttcacaatctgagatgagcagtgctagccccagtccccaaaggaaacctagttagggtggtgattagagacattttgaacaattacttcaggaaaggatcaaattcattgaaaagctgcttatcttagtgaaaatgttgtaactgtggaaagacataaaagacaaaatgttcataactgtatccttggaagtgcctttctttaaagaataggaatcatctcaccaaagtatttgaagaagaatgtgtgtggttgtttgcatgtagctgcctatacttaagaatgttacatatttcatttctcccaggatcactcagcctaagagaagaattcgaggttacttttagggaggaaaggacacttacactgggaattcaatcgatggtagttaagcgtcctttttctttaataattgggataagtatgacacatacaactttacatagcatgctcggggagtgaggagagaagctagagaagactgagatgagtgaaatgcaggcttgattgagaaactaagcagaatttctactaacagtgagsattgagggagaagcgttcctgtaatggaggggaaatgaataaaacctcgactcccagctcgacagggacctttcttctcctagccagctggaatgcaagctttaaaaaaaaaggaagtgtggggagggctattttttttaataagaygtctcagaaatgatcatgaacacagtaaagctggttttcaaaaaaggaaagtgagaaaagtagtgacaacttgaagctggtagttgaggaagaaggagaacttctgaacccatgaagagagtatacccggtttgggtgggcaggactccaaagcctttaggatcgatggaccagaacagagaaatgaaaatgcaacaagaacagctgtggggaaaaggcagaaggkgggtaggaagcgaagagggtgtgtacttttcctttctgatctgagaaagggaaattttgtgctgggaagagttacgcgggaggaggaaggaaaggcgccaggaatgcctggaaggtatatgatgtctgaccttatgatctcttgcaacaatttctacaccgattgtgtcccttcacctctgctctaaaaatgtggttaggtaaatatctgttttattaacattgtgagaaattagcctcgtttacagaattccacaaaacaacttgcaataatgagaggctgctaggatgtaggtgatactaggagaagcaatgccttgtctgaacccccagggctctggaggcaccgctttgggtttaaaatctttccttagtgaccttgaacgtaatgaaataggagagaacgttgatcttagagtagtaatagcacaaaccacagccttaatgcccagcaggcttagttcgctggaataattagcctaggaaatgcatgacttaagatgtccccacagtggcccccacaaagtctgaaggggaaacaaagagaaagccagagagcctttcatagaagggaaccaactgcgtttacatgcaaaagatccatctcctgtggctacctaagagcagtgactctctgggggtggaataatttatacatgtgtaaaaacatttatttttctacatatttacttsaagcatgtgttaaaatatctgcaaacaactccagaccccctccccatcttatttttatcctaaaggcagtgttacatggatatccaaatgtttagagaggacaatcttaaatatacaaaagaatgataaataaataaataaataaataaataaataaawaaawaaaagatttcctaatttgtcaccacttgcatgctggaaaccgacagcgctaacttgggtaatatccttttaactctgattgaattatatgttaattccttgcggtggtcttagatttcagacgctattagcaaattatggaggaaaagcaagatcrtatgattcatgaaytatcacagcagcaacagtttctaatttccacccatcctctgtgtcatgtgatatgtttcagaaactcacttaaaattgagaaaataagccattcctaattgtacttaagtaaggaaatagctcatttatgaatctaagaagattaaagaatatggctttagtgtgtttgtttagaatctatgccaaaatttttttccgaagcataaatctggttttttttcttttccttaaaaaaaactttaataaagccaaagaaagaaagaaaggaaagaaagaaagaaagagggctccacatgcagtttcagcactaagggatcctgacaagtaattcacctctgctttgaatgtgggatttttgcactctatgatatatacctttggagtggttttgttttctttgtggttttttttttgtttgttttttgttttttgttytttttgtgtgagacagtggatttttttatccatcattgcattattggagttttatgtgatttaatgtataaaaagtgaggctattctccaactagttgtttgggtttctgtaaagttcaatttccacagtttacctcaagaggtcttttaaaaatgaaatttcaagcatgttgcttgatattctttaacatgttctcaattaatttgcaataaagtccagcccccttcctattgcacactattgtacccttcctgcctttttcatgcactgctctccacccaccctggcttcccggctttgcctccaacgtcagagtgatttctgggcttgcttttttktttttyttttgcctggaaacttcttctctgaagaactttcaaatggctgccttcttcatgtatctcctctcggagcatcattccctgaccttcctttctagggctctgaatccaccccattgctgtctatccagtcagtctctcttttctagctggcatccatcacaagcaatctgcttatcttgtttttggtgagtttatatctgtttctaccactggattataaatacttccaggatagagatctagtttatatcactcaccattctcttcccttagtgcctggtatgtagtaggtgttcaataaatgtgtactgaaagaatggatgagtgatatgatattgatctgtacctatttttttctttttagtctatctttgttgagttttggtattgattttatgtgtcagtacctgagaaggagagaagtccttgagttgtttcgtaaatgtggctcaagtgagatgctgaacagtgccagcyatgtggactctgccacagtgaaggaggaaggtagagaaaatgggttccagtgtgtgtgtatgtgggggtgggaggggtgtgttgatttaggggtgtacagaaaatggtggtgtgcttcatgmcttttttttttaaagaatgaaaccaggacatcaactgagcatataagaggggaaagtggtgcagtagggttaaggcataatgaaaagatttagaattatcctaaaagagtaggaaagcaaaccacgtagagatgtataatagaattccagtgttgagtttccattttatcatcatgaatttgaagtgagacagctggaatttgggatttccctaacacttgagctgggaaggtaaattgttaatcacttttatggagccagtgtcctttgaccaagcaatcctagtctaggaatttatcctaaagacaattggacaagtttgagaaaatgcatatacaaagtcgtttaacaaaatattttattataattgacaacaaataaatggaaagtacctaaatattcagcaatatgggattggataaattctgaaacatacaatgggatattttgcagctattaaagactgtctgtctatattcattgatatgatgaataggtatgatgagttattgagtgaaaaaaatgcagttttcaaactagcacatagtgtaaaacccttttttaaaagtcgtttacactcatgtattttagcataaagaaagacatggaaggatgttcaccaaaatgttaaatcttctcaccctcttctatgtatctttttgaattgggtgaaatgttctataatgagtatttgaaaacagaataaacagaaaaaaaaagatttaattagatcccatttgtcagtttttgcttttgttattgttgtttttggtgtctttgtcatgaaatctttgctagttcctatgtacagaatggtattgcctaggttgtcttccagggtttttataatyttgggttttacatttaagtttttaattcatcttgagttgatttttgtatatggtgtatatgtagtcttctacatatggctagcgagttatcccagcaccatttattgaataaggagtcctttccccattgctggtttttgtcagttttgtcgaagatcagatggttataggcgtgcaggcttatttctgggctctttatcctgtttcattggtctgtgtgtctctttgtaccagtaccaggtggytgtggttactgtagccctgtagtatagtttgacgtgatgcttccagctttgttctttttgcatacaattgccttggctatgtaggctcttttttgattccatwtaaattttaaaatagtttttctttccagttctgtgaagaatatcattgatagtttgataggaatagcactgactctgtaaattgctttggacagtatggccattttaatgatattgattcttcctatccatgagcatggaatgtttttccatttgtttgtgtcatctctgattcctttgagcagtgttttgtaattctcattgtagagatctttcacctccctggttagctgtattcctaggtgttttattcttttgtggcaattgtgaatgaaattgcattcctgatttggctctcagcttggctgttgctgatgtatagaaatgccagtgatttttgtacattsattttatatcatgaaactttgctgaagttgtttatcagctgggatctaatgaaacttaagagcttctgcacagcaaaagaaaytaccaacagagtaaacaacaatgatctacagtatgggagaaaatatttgcaaactatacatctgataaagatctaatattcagcatctataaggaatttaaatttacaagaaaaaagcaaccccattaaaaagtgggcaaaggacatgaacagacacttttcaaaagaagacatacatgtggccaacaagtgtataaaaaaagctcaatatcactgatcattagagaaatgaaaatcaaaaccacaacgagatactatctcacaccagtcaaaatagctactattaaaaagtcaaaaaataacagatgctggtgtggttgtggagaaaagggaattcttatacactgttagtgggagtgtaaattagttcaaccattgtggaaagcagtatggcagttccttaaagagctaaaaacaaaactaccattcgacccagcaatctcattactgggtatatacccaaaggaatataaattcttctactataaagacacatgcacacatatgtttattgcagcactattcataatagcaaagacatggaatcaacctaaatgcccatcagtggcagatcagataaagaaaatgtgatacatatataccatggaatactatgctgccttaaaaaaaaccagatcatgtgctttgcagaaatatgaatggagctgggggccactatccttagtaaattcacgcagaaacagaaaaccaaatacctcatgttctcacttataaggaggagctaaatgatgagaacayacggacacaaagaggggagcaacagacattgggacctatttgagggtggagtgtggcaggaaggcgaggatcagaagaaataacttttgggtactaggcttagtacttgggtgatgaaataatctgtacagcaaacccccatgacacaagtttacctaggtaacaaacttatacatatactcctgaaccgaaaataaaagttaaaagaaaaaagaaagacccatctgtatagkgctctctctctctttctcttacttggtttattctcttccttatccattgcatgcattaaccctttagaacttccggtgttctggggaccctgaaagatcagctagcaggattattgcggggctcagtgcagtgatgcagaggcctccaccagcaatcctgaagttgaaagagaatatccacctcccttatgcataagggatagatttgggggtggcattgaaggtctttctctcattttgctggcagctgtagcaatgcattgattagcaggagaggttttctctctaatgagccagaaactaacacttgtggagttcctgctatacaccagcactgtgcagggtgctttacatttaaaaaataaatctgggccgggcgcagtggctcaagcctgtaatcccagcactttcggaggccgaggcgggaggatcacaaggtcaggagatcgagaccatcctgtttaacatggtgaaaccccatctctactaaaaatacaaaaattagctgggcatagtggcaggtgcctgtagtcccagctactcggcaggctgaggcaggagaatggcgtgaacccgggaggcagagcttgcagtgagccragattgygccactgcactctggcctgggcaacagagygagactccatctcaaaaaaataaaaaaataataaaataaaaataaaaaataaatctgtttaatcttcacaataattctacaacgaaaaaattgttatctccattttatagctgagaaaaaaatgaggcacaatgaaacaaaagcacttgcatagcacacaatataggaaggagtggagtgagaatctaaagtcaagtttacagcatgctgttttcaaggcaaaactacttttgatttaaaatcatattcttttctctccccaatctcctccagctagcgtttcatccgtgtggatttgtcaggagacaaggaaaatcaaatttccagcaatgcgtatctagtgtttaacaatcacatcattacacatgaaaaaaatttgaagcttgtcagatcaccattgtatgaaatatttcccacttgggaccatacagctctgtatttttctgatcagttacaatttttaggatctagtctttatcccagagacccagatctgtgtattctgtattcttttgtaccctgtgttattgcttcaccaagagtatactccaggtgatttttttgtgtgtccttaattttgtcattttgtggtcattaataacatcagttaacaataatattattawactgtccactacaatgtgcgtttgtgagcactggcaacaatttagcagaacagaatgagttagattcccaattgtggtagatcacgtgtagtagcgaacagagcacagaaactccggatcytaattcttgatttcctggcagtgataccttcccattccattacataaggtataagtggcagaagatcagggagaaccayagggctgtaagatattttataagttgttaaataaggggacactgctttatttggggcatgtcactcaatctcttcaacattgtgttaggtaggtatcatgaactaaattgtggccacccaaaactcatacctcgaaccccgggtacctcagaacataattgtatttggatatggagtctttaaagaggtaattaagttaaaatgaggttgttagagagggctgtaatctaatatgactggtatccttataagaagattgaaaacacagatgtgcacagagcaaagaccacgtgaagacacaaagaaaacagccatctgcaactcaagaagagagtcccagagcacattgtgatctctgacttctggcctccagaattgtgagacaatgaatttatatcgtttaagccaccagtctgttgtactttgttatggcagcctgaatgggccaatacagtgaggttccctggaagactttcagatggggacttgcatgcaagaagtttaacagggagagctctcaagagcaacccccggagggagagagggaggaaaggaaaattgggcagagagagaagctgacctctgatgcagctgctacaaggttctcagctgatcctagggttctcagctgatcctacagggtgttctggagctgggatggccccgtagagttgcctggaatcaaggcagggcccagggagggagataaccttggcaaaggcagcttccttcagcgggggaattcccagtgagggactcaattgtggctgtttgcagtgggcactggacagctggggagtgagtttctccgccctgacgaggggtctgggtgacatctcacagcatccatcgcagacctgcagctcctagtctgcagaccaggataagcacaatgcctgtggtgcatttccccgcaggcggctgtgaggagctaatgagataatggatatgaaaatgctctgcaaactgtgaagactatcaatatgctgttatgcatcattctctgttatttgttgctatcctgtcctttcaccttccccaggccggaatgatcacattttctctttccctagctttattcctgggtcactagcacagggaaaaaataagaagaaaaatcagagtggaattctaaaaaacaaaggtcctgtgcttttctgcctaaaatatgtacaatcctcagttggcactgtcaggaatggggaccgccctcatggagaagtggyacttccactcctarccagcctctgtgtgagctggactctaaggtcaggagaatgaggaggccgtgaaggtcttggccgtctctttttcccctcatctctactgagacatagatcragacagggacccataaatcaccttggagttaaatcaggggaaaaaagaaaagccctctcaggcaacagcatttcacagcagcaacaggaagttgtagggaaaagagaaaagtcaaaactcaagtgaaaatctgagtcatggttcagagaggccacaaatacctttcttatggagagtcagaagagggaacacagagaaaactgagaggttttttttttgtttgtttgttttgaactttttaaaggagaatttgtttttaatcctgtgaagctagtaaacatctctttaaagaatgtgtgtggtcacacaagttgaagggctagaaaattacctcctcacagcccagatggttttaagtgggaacagataggaaggagcgtgagttaaagctcccacccacactacaggaccctgctgttccagccgctttcctctgccactagctcaggaagagcgagggctgcctctcagacacagggagttcctgcaggctgacttcaggcactccagaatgaggtgtccgtattttcctaagtgctgagggtcaccctacctcctcctcttttattaagattctctgaaccactcagagaatacacaagttaaaaataaattacttcggcagatagtgagggtacagaagtcctcggtaaggttttccttttaatgaaaaccagccccaaatacttttcctttctaacaaagagcagcctgtgaaatcaagctacagacatagatgccascagaggaatactacctgggactaggcatgttcaaaatggcggttccatcttctcttccttttttttttttttttttttttttttttggttagttwgtttgtttttgttgttgttgctgttgtttgagacggagtctcgctctgtcgcccaggctggagtgcaatggcatggtggaggctcattgcaacctccacctcccaggttcaagcgattctcctgcctcagcctcccaagtagctgggattacaggaatgcaccaccgtgcccagttaattttgtattttagtagagacggggcttcaccatgttggtcaggctggtcttgaactcctgacctcgtgatccgcctgcttcggcctcccaaagtgctgagattacaggtgtgagccaccgcgcccagcccatcttccttttctcagtgccagccacgtgtacattaaggaacagacaacatggcgcgggtcaagtggaaagctcttttgcatagtaagatgagggtgaggtagccagccttcctcctgctatgtaaacatcacacctaatcgaactgatctgtgggccctatgtaaatcagacaccgcctcttcaaacctgcctaaaaatttggagaattccgccccagcaagtctttccctttcagaagccccgctctctcgctakagagaaagctgttctcctttctctttcttctgcctattaaacctgcgctcctaaaggcctcctttgtgtccctgtcctaaattttcttggcgccaggtaacgaaccctgggtatttaccccagacaacgaagccgcttcagaatgacaaaacaacagacatggggacttctggcaaacaataaaccacaaatgaacagagagagattagaaaataaatctaatcacagcagaggaggaggggagaaaatagcttctcttcccagaaacacaggagagacagaaagcaggctgccctgttctgcgcctgctccattctccagtaacataccgtcctggtgtagtgagacttttcgcattatagggcccaactagagatccagtcatttttacttacgctgtgagccaagattctgagtaaatgggtttatcttgattgcagttaaagtatctggttgggcacatcctaacatgaatattataccaacaataaaaatcgtggaaatgtggggaaatgtccacgatatgttcataacttaaagtaggttagcagtgcattgtcaacgtaaataaaacagtatattgagtgtgattccaatattgaaaaacaaaataaagagcactaaatctgccaagttcaaagaccagagtgccagatgcaaaatgtttaatgtttctttctgtgatgggattatttttttctttatatttttctgtatttcctgatttttttctacaataatcatgtttctactgtaatctgagatataaaacattagaaaatttggtcagatgagttgttccaggattgtgattatttctccacaaacagatgctcctcaactgataatgggattttgttcctataagcccatcataagttgaaaataccgtatgtcaaaaatgcacttcatacacctgacctactgaacatcatagcttagcctcgcctaccttaaacatgctcagaacacttagattagcctacagttgagcaaaatcatcttatgtaatttattgrctaccataccgaaagtgaaaatcgaatggttgtgttgttcgttgaagtatggtttctacaaatacatattgcctttrtgccatcataaagtcaagaaattgttaagtcaaatcatgagtgaggkatcatctgtacattcatacacacacggtatgaatacatgggggtgtgtgtgtgcatgtgtctatgcatgtaaatgtgtgtttcaaagctctggggtccttcttccttcccagctaggagccccttttcctctgctgagctctcgaatcttgcataattgctcaccacatttctgaaaagacaatctcttggtacagcacccccagccttctaccaagggattccagcagatgttcactcccagctcagcttggatagggccaccaaggagcctgcctttggtctccacagtcacttcctgaagtaagattgaagagggtgggagcaccatggtttgttgacctccagctctgcttgtatctcctttggcagaaggggtcccaggtggtgcctacattctagattttagagaggacaccacctccagagagctgaacccaaaaactgatgagctccaaagacgtgaaaaaggacagaccctgccagacgagcacccttaggttgttggcacggaactgagggaggaaactgggactacccgcctgatgttgcagcttttttattctcccctcgtcactgtgagaggtctggacttcttctgacataaacagcctcctttcatcaaaggatcgtgccatcctttctattttctaagcattaaaaggcagtttaagcagatcagtgaattaggcaaaygtttatattctcccttgcccttttctttttgcatctggtagaatttctcctgttctattgttgatctctttgtaaaagcccgtacattcttagctgccagggcatgtctttggaagcattaccacatacctgtgaatgattaataagctgtgtttggttaataagcaacattcagctctcatattaatcacagatttttaaagttagacacagctggtgacaatttagtgacacagggtcagcttagcttttcttgagcattagctgggaggagaggctgaacgctgccagatgtcaccaaccaaaaaaaaaaaaacctaactgggtcctcagagaggacctgggggatgcaagtgcacacacacacaagagcaagagatccctgttcttttcaagaactccttttctggaggactgtcacctccagagaccccatgcttcctcctcatggttataactttccccaactcttcaagtgtctagagaaagcacattttctgaaccaaaaatcagggtttattgattggccatgagtctcaaattaagaatgccctggaaaaactggagaaaatattgaggcattagcggcattctgcataggctatatttgttcagccacattgaataacttactctatgcttagtacctccagagagtggggttacaaagaagaataccccctgtctagtgggccttcactggtgtgtgaggctcctctgggcaggaactcaattctgacttgtgcaggttgcaagtggagggtcggccgtgctcagctgggctgatggtttcccctattcgagcccttcctggcacagtgtgtctcctctgatttctcgttcccagagcctttcctcaagtagggattgcagttcttgctctcagttccttcagctagagaagcgaggtcctttcactggccctcttcagatcctgttcttgagctcagtccaacaggacacctggcttctctgttcacataggatcttctttgggccaggccaaactttcctcttccatctctcaaattggcccttccctctctcaagaactggctacttctcacggccctcttcttcatctcttcattactcccagtctgacagtggctttgcaaaaatctttcacatttctcctcaccatggtctctctatcgtaaatgaagatccagaaacgtcttaatttatctttaatggataatatagagggtgattcctgtcttcaatcaaagagaaagaggtataaggacaatacacccaggccatttcacctacaaatgctgaccttacaaaagaccagtgggtggggacaggtgagtgaaggtcctaacccagggcttctctgtgctgggaagtcacagtttttcttttcttttcttttcttttcttttcttttcttttcttttcttttatgtgcagaaaatgcaggtttgttacgtaggtaaacatgtgccgtggtggtttgctgcacctatctacctgtcatctaggttttaagccccgcatgcattaggtattttttctaatgctctcccttcccttggcccccacttcccgactggccccagtgtgtgatgttcccctccctgtgtccatgtgttctcattgttcaactccaacttataagtgagaacatgaagtgtttggttttctgttcctgtgktagtttgctgagaatgatggcttccggtttcatccatgtccctgcaaagaacacgaattcttttttatggctgcatagtattccatgatgtatatatggcacattttctttatgcagtctatcattgatggctatttgggtcggttccaagtctttgctattgtaaatagtgctgcaacaaacatacatgtccttgtgtcattatagtagaatgatttataatcctttgggtatatacccattaatgggattgctgggtcaaatggtatttctgattttagatccttaaggaattgccacactgtcttccacaayagaactaatttacactcccaccaacagtgtaaaagcgttcctatttctccacagcctcgccagcatctgttgtttcctgactttttaataatcaccattctaactaacgtgagatggtgtctcattgtggttttgatttgcatttctctaatgaccagtgatgatgagctttttttcatatgtttgttggccacataaatgtcttcttttgagaagtgtctgttcatatcctttgcccactttttgatggggttgtttttttcttgtaaatttgtttaagttccttgtggattctggatattagctctttgtcagatggatagattgcaaacattttcccccattctgtaggttgcctgttcattctgatgatagtttcttttgctgtgcagaagctctttagtttgattagatcccatttgtcaattttggcttttgttgcaattgcttttggtgttttagtcatgaagtctttgcccatgcctatgtcctaagtggtattgccttggttttcctctagggcttttatggttttgggttttacatttaagactttaatccatcttgagttaatttttgtataaggagggggtccagttygttttctgcatatggctagccagttttcccagcaccgtttattaaatagggagtcctttccccactgcttgtttttgtcaagtttgttgaatagcagatggttgtagatgtgtggtgttatttctgaggtctctgttctgttctattggtctatatatctgttttggtatcagtaccatgctgttttggttactgtagccttgtagtatagtttgaagtcaggtagcatgatgcctccatctttaatctttttgcttagaactgtcttggctatacaggctcctttttggttccatatgaaatttaaagtagttttttctaattctgtaaagaaagtcactggtagcttgatgagaatagcattgaatctataaattactttggccattttcatgatattgattcttcctatccatgagcatggaatgtttttccatttgtttatgtcctctcttattcccttgaacagtggtttatagttctccttgaagaggtccttcacatcccttgtaagttgtattcctaggtattttattatctttgtagcaattgtgaatgagattcactcatgatttggctctctgcttgtctattgctggtgtataggaatgcttgggatttttgcacattgattttgtatcctgaggaagtcatagtttttctatgtgcagttccaaagcccctgaagaatgattaaagagcaaattactttctcttttgaagattaaaaagagactcctttttagcaagatcagagttaacaaattactggccccatgccctttcctacccatgtggagtcctcgccttgcatcaaaaagggaagctaacctgcaacaagggagcagccactgccaggaagaaatgcctttgtgccttccctcttcttgccctgctgccttcttcccaagtcagcactcctctcttccctttccacatgcttcctctttcccctcttaggaaaaaaatataatattggatcggctgtgtgtcaagcatctgaggttctaaccatagctccattactaccagtccgtgtgacttggggaatgctgcttaccttctttgagacccagtttcttcattacaagataaagagcttgctaggtgagctctgtgacttctttctacttaaacattttgtgattctgcgttcttagactttgtaataattctctcttaaggtatttgtacattaagttttacatgtcattgtggaatgaacagatttatctctagttacagaatcccaaacttcagcagaaggtgcagggagaaccaaagaggtgagggataaagaaaggggctccgccaaaccatatctctcatcttgttcttgaattaccagccctctggcagtcaactttcttaactggcttccttctggagcccagatttgtttttccttgctctcttaatctctgttcactattttctatagaaattactttagagagaaaccctcttccaattgtatttaaatccaccccccaaatataatttattctcttatgaagctttgaaatggaaamttttccccagaagtaaccaggcattgtgcaaagtcgcatccattttgaacaccaaagcagctgtaacaaataagagatgacaaatgccattgtgtaatttagttcttcatatcagtttgtcattctgactcctttctatttaactggatgctttgtcagactttgtaatctaaccatgtgaagggcagtgaataaaggattaacgaaaccctttccagttttgcatgagcatttgatttttggctaacttcctagctctgttcccatggaaacctgataaaggaaagtacaagtgggccctgattggtaaatcctatctggattgggacaactataaataccagagaagaagccatattttcgagtttccctaagtgcagtgacccttgtaactggcatgaccttgagaagaccatgaaagttatggccatggagttcctccaagagatattagctgctgtgaaatacagggcctctcatatagtgtggcctccacaccccactgatgtgagtctcatttcttcacaactcagtccacatgggggccaaagagaatagcttctgcccactgtgtggatggctttgtggtctgctgcgaggtcccgcagaagaggaagtctggatgtgccctactgacatgctctgcctcctggcctatgaatcttctgggtcaactgctgtctagagtgggccttggcagtcttgtgagtttgcaggtttaatagagccttatgagacctcctggtgggtcttgtggatggaggttttcacttttactggtttgaatgagtgcatttgcctgtgaagctgtgagcatgagacaatgtccagtcttatggtttttactaattgccagtttttctttacaaattaaaaaataattttgtaatgaaaattggcaggtcccacttgagaatattatactaagtgaaataagccagtgacaaaaagacaaatacttttttccacttctctgaggcactcawattcatagacatgggaagtagaatactgtttgccaggggctgggagaggaggtaacggaaagttgccgtttaatggatgcagagttccacctttgcaagatggaaagagttctggagactggttggacaacaacatgaatgcacttaacactaccgattgtgcacttggtttaaaaactgcacatttgtaaaatggttaacgtggcaaactttatgttatatgtattttaccataatttaaaaattttttttaattgacagtttcctctaaatatcacacttaaatcatgttttcaatacacagactaattctaagtgtttccaaatttccttctaagtaatataggaagattttgtgttacttttccaatttcatcctgcaaccacggttaaaaatcactactattcacttcttaccatttgatctgttgacagtttcagccatcagtcactgccggctcccacttcatttagttaccatgyccctcactaacacaagatcgccgtctaggggccaatcgtagaactacaggctacacagaggagaagggagccaggccacctttcccatgcatcccactccttgaacagaaagagcaactaaaaagggaggcaggagttctaagcaccatctttttttcaccagtacagtttccaagatcttgctgctatgaaaataaagatctcctaatatttatagtacttgaggttagaatagtcttctaggtagagtactaatatcttgctgataaagcttttgatgctgaatccttgrttattctcttaatataatatcttctgtgcgaataaggctaaaatgcttgcatacactcttgtactcacttaggaatgtaatagagcagtttgggagagtgactgaatgcttctgctttgggcaaatttgccacaaaatcatattatgcaatcacagggtcacagaacattagaacttaaagagctttagaggcccgtggtctctagcagatccctttgagagtctgataaaaattagaggtttacgtaccataaaatgctattttgcacaaagctttgaataccattttaaaatttcatcatagatgaagaattccagcttgaatcccaccccataatttggaagtgaagtttctgagaagcatcctgtgtgaagaagcagctaaacagaggggaatgggagtcagaactggatgttggaaagagatgtgatcccacagacagtgtaatgctgggttggaaccagccctggtcaaacccattcccccgagtgcacatgtgttccagggagaagcttgctggggaagagagcagcaatttgcccaccagaggcccagatctcctgggagaaatcagctgccatggaacaggagtttttcttcatgctagaaagggaaaagaacatgaataagtggcaatccagggacagccagaaggaacctggacaatggctcaccggctgagcagagatagagttgcactggkkggggggggcgggggtggggggcagttgacagcagcctggattgtgagcaaggagtacgaagaaataataattgaagtagcagaaggtagcaaggggtgcagaccaagagcacaggcactgcagagagaagtctggattatttgtgaggactttccctagggacttctagaaagaaatcactagtgaggtctaaaagaagactggacttccagtgtggtgataggaacattgctctttgagttcttactacaaatgaggaactttgatttgccaggaaacaaagggttcaaagaaccaattgtgatatattttggcttaaatcccccccactgaaatatgacaggagtcaaattggggtaccaggtaagtcttgtgaaggtgctgcctggggagtacccagctgtctggcactttcataatatctttctgaacctcagtttcctcatctacaaaatgggattaggacttgttgagcatcaaggttccttccgacttgaaaaatcttctgattctatgaccaaactggaaggcctgggttgggctctctcagttctgcagatttaaatgagtcatttctgaactgttggcwtaaggcctatccttttcactcaaatattcccttgaggcatcattttttttttttttttcaaaattgggaaagcgaaggatacaagaagttggaaggaaagcccatgaaagaaaaamacatttactataattaagaaagaaaattaaacagatgatgatcagaactgcggttataaattaaagttaactgattccaagagtgtacgccatcagaattcgccctcataactggaaatttagaggcagggcaagcttcaagtttgcctaattcagcagttccaatcccatttccttgggattctcagctctgcctcatctgtgttcagtttaattctcaggctggggataacatggctattgcaataatagggccaagcttgacaacatccagagggagagactctcttttcctatggctctctcttaaaggtggagaattttccagaagccccagcaaacttccccataaatcttattaaacctaattggtccatatgcctattcctgaacctctcactggcagggggatgagattatacttagacaatttaggcctaacctggaagtacaaagactgcaatggggaaggggtgaatatttgaaaaaaatcagggtttgttggaatgaagtgaagaatggctgctgggcagacagtcagcggtatcttgtcagaatcagctgttgaaatgcagtggggcgtatgaccatgctccccatttaacagatggagtagttaggcccaaggtcacacagttgggttagagctagggacaaagacctttctactcaaaacccgaggcttctctatgtacatttcaaaaggcttaaattttggcttatctttttacccagaaagtctacttctgggaattattataaggaaataatgaatgggaataaagagttagaaacaataatttttaacccagtatatttttgtgaaaaaaaaatgggaataatgtgaaagtctaatagtatgcagttagtgaaatcaataatgrtacatacatacaatggaatactatgcagccattacaattataccacagaagaaaaggcaatggcctggaaaaatatattgttcataatatattgttacataaaaagtaggctataaaactgttgtttaacaaaacagatctagaaagattaagagatgtatacagcaacattttacctgtagtttcctctgcatgatggaattgtagatgattttaatctcttagtttgtgcttcttttttccagatttctttggttgaggatatgtaacaaagaatatctttggtgagaacattgcaatcagaaaaaaatgtccgtgtaaccattttttaarattaattctattttcactaagaacactgattttcagacatagctataggtatcacagggttctatatggaatttctagaaatacagtggggagttcatggcaacagccttctcaagacctgtcttccatgcccacgaattcctaggataagaaacaacactcgggaggtttctaaagttcccgacctcaactgccctcagagaggggtcattatatccagggcaatgttagtgagccacagtatgtgcgttgggaaccatgtagagaacaggaaactacagatgctttttaagacacttatgagaattgttctttctamagtttaaagtgcctggcacatatttggtgcctaatactggctaaataaggagatgytggctgtgcgcagtggctcacgcctgtaattccaggactttgggaggccaaggcgggtggatcacgaggtcaggaggttgagaccatcctggctaacacggtgaaaccccgtctctactaaaaacacaaaaaaaattagccgggcgtggtggcgggcgcttgtagtcccagctactcggaaggctgaggcaggagaatggcgtgaacccgggaggtggagcttgcagtgagccgagatcgcgccactgcactgcagcctgggcgacagagtgagactctgtctcaaaaaagaaaaaaaaaaaagataaaattaccagaaaatattaaacaggtaagtatttacctgtttaaaagaaaaattactagaaaatattaaacagtgaaatgaccagtgtgtcctcagcacaacaccttctacaaattatattaggagtagcaaacaaggcagtggctcacacctgaaatcccaacactctgtctgggaggccgaggtgggtggatcacctgaagtcaggagttcgagaccagcctggacaacatggtgaaaccccgtctctactgaaactacaaaaataacctggacatggtggtgggcacctgtaatcccagctactcaggaggtgaggcaggagaatcacttgaacccaggaggcggaggttgcagygagccgagatcgcgccactgcactccagcgtgggcgacaagagcaaaactctgtctcaaaaaaaaaaaaaaaaaaaaaaaaaaaaggagtagaaaacagaatgactctcaggggcactccgctttttctggagttgttcctgggtctcctgaccacccaagtctgactgagttctcccacatttatcccagctgtcacggatgagaggcactttctcttctgctgaccttctrgctcctggtgatactgtctacwgcacagatggaaagtacccaggaaacagcataacaacaacaacaaaaaatcacattttttagcttcaaagcaaacaccaaagttaaaagcccaacgcctgaaggaatttaaggaccaaagttatttagggcagaagctaaaaggaggtggcctaccccctacccacggaccccaggcttcaaataggtgaaggttggaggctgccaggccctgagcaagcatcatcaaagaagagcacatccaagagtaccccagtgctcactctgctttgaagacaaacagccctcctaattagaaacagcttcattcacatgccagatgtccatgcttcccttccaattattttcagaaacatcataaagaaccattagcggcagtgcaaaatatcctgggttgttttttaaaagaatttgtccattcttatgagttcagtttgatatgaagaagattgcaatccgcctattcctaagaggtttttggagcaggagagggactcaagataaggatgtgtaaggatttgatcaccagaaatactaccacatatttggtttaagcataaagaacaagcatcttacaaaaatgttagccaaatgtctctttacatcacacacacacacacacacacacacacacacacacgattagtacaccctgagcatttatctaagaataacatgaacaatcaaaagtttttggaagcagaggatctagatcatgagttatagttctgaattctgtgttggtcagactacttcgaaatacattgtccacttcaggaaaccacatctggaaagggacattgaccaattcaagaaaccccagaaagtgggaagagcacaaccatggtggaccatagacttctttagggcagsgtctgtgccatgcctttgctcacccccactgccctggcacagtgctttatacatagaccatgccgtaagatatttgttgaataaatgagtaaataattcatatgtcatgcataattgttgaaggaagtacagttggttaactcagagaataaaaggtacagaggacatgacagctcatgtcacatacctaaaggggtaccacagagaatagggaaaagatgtattctctcttggtctttggatcagaatgaagactatttagtgaaagctacaggaaagcagctttgacccaggattattattattttgtgtatccaccataaataactgtgtgaggctcgggtacattctcacactcaaactttaatttgagcattagagggatatagaaagaaatttgggcttgtggccagattaataacttgttcaagaaatctttactgagatagtgccagaggatgctgagaagcagggtgaataagtaaccaaaaaggcagggtttcttcctttttgaagcttccggtctattcaggaatgcagacaagtcagcaggtaatcacggtgtgcacaggtgagatggactgtgataagggaagttcgggcgcctcctgcagtgggtgctccagcatcccagggggcttagatgaagcaaaaatgggggatgtgataggggtggaggatgatccagcatgcatatgagctctaaggcaggacagagtggcactttggagaaccctccaccgtccttaaaccagccccacttcccacttccagttctacccactcttggcttaggaaattttctcctctttttgccctgaaaattagccttggtggctgagttttgcttttcaggttctcattgctagtgcttattttgaygcttagtgaccatctcattcctactaytggcccgcagtagggaatcagacctttagtagacacggagctcttcaaatacagagtgaacttggggcatctgatcatgtgggtcaagatgaacactacagaatacaacygagagccacatgtgagtgaagctgtactcgagctgacaatactgacattcaaaaagcaacaggatgatgagaatgttctggaattagagggtagtgatagttacacaaccttgtgaatatactactgcacaccttaacatggtgaattttatggtacgtaaattacatctcaataacatttaaaaaaaaaaaaaaaagcagcagcagatggctgctggaggaggctgagcttaaatacccctggttacacttcctcctttccttgtatttactggaaggagaaggatttgtcctaagatgaatagttttttcatcttcagaaattcctgacaagctactaccctgtcaaggcatgaaaaatttcattagtgctgacttggtacacagtctattaattagtacctaaataattgcatgttgcctctgtgtcatgatttataattgtatgcatgctttgatctttctcatcacaggcagcactgagaagtgaaggaatatttgggaggatcagaagcttggtcctgattttgccatcaacaggaacttgatgacttcaagggagtccccaaaccctgggtttctgttttctcaactctaacatgaggggctagatgcatctggtttagttagtctccatgatggtttagttcgtctccatgatcctgtgaatttcagatgttgaaaatcttcggaaaagccctgaaagatgaacaggtaggagttattgtctatattttacccatgaggaaactaaggacctgggaatctagagggctcattagcttttgaaccagtactagcaatgagttcatctgaattctggtcccaaactcctagcatgagagaaatgtggacctttcattccaggagtttagcatgtaggaggtattcagctggtgagggattaaggcaagattacaggttcttgagaaacataagcgacagagacaagaacatcagaaagggccgctgtgactcgggtcgtggctgccgatggagctcgtaagtcaggagaggttgtttgctgagaagcttgcattccctagagcccaagtgggtgttgccaggaaaccctgagttttccaacttggcaatcagtgcacagctgagtttttataggaaattgcccagctctttggaaattgtatgtggtataaatatggttttgaaattctatatattagcttagcaaaaggcggaaatattttgaaacccatggatttgggagatctgccggcattgctattaaaattactttcagcagaattgtacaatatgacattatattgctcaaaatgactcaattttctaatctttgagacttcttaaaaagaaatgaaccccaagtagagtraaggtggactgcaaaaaacagcttagtctgaatgaaaaaaattcatccttggctctgcatctaagaaactggctgtgtgtcctcagacaattcacttaatgtctcagatcctcaacgtcttcaactgcaaataaaggggttagaggagatcatctttaaagcccaactcagctctaacatactatgattggataccatacacttgtccacattcttttctctagcacttggggatttctgctcttccagcctttacaaatacaacctttcactgtcacactcattcttccttgtccttaaaacagaaagcccaggcatagtctgatgccacttctgagggctatagcaggtggcatctagtgtctctatagtaactatttacactcctagggaaaattatctcacagaagcatagagagcctgaccttgtctataaagacagtaaggtayaawgattaaaagaataggctctaaagtcaggcagacctgggtaaatctgccacctactagagagcttgggcaagcaagttcaccatgcctggtacctagtgagtgctgtgggcctctattctggagggacagcagggccttacgaaaccagcatgagattgtaaatgccttgcaggctggattttcaagaggaaatgctaccccctttttctccaacatctctggcaaaattgctaacccaaaggtactaggcccagctagttatgaaggggatggaagtgatctctatccaagggaagaacatttgaattgatgtttaaaggagttgtttagattcttatgaaggaatagaggaakagtagaggcaaagacagagaaggggatggatgagaataaagaacaagaaaagaagcagtaggagacaaatgagaaggttaaagctgataatttttacttttatgataaaaggaatttctaagcaaattctaaccattttatcaagaagaaacaaattcactaacttatatttctgcttaaagaaatgcatgggcattttcttcgcatgtgcagtttgtttaaaaattaggcattgaatgctttttaaaaaatatctagatctattctggacatgcacattccaattgatagatagatcaaaatgtctgattttcttactggtaacttggcaccagttgccagtggcttcatatgaacctatcagctgctgtgggatggcagagcagttaagagtccaagactagtccacgcaggcctgyagctcccacattctgatgcatcaaagccacagcaagttcctaaaacataggctctggatccagatgcttttggttcaaattttcacttcattatttctcagatgtgtgacttatggcaattacttacttctctaaggctcactttccacatctgtaaaatagggctaatgatagtatttgcttcataagattggggattgaatgggataatgcacttagctcaatactcacccataaactttttttttttttttttttttttttttgagacagagtcttgctctgttgcccaggctggagtgcagtcgtgcgatcttggctcactgaaatctccacctcccaggttcaagcaattctcctgcctcggcctcccatgtagctgggatttcaggcacacaccaacaccccygactaatttttttgaatttttagtagagacaggattttaccatgttagtcaggctggtctcaaactcctggcctcaagtaatccgcccaccttggcctcccaaagggctgggattacaggcgtgagccaccactcccagccaacaatattcaattacatactcaattactatgttctttttctggtaactagaatgtaggatcttatgattggccccaagttcaaagatatgggcaagtaagtataatataagagtgtagatacagattttgtaggatatatgccatggcctctgtcccatatcagtttaatacctattttccaatgtaatgccctgaaatcccagaagaggaaaaaagaatttttttctaacaattagaaacatgataaaaaawactatcaaaggtatattcattcagccatgcaaattgtaaaaccatagcaatcattctatttgtttggtcacagtttaaaaaaggaaatttgctataagaaaaataaatacaaacaaacacaaaaagagttgaatgcyacctgcagaagaagcaccaatccaactattttaccctgcccacattcaccatgtttctcacaattgcctataaaaagtagtcaccatttattgtaccaggcagtgagctaagtgctttatggaccctgtctcgtttaactgtccccagagtcctatgagtaggtatgttagtgccatgcccatatcacggataaggagatatgccaggtcagagaggcgagttgggattcacacgcagcagacttgctccagggcctgtgttctcaacactgcatggtgccgcttctgatctggattgttaaatctcagcacccagcactcctggcttgggtagaagggaatgggcccagaggtgctgagaatggatctcatgtacacctagggtcgaagttggaacagagagtatgtggagagcctgggctaagactgaagccgccatgatgaaaaccaaactcaagcagtctygttttttaaaaccaatgggagtagtaaagtataaatgtaaatctcagttatcttatcatgccaccctataggtgtttccagtagttactttagagctatcaaagatacatctgaaataacggtactgtgtatatacttgagtcctcttccccagcttgacactcctaggagtcaggtgttctctgggccagatcatttgcccacaaacatagcaatatgcctagccttctcattatataaggtcccccattatatgggggaccttatataatttcatcatatggatgaaaaatgggattattttattatttgactcttctctctaggattcaaagtgcttttatttatagattttcatgatttaaccaattcacccaagaagtaggaagagggcagctttattattttcaaattgtggactgagaaactgagatatgcagaaagaaataaagctgctctgcaatttggaaaaccatctgtgatgctataaaaacgtctcactgtactctcaaccacataaatcactatttttattgccttctctctggatgagatgtggcttaatttgagagagctgtttatcatttggcaagctgaaagaacctaatttcaagtctccattctagtgggtggtaagaataaagggaatttgctttaagggaagaggaaatgataagaatgggaaggaaacggttagacctaaaaaaaatcgattttgaaaccctttggattatcatggatttaatttgccaagcatgggtgaggggtcacatggaatgggtttgaattctaagccaccattatgaccactcacttaatgtttcttcctaccactcccattctacagtgagcccatgattaagataacaacagcttaaatgagttagtgcatagtatggtttggctctgkgtccccacccaaatcccgtgttaaattgtaatcttgagtgttggacgtggggcttggtgagaggtgatttgatcatgagggtgatttctaatggtttagcaccatccccacagtgctgccttatgatagagttctcaggcgatctrgttgtttgaaagcatgtagcacttccrctgcccttctcctgctggccatgtgaaggtgtgcctgtttctcctttaccttctgccatgattgtaagtttcctgaggcctccccaaaagcagaagcctttacagcccacagaactgtgagctgattaaacatctttctttataaattacccagtctcaggtagtttttatagcaatgcaagaacagactaatgaagaaaattggtaccagagaagtgaggcattactacaaagatacctgaaaatgtggaagcagctttggaactggataatgggcagagggtggaacagtttggaaagctcagaagaagacaggaagatgaggaaatgtttggaatttcctagagacttgtttaatggttttgaccaaaatgctcatagtgatatgggcagagatggccaggctgatgaggtctcagatggagatgaggaacttattgagaactggagtaaaggtcactcttgctatgctttagcaaagagactggtggcattgtgctcctgctctagggatctgttgaactttgaccttgagagatgatttagggtatctggcagaagaaatttctaagcatcaaagtgctcaagrtgtggcctggctgcttccaaaagcctaactcatctgcataaacaaagaaatgacctgaaaagggaggcaaagcataaaagatagataggaaaatttgcagcctagccatgtggtagaaaagaaaaacccattttctggggagaaattcaagcccaatacagaaatttgcataagtaaagaggagccaaatattagcagtcaagacaatggggaaaatgcctatgaggcattccagagacctttggggcagcccctcccatcacaggcctggaggcctaggagggaaaaatggtttcatggggccaggcccagggccctgctgctttgtgcagccttggggcatggcaccctgcatcccacttgctccagctacagctgtggccaaaagggccccagatacttctcagactgctgctccagagagtgcaagccacaagccttggtggcttccatgtggtgttaagcctgcaagtacaaagaggatragagttgaggcttgggaacctccacctagatttcagaggatgtatggaaaggcctggatgtccaggcgggagtctcctgcaggggcagagccttcatggagaatatctagtagggcagtgcaaaggggaaatgtggggttggagcccccacacagagtccccactggggcactgcctagtggagctctgaaaagaaggtcatcctcctccagaccccagcttgcactgtgtacctggaaaatccacaggcactcacatcagtccatgaaagcagccacaggggatgtaccctgcagagctgcccaaggccttggaagcccaccccctccatcagcatggcctggatgtgagacacagagtcaagattattttggagctttaagatttaatgaccgtcctgctgggtttcggacttgcatggggcctgtagcccctgtgttgtggctgagttctcctttcyggaaatggagtatttacccaatgcctgtactcccattgtatcttggaagtagctaacttgtttttgattttacaggctcataggtggaagggacttgccttgtctccgattagactttggacttggacttttgagttaattctggaatgagttaagactttgggggactgttgagaagggatggttatattttacaatgtgagaggatatgagatttgggaggggccaagggtggaatggtatggtggggctttgtgtccctacccaaatctcatgttgaactgtgatcccgagtgctggagggagggtttggtgggaggtgattggatcacaggggtggtttttaatggtttagygccattcccccaatttcttaggaaatctgcttgtttgaaagtgtgtagcatctcctttgcccctctcctgctgctaatggcctgtttccccttcaccttgtgccacrattgtaagtttcctgaggcctcccccagaagcagamgcctgtacagcccacaggaaccatgagctgactaaccatcttttctttataaattacccagttctttatggcaaygtaagaatggaccaatagagcacatcactagggtagcacaaaggagagggcccagaagcagaggagagataaacagctcatttttttcatctttctcaatgtttcttgctcactctctgttgtttgcatccatttttcatttcatcccatttcctcttttttccctttcatttcctcattttgggacagcaagaggtcatgttcttgctgccaacagttacgacattttcagtagtcatgacagccacaaagccagggctggacttgtccagaagtctgatctgcagcaggagggagtctgtagtgtgcaggggctctccagctgtcacttagatcccaagctgccccttcacttttaattttgctgatggtggcttttgtcaaaggcaatttaaaatttagggctaggtagtctaatctgtcaatcttttcttttctttgtggtttccaggtttgtgtcttacttaggagggccttcccaatgctaaaattatatatataaacagatataccacaattgcctaaacagaaatttgggcaagctggcacatttgaaacagggctgtctcctaaaatttggaacgtgtggatagcgtgcatatgcttggactctaggacttactttctctggaaaaatccgtctagcttcctcactcactgcctctgcctcccagctccagcctagccatttcatcttatggtgggggagcactcagttgctagggccagaaacccactcagagtaacttaagtaaatggggattacttgcacagtgataacggaatactgtgaaacccagtttgaagaattgcacctggatcactgaagggctagagtctggagctgcccttcctcctccctttctctcagttatctttgtctctgctccatcctcccccttcgtcaagcatactctgttaccacatgaccttaaatgactgtctaactcagtccttgagcccacagaatcttgtgagtctagcactcacagataaaaaaacaccctcaggctttctgtgtyccaactccaagttctagataaagatgtctgattggttaaagtgggtcatgtttaaagtgggtctactcccaattcagttattggtggccagggccatgagccacatggttgccccttggggcagtgggcaaggtaaagttcacaagatgtggtggggaggaaatgaccactgtaactctgtggtccagttcccacacccatattgtgatttttgctccccttcaagtttgcccttgatgttgtctgtaactgaattctgttttctcccatggttagatttataccagatccaggaccttttagggagggctgtggtcctgtccccttggggaggctctgatctaagactgctccctcatggaaattaaggagaaggggaaagcctaggctacagatggagaaggatgagtcattccagcagccatggccaagggaactcytggagacgtagggactgtttatgtggccactcaccatcatgcaggcccccaatgggggtgaggcaaggaaggacatagaaagactgctcaagtgcatttctggttttgcttcctaccgcaaacgactcttgtcatatgactgggggagtgtggtggtggcaataagcagaaaaatttgagtctaagagttgctttctgaattctcttattagggtcaatgtagtctaaagaagttgacttttgaggaaataaatcttttctgttttctgcagccagactaaggatttagtggtgaatggtaggtgggaacatagtgggactctgactgctcatacggcctctgtgaggctcaattcttttatctctaaaagagagaactgtctacctggtaagagaagatcttttgggagcccactaaactctaacataatgttattatacagtaagttctcacttaatgtcatcgacagtttcttggaaactatagctttaagcaaaatgacatgtaacaaaagcrtttttttctcatcaacgttataacaaaacgttaaaggaagtgacattatttatgaacctgctgcatgttgttttgcttaaagttacagattccaagaacctatcgatgacattaagtgaggacttactgtactagtatcatttataacttataaaaatgacttaattaatataccacaaaatatgcagctttcatgttagagaccagataaatatgaatattttgttaaaatgtctctcttctctactttaccagtcttcaccaacctcctccctccagaatattcctcaagaatataaaatgcctcatcaacatgagacaacagcaggaagcacccattcgtagtaatcctctgtatggaggaggctgttacataaccacaaaggcacaaagctgcagttttgagaacatcttcccacgccagttctaagcattgacttcaactatggttgctaacacaagaatcggcactggtgacttttgagccatcaatcatcctttcctaacacatgaatcttttggaaaagtatgtgagattggagattacctgtgatggtttggatttagattttgcctccaggtttaggcaatggtaaataggcaggagtttaataggaactaaggttatttgakaattcctgggccactgcaaatagaaagtgttggcaattttgtcttttgggctgcctctgattgaaggcacaggcctgtttcatgaagttctgaaacatgaaccggctgtatctgcgtcaaagtcagtggtaaccaggttaatagcactgacaaccatgttctttttacaggaaacacaaacgtgaatcacttgttcttacttttcttttacagtggtctcaaatrgtcaagaccccctgctgggaggagcttctatcctgctctgtggaagaaatgggcatgccagatgcctggaagatcagaggctcacattccaggtgggtcaccctggttcttctcatcagaatcaactagagagatgggctccctctccatccctacccacgggcattggtcaggctgaaagcaaagaaagacaatccattgcccccaggagaactggtcttactctaaatcagtggcctgcaaactgtttatgtggatgtcyggatagtacattttttgcctgtgtgggccttccagtctgtcttagttactcaactctgtgatttttgagcaaccattrgacagtatgtaaatgaatgagcatggccccatctggccctccacccacaggccatagtttgctgactcctgcaagagtaaaaccctttatgaactagagagttscaggcttgaacatgggtccagaaaatatgggaaggcaaacctcacacatttgtggttgtgtgcctcctaagtgctttgtgtcactgttggcttccaattcctaggaagggccttgggcaccaaccgtatgttgacccagggagaaaaggacttttgggagtgagagtcagagaatgggtaccacgtacccttcagatccctcagctttcagattgacacagcaacagatcatagtctcctaaattctctggcttaaagcatggagccacacttatcctgccaggctgggkccccagttcttagatgaggctagcagtagccatgaggagtgggcatgtggctagtacaagagaaggaatgctaggtggcacttggtcagcaactttccaatatcatgtttcttaattgtatcaccaaatgtgtattatcgtcctgtcttttttttttttaattattatactttaagttttagggtacatgtgcacaacatgcaggtttgttacatatatacacatgtgccatgttggtgtgctgtacccattaactcgtcacttagcattaggtatatatcctaatgctatccctcccccctccccacaccccacaacagtccccsgtgtgtgatgttccccttcctgtgtccatgtgttctcattgttcaattcccacctatgagtgagaacatggggtgttcggttttctgtccttgcaatagtttgctgagaatgatggtttccagtttcatccatgtccctacaaaggacatgaactcattattttttagggctgcatagtattccatggtgtatatgtgccacattttcttaatccagtctatcattgttggacatttaggttggttctaagtctttgctattgtgaatagtgccactataaacatacgtgtgcatgtgtctttaaagcagcatgacttataatctttggctatatacccagtaatgggtcaaatggctgggtcaaatggtatttctagttctagatccctkaggaatcgccacactgacttscacaatggttgaactagtttacagtcccaccaacagtgtaaaagtgttcctatttctccacatcctctccagcacctgttgtttcctgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctgtgcccactttttgatggggttgtttgtttttttcttataaatttgtttgagttcattgtagattctggaggttagccctttgtcagatgagtaggttgcgaaaattttctcccattctgtaggttgcttgttcactctgatggtagtttcttttgctgtgcagaagctctttagtttcattagatcccatttgtgaattttggcttttgttgtcattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaagtaggggatcatttccccatttcttgtttttgtcaggtttgtcaaagatcagatggttgtagatatgcagcattatttctgagggctctgttctgttccattgatctatatctctggtttggtaccagtaccatgctgttttggtgactgtagccttgtagtatagtttgaagtcaggtagcgtgatgcctccagctttgttcttttggcttaggattgacttggcratgcgggctcttttttggttccatatgaactttaaagtagttttttccagttctgtgaagaaagtcattggtagcttgatgrggatggcattgaatctgtaaattactttgggcagtatggccattttcacgatattgattcttcctacccatgagcatggaatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtttgtctgttattcgtgtataagaatgcttgtgatttttgtacattgattttgtatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctaattkccctggccagaacttccaacactatgttgaataggagtggtgagagagggcatccctgtcttgtgccccttttcaaagggaatgcttccagtttttgcccattcagtatgatattggctgtgggtttgtcatagatagctcttattattttgagatacatcccatcaatacctaatttattgggagtttttagcatgaagggttgttgaattttgtcaaaggtcttttctgcatctattgagataatcatgtggtttttgtctttggttctgtttatatgttgaattacatttattgatttgcrtatgttgaaccagccttgcatcccagggatgaagcccacttgatcatggtagataagctttttgatgtgctgctggattaggtttgccagtattttattgaggatttttgcttcagtgttcatcaaggatattggtctaaagttctctttttttgttgtatctctgccaggctttggtatgaggatgatgctggcctcataaaatgagttagggaggattccttctttttctattgattggaatagttttagaaggaatggtaccagctcctctttgtaactctggtagaattcgactgtgaatccatctggtcctggactttttttggttggtaagctattgmttattgcctcaatttcagagcctgttattggtctattcagagattcaacttcttcctggtttagtcttgggaggatggatgtgtttgaggaatttatccatttcttctagattttctagtttatttgcrtagaggtgtttatagtattctctgatggtagtttgtatttctgtgggatcgstggtgatatctcctttatcattttttattgcatctatgcagttcttctctcttttcttctttattagtcttgctagcggtctatcaattttgttgatcttttcaaaaagccagctcctggattcattaattttttgaaggattttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagactctggtatgttgtgtctttgttctctttggtttcaaagcacatctttatttctgccttcatttcattatttgcccagtagtcattcaggagcaagttgttcagtttccatgtagttgaggggttttgagtgagtttcttaatcctgagttctaatttgattgcactgtggtctgagagacagttagttataatttctgttcttttacatttgctgaggagtgctttacttccaactatgtggtcaattttggagtaggtgtggtgtggtactgaaaagaatgtatattctgttgatttggggtggagagttctgtagatgtctattcggtctgtttggtgcagagctgagttcaattcctgagtatccttgttaactttctgtctcgttgatctgtctaatgttgacagtggggtgttaaagtctcccattattattgtttgggagtctaagtctttttgtaagtcactaaggacttgctttatgaatctgggtgctcctgtattgggtgcatatatatttaggatagtttgctctccttgttgaattgatccctttaccattatgtaatggccttctttgtctcttttgatctttgttggtttaaagtctgttttctcagaggctaggattgcaacccctgcctttttttgttttccatttgcttggtagatcttcctccatccctttattttgagcctatgtgtgtctctgcacgtgagatggatttcctgaatacagcagactgatgggtcttgactctttatccaattggccagtctgtgtcttttaattggagcatttagcccatttacatttaaagttaatattgttatgtgtgaatttgatcctgtcattatgatgttagctggttattttgctcgtacagttttttcctagccttgatggtctttacaatttggcatgtttttgcagtggctggtaccggttgttcctttccatgtttagtgcttccttcaggagctcttttagggcaggtctggtggtgacaaaatctctcagcatttgcctgtctgtaaagtattttatttctccttcacttatgaagcttagtttggctggatatgagattctgggttgaacattcttttctttaagaatgttgaatattggtccccactctcttctggcctgtagagtttctgctgagagatcagctgttagtctgatgggcttcccgagagatcagctgttagtctgatgggcttcccttgtgggtaacccgtcctttctctctggctgcccttaacattttttccttcatttcaactttggtgaatctgacaattatgtgtcttggagttgctcttctggaggattttctttgtggcattctctgtatttcctgaatttgaatgttggcctgccttgctagattggggaagttctcctggataatatcctgcagagtgttttccaacttggttccattctccccgtcacgtcactttcaggtacaccaatcagatgtagatttggtcttttcacatagtcccatgtttcttggaggcttggtccatttctttttattttttttctctaaacttctcttctcgcttcatttcattcattttgtcttccatcactgataccctttcttccagttgatcgcatcagctactgaggcttgtgcattcatcacatagttctcgtgccttggttttcagctccatcaggtcctttaaggacttctctgcattggttattctagttatccattcgtctaatttttttttcaaagcttttaacttctttgccattggttcgaatttcctcctgtagctcggagtagtttgatcatctgaagccttcttctctcaactcgtcaaagtcattctctgtccagctttgtkccattgctggtgaggagctgcgttcctttggaggaggagaggcactctgagttttagagtttccagtttttctgctctgttttttccccatctttgtggttttatctacctttggtcttcgatgatggtgacgtacagatgggtttttggtgtggatgtcctttgtttgttagttttccttctaacaggcaggaccctcagctgcaggtctgttggaggttgctagaggtccactccagaccctgtttgcctgggtatcagcagcagtggctgcagaacagtggatattggtgaactgcagatgctgctgcctgatccttcctctggaagttttgtcttagaggagtacccagccatgtgaggtgtcagtccgcccctactggggggtgcctcccagttaggctactcaggggtcagggacccacttgaggaggcagtctgcccattctcagatctcaagctgcgtgctgggagaaccactactctcttcaaagctgtcagagaggaacatttaagtctgcggaggttagtgctatcttttcatttgtctgtgccctgcccccagagttggagcctacagagggaggcaggcaggcctccttgagctgtggtgggctccacccagatcgagcttcccggctgctttgtttgcttaatcaaacaactaactgggccacggctggcgcccctcccccagcctcgctgccgccttgcagtttgatcttggactgctgtgctagcaatgagcaagactctgtgggcgtaggaccctctgagccatgcgcgggatataatctccttgtgtgccgtttgttaagcccattggaaaagtgcagtmttagggtgggagtgacccgattttccaggtgctgtctgtcactgctttctttgactaggaaagggaattccctgaccccttgcgcttcccaggtgaggcgatgccttgccctgctttggctcgtgcatggtgtgctgcacccactgtccggcactccccagtgagatgaacccggtacctcagttggaaatgcagaaatcacccgtcttctgcatcgctcacgctgggagctgtggaccgaagctgttcctattcggtcatcttggctcctcccccgtcctgtcttaaagagaagaaatatgagtctctcctgcctgacagaaagttccaggcagcagaagcatgaccttggcattatggcagacagagaggtgtcctttgcttgtgcctttccttcaacctgcctgaccccggctctgctcagcagtgacccatgctctcttgaccacttgtctccagcagacctgtgatttgtccaccttgctgcatcctgggctggtggaactaccctgtttggggcttctcctccaggggttcacccaagtttagaaaagcagtaaaacagccaccatgcagaccagcctatccttttaacaaacgtctttgaagctaccatgttctaaaacattttcagcatgttttgaagctttttattattactatagggaacactctgaaactaatgctatggttataaggaactcggagccatccccagtatgattccatttcccaacaagttcaagaaacagaatccaggcacgtagtatatgaacaatgccaaaagatgcaaccgatacagtgaaacttcatggtgttagagacaggaaggaggttggaaattaccctctaagtttgttcttttagctcattatttacttttaaagtactgcttgtgcagaacccaaggacagctgcgcatttattgcacatttatattcactgcttcctgatgacattaaatgtaagcacctgcagcagggtattggtraactgtccaggggaagcacaaattagaaaaaatacaaaatacgcttccctgagcccatgaatttaccrtatcaggaatatgtaagatacattaattagttcatcagtaggctccaagacagacattgcagatggtggggaaggtgggggtgggggcaggtgggtgggcaggcaccactgactcaaaagttattgcgtgtgggacactttgccaaactctggggcctgtgtgggttgaggcacatatgttggggcctccatcagggctgggtggaggccagggcaggacacagtggtctggagctgaggagtacgacacacaactccacaggagcctcagagtttagcacgtgtgcagggtagcatgtttgggcaatgtgtgtctgtctgagagtcttctacagctgagagcctggggtccccaaggaaatagggtgatgtcagcagggaagagcccaaaacgctcatcagccttcaaaattcagcatacgctagggacctcatgattccaagcagagaagctaaaagaaatgcagttcaccaaggcatgtagttcaggtgccttctcccaggacctatgtagcattgagacttccctggggtcctttaaattatgcaattatcaagccttttttgaagatcttttttaaaatgatttttctttttgcattgtcttttggttttcaaggaaacataggttctttggtgaactgttttataactacagcatttgctgtaaggaggtgttcatattctcttagtgtaataacatcaagaagctgaaagaagtccgagatctctaggagggaaatggcttcagaatatgcctctcaggctaccatagatctgacaccccagaaatatttggaagacagactggagttagattccataactcaggctatgtggcctacctgctggggctcctatggccttccctacctccactccccaagttgtggcagagagccccttccaaattgtcctcggtctgattaacctcagtatgttagaagacagggggttgtcaaaggccaggatgttctttgctgtctctcattgtgctgcagttgttgaagcctggagtaccaaccgggatttcagacagcttggatgatgtcccttctggttctgcaatgggttctcttatttgatgggtagctgagaaaaagagaggcaagggggctttagatcttctggaaatcttgattcgtcagagttgattgactygtctcttccctggagtcagtgacaggcaaattcacaatttcactcaatgctygcactgaatagctaaaaaatggccagtattctgggctagaacctgatgacagaaagagatatggaaggaaaacagtgtcctaccacaaagtagcaaagacacattgccttggtgtcaacacacttatacttaaagcttggttctgccatttataatgaagtgacctactgctaattgttaacttctctgagcctcagtttgctcatccataaaaataatgcctcagtgttgcagtgaaggcttactataaagtgaccagcaggcaagctagacatagtaagtggttggtgcaaagtagctgctgttgggctgcttttcattcggtttaagtactcatctagaactgatgcgctattagatctatttgactgtcctgtgaacaaaagataaattgtttcctaggagtattttatttttctaagctaaacacttggtgcataggagcttaccacttgcatgtaattttcttgttttgtataaaataaactgaaaaaccrgttctttttttggctgaatttaatcatcaaacctatttttaaaatgctctttgtgtactttctttcctttttagaaaattccttttggtatttaggaaaatgtttaattttgttctaatggttacctttgtagtactctttattacctttttaagaattttttaaccttttaccatatcttttggctattacttatagtgtaaattcaatgatcttattctacgttcttacccacttctcccattttaaaaattgtactgtttckattctgttagaaaatgcaatgtttaactaccattcttatacccatatctccaaccttgtgttagtcctagatctatatatgaaatatgtagaagcccaccttcaatcctcctgctgaagtgtctgcagtcagctcttagttgaataaagtacacttaattctgcagtggattcgtcagaaaggacacgtgggcacagtattcttgtgttctttcgtcttcaaaactgcttttctatattgttaacatttgaagaacagcttggctagatataaagttcttgacttgcattttctcaagcttctcaaagagctgcttcactcacgtcttgctttatatgttgttgttgagaaatccaatgtcagccaaatcctcttctcctttcaagctattttatgtttcctccaaaaggccatatggatttttttctttctctttaaagcttagcagttctactaggatatggctctgatataataatgccaggtcaacttttataataatgccaggtcaactttttcaagtgaaccctttcacttgtagattcaattcctgatttatttccagaaagttttcttggattataattttaaataatagttatattccattgttttgctctcctcgttcaagaactccagttggacatccttggctggtcttccacttcgatcactttcctctgaccttttttctttttttctttacctcctttttgctctcttgttttctcctgctttccttcaatgtcttttgttaaatttccatttaaatttattctcccttgggcctcataattttgtctacatttctggtatgattttgccattttctttgatattcttcctatgttcaatgactatcatttcatttcttccttttcttctttcttgatctatttgtgttgctgagttttatatttctgattcagttttatatttctgattcagttttatatttctgattcagttttatatttctgatgctttttacgtatctccaaattctattttgaggaaaattaatttttgtgggagtattatgttacagttttcctcagctcattgttccccccaccacaccctgcccctgaggtgagggagtattttcttcagctgaattaccttggttcactttttacgacagttttatttggatatgactgcggtttttctgtacctcttcattctgtggagagagttcatcgtgtgacatcagcatttcctttcagttctgcccttttctgtgaagtttcttttatggaagatgttgatggtgaagttaggaagaaaaagaaagggactactgtgtctttcttcctagaaacattaattttatcttttcttttttctttcctttcattgctatttcaccgaggaataccaccacttctctgtatctcattctccctaagaagccgtgcttctccagggctgccacttctgggcctcactcatttcaaatcttttccctgcagctggtggtgtgaactgccaagttccaaattgcgtagagcatttcttaacgtagttgggctttcttttgagagtgtgcataccttatgtaagtccttaatgccctctactatttttgataccattctttaatacttccctacttcactttccatatccataggcttgaagcagtaaggcaaaaggtagctgttagaatatgatgcatttttctacttgctgatcatttacaacttgtagtattctccaattcttagtaatgctaaagccataatgttattttctattttcactctatttattttaagggtttttaaagttgtatggggagatttgaagtcaagcagctgccatcattttccattcctgtttggtgttcattgaacttcttggattttcatgttgatatttttcatcaaatttggaaaaaaattttgactgcatattttttcaaaacttttttatctccaatctctattctttttttttctcaaatctctctctcctctttttctgggactttaattacattaatatttgaacccttaataccatttcacagataacagagactacctctctagcctttcttctcttagcttcagtttggatagtttctactattctgtcttcaagttcactgatcctttctttttcagtgtccactgtgctgctaagcccatccagtgaactttttatttgagatattttattattattatcattttcatttctctactgagagtatccatttgtttactcattaggtttatcttatttaaacctgtaaacatatgcataatggctgttttaaagtcttcgtctattaattccaacatctctgggtctgtttctattttttgttaattttttttcctggacataggtaacattttgctactacttcacatatctagtaatttctgattgtgtgctggttattgtaaattcttgaaactcccttctcttggctcctgtgacacaatgatctctgggttttcctactacttctttgggattctgtccaccttctttaacactcattatcttctacttgatttttaaatgtcatagatcttcatggctcaatcttatatttgatcttttctcacactatattttctctttaggcagtctcatctacaccctatgcttcaatcaatcaccacctacacactgatgattcaaaatcatataaattcagatgagacctcttctttgactaacttcagactaattgctacttgtttgtttcaataacacatctatctcactatgtccagaaccaatattgtgatttctctggcctgcctgcatgtgcaaacacacacacacacacccacaatatgaaataggaaacttcttctagtgatataaatttcagtgaattacaccaccatcacttcaattatgcatgtttgaaatacagacactttgacacctcttccttcctcattccccatatacattccatcttgcaattttattgattttatacttccacttgtctccattgccatctctctctgccactatccagtttttagctcccaccacctctcacttgcattatgaaatagctccaaatttattgtgcacctctaatctttccctgctataatccattctccaaatcattgccagcattacattttagaaatgcaaatctaataatgcaaatctaattcattctctctctgtatttgtctctctctctctacatgcacacacacacacatacacacacacagttttaaagaaggctaaattgttgtccattgctttttggatgaaaacaaaaatcattaacatgggctgatccctacctgactcatgttaccatgctttccttgctctctcctatccctctctgttgtcttggtcctatatactgttctggatttcctggagtgtatctgcctctggtctttgcctgtgctattccatctgtattaactgctcttttctctcctcatcacctcctccaaacctgaaatcaattgtccttttcttgggggaagccttccctgaattccttggccagtcaatctcacacttatgctcacagtggcacagtgtacctctcatttgtagtccctataacatttgtaatttcacatctatttccgtgattctttcattcaggtatgacacccctactgaattataactgtcatgaaatcaagaattgtgtctgttttggcacactcatatttctagtatcaatcatagtgtagatgtttaataaatatttactgaatcagtgaataatgaataaaaagtactcttccatgaatctttcttatactcatgcttagctctcactctacctttctaacaaatggcctaagcagaggaagatgctaaaggggctgctaaggcagcaagaaaatcaagtarcacagaaacagagtcagttggttctttgcacttaggattctcagaagaattttttgcttctgccttcaaaattaaactggaatattaaaactgatcttttggtccctggaagatgaagtacaaaccatcatcaaaaagtatctactgttgggactggtgactcactttgtccttccctcctgtaagccatgagaaggaatcagaatgattctgtcatcaagagcatcacaaatcctggatcttcacctgattaatgcttcacgtctagcacaagcactttcattttcaagggattccatactgtattgtctagcccctggctgggttgggatatagttatcttggtggcataggatcagcatgtgtaagagcgggatattattgggcgctgtattgaaaagagtaaccctgggaaggtgagggtgattattaagaccaactctgaagcgatgactggtgaccagaaatgagttgatgtcagaaatttctacagagatggtgatagcttataaaggtgaaaatccagtaaatagtctggggtttaaaaactcaagtaagggatgaatcaagggatgatgcagaaattatgtgtagtagaaaaggcagatgtcaggggtagaaatacatcaccgggcaagtaaggccaagtacgtgcccatctggaacacagggcagaatctcttcagtaagttggctttattggttttagtcatttttatctattgctgatgctcatgtgatactttgtttcttgggtgaatttcggtatctcagacagacacatacaaggagaaagaacagaagttcttaggtagttttttagtaatagaagttcttagattttttttttttttttttttttttttagtaagaaagaaaagtgctgggagagattgatcgttccttataaaaaggccttcattcctcacaaaaatacaactttcagtcaagaatttggtcctttaaaaaagaaagaggaagaaaagaaagcatgwgctctatccctcttttgactaaatactaccactgactttcctgtttakaactaaaggctgtctcttgttccacaggtcaaatgcatactttttaaaatgccacttgaccccttgggttccccattctcagtagaaaaacaaaatggtcattaatttattttgacatgcaaactcagctgaacattttktggtgattcaaccccacagatgtaaagtgaaagagtgccagaaaagcaagtgagagccatgagattaccacaagtctgtgagcacatttttttcaaggcttacagaatcccaaagcttgcccttgcttcaggaaaaagaactggttgacacctgagaggttttaagccacaagaagctgaggcccgttgtgaggagggcagggacagtggggccaggccacacgcgacgcgtcacccacctcctgcctcacctcccccactgagatgtctgctgggtgggaggaggcttattgccagagaacagtctggtgttttctgttcctgcttcaggaagtcccccttctcccgccacccccgcagctcctcagcctggaaacaacttttagagaggagaagggaagcaaagctttcaaaagcagatacctgtggggtttgaagggaggtgccccttgttcaagtatttctcccccaaaattgaaaggacacttcagattcattcattttagttttgatgtatcttcagtaattaagaagccactaagaaaactgaccctgggaaggcaaattcctgaagctgagtcagatacagccagctcttaccataccatctgaccctcagttccctctgacctcatctcttcccacctcctctctgtctgactcagcagtgaggccacacaggcctccctgctgattcgagaatggctcccacctgaggccttgggccccccttgttttcgcccccacatacccatctggcttccccttcactgcttccaaggctctcctcagagagcatcctgtcagaccagtctttcctggacatgctgagtgtacctttcccctatttcattttccttcgtggcaccttttaccacctgatatgttcaatggctctatgtttgtttgtagtaagtctcgcctgactagaatataagacccatgggagaagagactttctgctctacccttggcacataccgggtgctcaaaaaatattcaagtgctcgcttyggcagtacatgtactaaaactggaacaatacagagaacattagcacggccccttcacaaggatgacacacaaatttatgcagcattccataatttcgagaaatacaaatcaaaaccacaatgagataacatctcacaccagtcagaatggctattattaaaaagacagaaaataagagttgctggtgaggctgcagagraaaggggaaagcttatatgctcttaatggaaacacaaactagttgagccactgtggaagacagtttggagatttctcaaggaactcaaaatagaacaaccattagacccagcaatcccactactgagtatatacccaaaggaaagtaattcatcctatcttaaagacacatatgctcctatgttcactgcagcaccattcacaatagcaaggacatggaatcaacctaagagcccatcaacagtggattggagagagaaaatgaggtacaaatacaccatggaatactatgcagccataaaaaagaatgaaatcatgtcctttcgcaacatggatggaggtggaaggcattatgacctccataaatgacctaatgtaagaacctaaaacaaaatattgcatgttatcacttgtaagtggggcctaaacgttgaagacacatgatcacgaagatgggaacaataggcactggggatcactagatggggaaggaagggagcagggggcatgggctgragtgccacctgttgcgtcctatacttattccctgggtgatgggatcattgggatcccaagcctcagggtgatgcaatttacccatgtaataaacctgcatgtgtaccctttaatctatgataaaagttgaaattaaaacataaacaaataaaatcctgagtactgtttcaaaaaatatatttgaggaaagaaggaaggaaagagggatggagagatggaggaagactaaaggaaggatcgtggccctgagagaatagagcacaggccaggggtgagatacagagtgagatgggagctgaatggggtctctgaaactagacatggaagacaccaaaagaaacattcctacttcatctttccctgtgcctgggataatttactcctggatggtaaagatatgtcttggtttcatctgtgttaaataaacctgcacgatgttacaagctggcattgcttcataagcttgaccttagctttcaaataggacctygatcattgctcaatgaccaagtcacaaagttgcctaatgatattggcccacagccatgttattgcaaacatggcaatgactggccaaaaccaggtgtgctccttacatttctgcccgggtgatactctcagagagctcctcgccatgagaactaagtcastctcccagtgccaggagccaggacaattayggggctttccctattgtgtgttcttgctgctaaccagctcccaggcctaggcttctgagaaacagtgyaggcacacaagctgcagatctctcctccctttattctctctccccttccccaaacccacaatagcctctaccatagtgcttattcttttgacctgttctgatctgctagcctaactattccccarcacctttaggaagataggtcttccctgaccctcagtctgaggtctagaagcccttctgccttgcctcacaggcatcttccctcctcccccgtccccyagaccagtccaacagcagcccgtgcagcctctgaagtccactcccagtgctagctgatgggaaccccatgggctcctgtctgctatacaaatggaacagactttcttcagagccaaccccagctgccccactgaagctggttgccacagtgattttcagtctcataccagattctgatctcttctcttgcccacctttggtgctgcagagtggatcatcttgttttatactcaagtcatcattaaaatttatagaaaaagagagaatttaaaaaaaaaaacactaaaaaatcaccttgtacgcatatacctcagaagrtctttggcctaatggtaatctgtgacattaaggcaaataaccaaaaatatgtaatttttctatttatttctttgagtgggctcagttgcagatatatgaatctgaccagggtcctgatcacttcctgctcccaaagaccaccctttgagcctgtaagatccaaagtcaactcagtggattaatgtgcaagtctagcctgagccagtaagacatggttccctctaagatgccaggaaaggacctagggcttccctgggctgagctcttaggtaagccatggcctggcctggcctyttagaggttgtgcaagaccagcctctgtgatctgcgaaggccctgagtcccagacatcgtctccaacactgacctagatccagtgccagcaggacaagaaagwcccctctgctttaacctttacatgaaaagaaactttgaaatgaccaatccacattttttttgtttgtttttttctgctttccacagcccttttctgtctgtaaaaccaacctcctcttcttggctcatcagaacactcattctattttatggaataaagtgctgcccaattgtagaatcaaaaatacagcaaattaatgttttttatataaagtttttgatacataataattacacatatttatggggtatctgtgatatcttgacacagccatagaatgtgtaatgatcaaatcagggtatttaggatatccatcgccttgaacatgtatcatttctttgagctaggaacatttcaaattttctcttctggctattttgagatactcaatatgtttttgttaactatagtcaccctactttgaggctgaatactagcrcttattccgtctaactatatgtctgtacctattaaccaacctctcttcatcccacacacccttcatagcctytagtagctaccattcttttctctacctccatgagatccatctttttagctcccacatatgagtaagaatatgcaatatttgtctttcggtgcctggctgattttacttaacaaratgcccttcaattccatacatgttcctgcaaatgatagaatttcattcttttttacggcttaatagtattccattgtgtgtgtgtgtgtgtgtgtgtgtgtgtgtgtgtgkatcacatttgctttatccattcatctgttgatggacacttagattgatactgtatcttggctattgtgaatagtgctgcaataaacatgggagtgcaggtctccctttgatatattgattttttttcctttggataaatacccagcagtgggatttctggatcacatggtagttctatttttaattttttgagaaacttccatagtgttttctataatggctatactgataaatgaatttaacaaggttgcagaatacaaaatcaacatacataatcaatagcatttctatataccaataattaacttgctgaagaagaaatcaagaaagtaatcccatttaaaatagctataaaaaattaattgtctaggaataaatttaatcaaatttaataaattctttccgatgaaagaaattgaagaagacacaaacaaatagacgttccatgctcatgaattggaagaattaatattgttaaaatgaccatactacccaaagtaatctacagattcaatctcttatcaaaataccaataacattcttcacagaaatagaaaaataatcctgaagtttatatggaactacaaaacaccccaaatagccaagcaatactgagtagaaagaacaaagtggtaggcattacacaatctgacttcaaaatatactatatttggttacatatagtaaccaaaatggcatgatatttagtataaaaagacatatagaccagtgaaacagaatagagaacccagaaataaatccacgtatttatagcaaactattttcaacaaaggtgccaagaacatacactggggaaaaaatactctcttcaatatacggtgttggaaaaactggatatccatatccggaagaatgaaattggatccctatttctcaccatatacaaaaatcaacacaacatggattaaagacgtaaatgtaagatctgaaactataacactactagaggaaaacacaggagaaatgcttcaggacattgatctaggcaaagattttatggctaagacctcaaaaacacaggcagcaattaagatctttaaaccaaatttgttgtaattttgtcttatgacactagcaacacaagtgaatttagaaccatttgtctggtcacttaccgtagaattaaccaccttcaaaacatgtaacgactttaccacttaaacccttaccattttgttatggtcagggatactgtgggccaggtattcaataaggacacagtagaaatggcttgtctctgttccacaatgtcttggaccttagctggaaagaagcaaaggccaatggttacttgatggcyggragcaaatatcatctcaaggctcccttcctcacaggtctggttcctatgctaataggactcaaagacgaggataggtgactcattamctacccatggcctctatacatgggttggtgttttcacaacatggtggcctaggtattcagactcaaggctccaagaactagtgttctagaaaactaagaggaagctgcgtcactttttatgattgagcctcagaagtcaagcagtatcactttccctactctactgtttgaacaattacaagcccactcagattcaagtggactccacgtcttgatgagggggaactaaggtcacaacgtagaagagcacagacgataggagacactggccatctttggaaaatacaatttgccactcatcatgtgttaatgcacagatgaggaagtgctatctgctcttctcccctcctcagctcaccctgacttctgtgtttccagtcctgattatttataacacatgttcaatataacaaggatgttttgaagcccaaaggagtgaatcctttcctagcctttcaaaccaagataaggaaaaagtggaagaagacattaagacatgcagctctaaggaactatccaaattacactaggtagatgccctgcagatgtttaacttcaagatttccagaggccacgtgtgtgtcagtatcagagaatcaagtttacattctcaataagtagatgttgagaatatacagctgatccccactatttgaagatttttgcatttgtaaatttgcctactgactaaaatttatttgtaacccccaaatcagtattcagagtttttgcaggcatttgtaggcatgcaccaagtggcaaaatattgagttaccttatgtgcacgtcaacagacgaaggtgaacaaggcaatactctgccctcttgtttccattctcatactgtaaacaagtgaccttctgtggtcaacctagtgccttatttttcaaacttttgtggttttgttagcaatttcactctctaaaaatgaccctcaagtctagtattcctaaaaacaataaggctgtgatgtgccttacagagaaaatacatgtgttagatacaccttgctcaggcatgagttaaagtgctgttggctgtgagctcagtgctgatgaatcaacaatatatattaagtaaggcatctttaatcagaaacacacataaagtaaggttatctaytgatcagttggcaaaaatgtaactagaggctcactggaacctaaacctgcatttcccttaggagcagtggttcaatatttgctaattcattgtttgcagtgactttatagagcataacttatattacaaataatgagaatcaactgtaccgtagatcaggacttttataagccctggagatacaacagtgaccaagcagaccaaaatccctgctgtcatagagtttatattctagaggagaggggaaaacataaatgaaataaataaataaaagatatgtatgttagaaggtgataagtgctatgggaaaaaataaagcaagtgatgggaggtgggagtgggcattcaaggtggccttttttgttgttgttactattgttttctgtttctttaccaaaaaaaatggccagggtggacctcaataacaatcagataacagttgagacagctggkgaaagagatgaggaagaacactaagcgatttcccggaagacagcagaaagaacaaccagtacacaggctgaggatgtaaacaaacccgccatgttgtggaaaccaggaggaggctcatgtgcccaaaatgsagtcagtaggagataaggtcagagaagtaagaaggtgtcaactcaatagggcctggcagcccattgtaatgactggggctttcacactgagtgaaagatggtaagcatccaagggagaaacaggasagcaattaaaagagtkgcaaaaatctagacttggagagtaattaccaccgattataagaagtggtcaggttccagatgtcttcaaaggcagagccaacaggatttgccggtggattgcacgtgtaattgtgaaagaaatgatgatgtcaaacatgactccaaagtttttggcctgagaagctggaagttgccattctaagacagaaaagactgtagatcaagcaggttctggaggggatttcaattctactcattttaaggtgagatgtctacttaatatccaagtggaaaaataaggtaggcaactggatatacagggctggaattcaaagaagtccaaactggtaatatacattttgagtcctcagcataaagatggaatttagagacatgtaactgaatgagaccaccaaggaatcggtgtaggaagagaagaggttgaagaatggaatcctgaggcattccagtgtcaaaagaagaaattgagaaaagcagattgagaaatgtggcctcctggaagctggatgaagagagtcttcctagaaagagtgaatgattgttatgtcagcatgcccagaagtggggtaggatgaggactgggaagagagaaagtcctgatttgtagagtttgccaatttccatggcgaaaatactcccaccagagttgatttcaagctgttaatgtgatgtcattgaatgcagagtttagaagagatgcacacaattggctctcaggagatattgcaaactgatctcagcagacattgcaagctgatctcagcacacccctgacagctaatgatatccattgcctcagcaggctttggcatccaagagggaactaactgcccaagcaagtctgaacgtggcatggctgaatctctgtcatctggacagggccaagcaacatttatcttcaatatggtaggctggcaactttctcagagggcagcccaagctgggctgggcaagaggggctcagaaaaggatgtcatggtccttgcagccagactcatgctaacttttagcagagtgcatttcagtaatgaacagcctgagggatggtccctcagccaacacagaatgcagacctctttgcaggcttcccagatcttcctgagcacatctttggtgtctgattcaacaatgagagggtctgactagacagatttaagtctcagatggacttaccgagcaagtacactaaagtaatctggacactttaacaaataaaagcataatactctctctcaaagagttgttaaaacaaaatctgatgagaaaccttcttggaaataagtctcccggcttatgggaaccttgtttccaaatctgttagtattcccgcccacatcctgagaatccttttatgttctctcagactccagaccctacttcatacatttcctgctgcctagactttatcttgactggcctgattactgataccatttggttccagccacttaattcccagcagcctgaaatggccacatccctaaagcaaaataccatcggactaggaggaacatcaacctgcttaaattgtgggctctgcctttcatttacacacaggaagaattttccaaggaggtttttttttcccttccctctctggaagtctttaaatgtgagattttcatttttcataaaataataattaacaaacatacatcgattacctactgaatgcagcgcaccatacaggattctataaaacatacaaagaataattagatgtctacttataatgtagttgggaaatttgtcattttcttagataaaattctgaccaatgtgagtgcccagtgaatgtctcagaaaccaggtactggaggacagtgagacacaagaagcccacaaagctgcagtctacaggatggataagatcaaaggaaaggaaaaggaatctcctatttgcttgccacttctttgtgctagaactgttttagacactacatctgtttaattacatcgcaatacttcctattgctataaaaaaggattttcctacttctatgaaaagagagtgtcattcctttttacaaatgaatcacagagtggtaaagcacttaaccaaaatccacagagccagtcagtggcagaagtgggaccccaacagaggaaaacatctccaaagtcctatgtttaactcttactaccacttcacattgcttcccttagactgaggagtcagtcgaattgtgccgcccctcttcccaaagatacgtccgagtcctaaatccctgtatctgtaatgggatcttatctggaaatagtatttacagatgtaattaaagtgtcttgagatgagattatcctggaggtaggggctggactgaggagccaaatccaatgactggcatctttagaagagaagggaaaacagacccagagacccagagggagggccatgtgaagatgaaggcagacgtkggagttctgcacccccaagcccaaaacaccaaagactgccagcaccccgcagaagtctggagaagggcgtggaatgaattctccttcaagccttcagaatgaaccaaccctgccaacaccttgatttttagacttttgaccttctcaactgtgagagaataaatttctgttgctttaagccaccaagttgttgtgatttattatggctgccctaggaaactaatacggacagtcaggatgaggtcagtctgcacagagacatgggggaagaaagagaagaaaagatcacgaaatgtgacttctaaagctgagccaaaatagggttcctgggaagagggagctatactctttttgctgccagtggcaagtcctgaactcccatgtcttggtttgattccaactagcgtgtcataaactattcggtttgactctgaatgctaacatctaatcagtttcctcagcttgctggttttgctggtttctattgtttgggcaagtttgagctacacagacacagctcctggtatacttgtcctcaaatatcagagaacatcgaatcattcaggtgcatctttgtgagcacactgaagagataagcttctaagaaataaaactgatatcactggcaatgcctaccattggtcaaaagtaacttcctcaatagctcttggtggtgcctagttctgtttttacatggaggcatcagataaaatgcaatgattccaataggattcagctatcatcacccattaacaggtcagttctragggaagcagctctctggggatttattgtggaatgagagaggagagaaaactttatagccaaagcaaaacgcaaagagatagatctatttgagaatcctgggcattcaggaatgttagcaaggaattgaggaacagactgaaatgaagatgacaaggaatgagaataaatcatggttatgtccaattttttgtatgttggtgttcaagaaccataagtagccacttactgaattctgattcgagcttactaaggacctactaaggacaatgtaccccattaggtgggtgtactagagctataaggatgaatgagttcatctgctcatagcataaggaggcaaactttgggggttgggggaggtatatgttgggagtcagagtagaggaaagaaaaatgatgccatatccctcagcttctgggaggtgatcccatcaagagtgcagtggaatttttaatgttgagaactccatgaagttctgtaaccaagtaccccccattgtttctgagatagagaatgaattattttttattttctcttctctctttccccctrctcccctgttccccacttcctatttagctctttagaaatgcaatgatgataatattttaccttccctccaccagacatccctacagggcaagcttatctgactatgtgcttacttaaaagctccaggacagaactctgtcctaccaggagatttcctcaaaagacaacagtcaatacgcaacctaaagtacgcccactatgaaaccctctcccacctggaaagtatctcgagacaaggccactttacaacctagttctgcccgggatggtgccagctcgaccacctggtagataaggcacaaatcgagtcatgcagacccccacctgctcacgccctcccttgcatgccattcatgccaagtccccttttaaaagtttctgctttctgctccaaaagcaaagtggtacccataaggcaggcagcctgtacttccctaagctagctttggaatacaaaatcacatyccttataccagactccgctcttgttcattggactaagcaggtggcaagtgactaaacctgtattttggttacatttctactgagaggaatccagggacaccaataacaggctgagagttgtctggctgctcagagctccacacaaaggtcgggtatttgtcagaggaggaaaagtgtggcatctttatatagaccagggctcaccggcatatactttgccatttcctgggaaaggaagcttctggctcctggaaaaatggcagamacttgaacagaggattggtgaagtcttttggtttatgtggccagatagtacaaggttcctatcaggaagaaaagcacatagtgtctttcttcactcctttgggtttgggaaacaaaaaaaatacaccaaaggcagtgaggccaccataaaacccagagtgggggcagaggacaggatgctggggagttcaggggaagggctcttctgaggtctgagtttccctgtatctgcgcatttatcccaactgaacttttccacgggagtgcttctggcctcctctcagcctaacctccccacctctccacatcctgagcaaaggttccatgtgaatgagcccagatggaaaaacactggaggagtttttctttgtcactacaggcaggaagaaaatggcaaatggagacaattatttgctgaatttggtctccgtagactcatactttttgcttagttttcattatttgaggataaarattgcttttaggcctaagagactcagctaactggacaatttttcagttcatttttgagaagtaggcatggccttgggagaacattttttaccctctccgcactctcattccatctcacatacaaatacatyaagaaaatgaagccaactgaagcagaggtcaggagtgaaagaaaagttgatataagagcttcagcaacagcagctggccccaggcactagcggctgataaaggaaactctgggcagaagagcctgagatgaatgggatattagtgagaggagctgagccggtcacatagccaagttttgcaggaggraaaaagagaatgggaaattaattataatcaattcctactaaaaccctgagaattggagacaacacataggctattgagagggcgatttctcctaattctttctgcaaggtctwagagtgcttctwacccacaacagaaggtacgagaacctctgccaagcatatggaattgccaacttcaagtcaggagaacttacttgtgagcctcctggagatggttatgtggacacagatgatgggttttctttctgtttagtaaggagttcagtaaggagtaaacctatgtttgtttggttctcatactcgtctctactccctgctgatatttcccttggcagaaaatgagtgcactgaccaagccaaatgcaagcaataaatccggtggcactttatatcgtattaactccagagaggagttagaaggcctcaagacaatcatgcctatcgtgatattggaggttcgctgtttggagggcagaccaaaacctggaggggtctagatatgaggatcagaggctgagaaagggtattggggtagggagtgactccaactttgctttcagccacccttctcagaggacagtgggcagaccagcaaaaccattctggagggaaagccaaaaaaattagggttccaggaaggctgaaaatgaaggcggccttttctaataaagtgaacaggatcaagaggctgccaaatgctgctcactccaaccccttttattggcagtgaagcaagtcaaatacttactaggaacactagccctttcttagaagcgactcttgttgaaaaaaacatcctgtgctttgygaagtgatttgtccctgaagaactctatgagtaaaagagactctagctgtgactttggccaagtcaggtggtcttgctactgatgagggggctgaatcctgagcattctctttgatacggaaaataaaacggactaggggagaaggtatagaatgtaacgcactaggggttttttggagggaggataatctctgggmagttccctactcttgaaacctagcctggaatgggctttcacctctgtgctatttatactaaaactgaattggccttagggatgggatggaaagtaaktaggattccctattacctgatgattttgaacccaaactattcccttgtggacacaaatgggtatggtggagtcaaatgcattccgtgaattcttcccctattgttttaatcaaagcaccgattttagcacagactcatgtgccaaacaaactattgaaaaactactgtgatacacatttaatgagatgatctaaagtgtttctgggggcttgtcatgggactgctgaggtggtctccagggatgcttagaggaaggatatgggaagtgagacatgtgggttgaattgccccactcctaataaggctgataaattgaaaaaccaaggtatagaagtgaccttttacgttctggggcaacttttcatctgtgcttaacgagagaaatgaaaatcggatggatttccactgaaaatttcatgtcacgatttcatgtgaatgatctaatatctagctttccccaggagccagtgaattatatatccagctgtggaaactgaaaacaccatgaggctgctcatgttaggcacctgctgtagagaaagacctttcgcatttgggaggaggggcagaaggcttgtttgtaaaacagcctggtgtgatgctcttttctgagcatttttctcttgctctctctgccttgcctgagttgtctcttctcagtgactttaggagacatacctttgggctatcttcataaatcttttgctatgaatcaggatttaaatcattagggttttcactcatgccatttaggatactgaaaacaagtgtgcacttttcagacattctgtcttacacctgtaggtcacaagtctttcatgcctatggtattttgttacagtctatatggtttactgttgcatctctcaatccattgaagtctattccctaaaaacttctaggcatggagtaaatgtcaattacaaatgaccagaatttaacaacaaaaaatttctaggcaggaatgttacagcccatcttcagttctggaggaaagctgggatagttcataaaataattctgtctgatttgtttctatgagaatctgtgtttagggtattttcaggagagaggaatacacttacttgctctaaggccacacatcttaaaccgagatacatctactctgggaggtttgcagctggagttttcagctraacttttaaaaactttgtttaaaataagttgctttacattggaacttaatatcctcagtggattgagatcgacattctgggaattgaaattgtgtctggagaagagaaaggagcaatgttgcattttgcagtagaggcagatgggctaggcagggatgggggaagtcttctgaaaggaaagcagtgaacagttggggaggggttcagaaatggagctaggggaccaaccacagaaagggtggcctactttgggatttttctagctgcagcataaatctagtacatctttttatattgaaactaaatacagatatgaaatagagcttcatctggcaatggcctcatgagtgttgggcaaagctgccttcttctgaggctgtttccttcaggcacgggcttgggctcctcttctcattccctcaagccccactctctcaactcaggtgcctttgtcagcttgacataagatcctttaataaacctaatggcaaacatcaacgggaagcaaaaaatccagatctcaactatggcatgaatagttgcaaaagatctaactaaagccacccagccacagtgtggcttcctttctgcacaagtattcttgcttcctaaaaaaggaccaacctggctgggaacgctggctcacgcctgtaataccagcactttgggagcctgacgtgggtgaatcacgaggtatggagttcaagaccagcctggtcaagatgtgaaamcccgtctctactaaaactacaaaaatgagccaggtatggtggcgggcacccgtaatctcagctactcgggaggctgaggcagggaattgcttgaacccgggaggcggagcttgcagtgagccgagatcgcgccactgcactccaacctgggagacacagcgagactccgtctcaaaaaaaaaaaaaaaaaaaaaaaaaaaaaaaaaggaccatcctataccccattctcagcacgtcattcaggtactggacagaccttagtcttaaaaccagcatgcctggagtgggctcttaccctctatgggcctcagctatggggggaagaaaagaaaaaaaaaaaaaaagcgttaaactagggactcaccaagggcccttccagctctagctctcttcaattctacatacagcattaaagaatttcaggatatatctccctggcttgttgttagtctctttttactttctccaactttccctaaagcagggaatagcaaagaatagcaaagaaacttggtgctgatctgcagagagagcctctcctcaatcagagattctgagccaaggggtttgtgtgacctttggaactcaaccacaaagccctggaagaactggttaccaccaggaccctagagaacaatcccaatataagccacactttctcttgttgttctcctatctccatttttgaacctctccccaaccttttactgccttgccatctaagtctactgtaaaaatacaacatttctcctttctcctctctgtcccaggcaaaatttctattcctaggatgttgatctcaatctgctaagaatattatgttctaatgtaaagcaactctttttaaacacagagctcaactcaaaacaatcttcagtgatctaccaaaaaggaagatattttgaataagagacttccttcagatgaaatcagtataattaattcaaatcccatccatcctctctttatataatcaaacttcacagcaggacagagataatatgggttagccaagaagagaaaagttttcagtcctagaagaaagaaggtctctgctatcacctcataatagctttggggctactccctccaagatcatagagctygtcagcataaatcatagaggagctgtttgcatgcagcagagggacccagagtgccacctggcatggtccaacctaagaacctaggtgagaagcatgggaagccaggggttgccatgagaataaaggtaaagagacacagtttgtctaattcttgggtttgcttggggtcagctctgcgtgtcgaaatacccccttccaccaattttctaggcttggcttgactccacttacactcccgtagatttcagctatcatccctgcttccctcttgggagttttttttttcctcttgggagtgttatttaggctggggagaacttaatgcagtcatcatgttgattcattttcacaaatacttattaaatgtctgcttttgcacagctctgtggaagggccagagtggtatataatgcatgatctctgacttaaaggaacttgaaagtaacctgtgccctaactttgttaccgacagggaatgattttggaggttctgggagaagcaatctgttaggttggtgcaaatgcaattgctgtttttgtcattaaaagtaatggcaaaaactgcaattacatttgcacaaacctgacactcctgacacctgagagccaactgccaatcattccaggatacactgtgtgcactttgctttctcactgcaatcttctttaagcattcatctatctctcaatttccatctaattgaaactgtggcagcagcattagcagctggtggtggtggaagacctcctgattccagaaatttcccagggtggccccctacagtttggatctgctgaggagcatgtggaaattcaaaggcatgctctcttatggagaacagtttgttggcaaaacattgcccgtttgctgcacatctgtaaactgaagtagacctgtctttctcgacacattaaaaactggtcaaaagcttcactggctaattaggttagtgatatggtttagctgtgtccccacccaaatttcatcttgaactgtagcccccataatccccacatgtcatgggagggacccagtgggaggtaactgaatcacagtggcaggtttttcccgtgctgttgccatgacagtgaataagtctcaccagatctgagggctttataaagggcagttcctctgcatatgccctcttgcctatcgccatgtaagacatggctttgctcctcctttgccttctgccatgattatgaggcctccccagccatgtcgaaatgtgaatctgttaaacttctttttctttataaatcacccagtctcgggtatttcttcacagccgtaggaaaatggactaatacaattagttgcaaaattaggttaatcaccttctcattgaatgtaacttcatcacatatatataaatgatatatagtgtacttcatataaaaatgatttgttatatatacatacacacayatatatatatataatggttwgtgtaccttccctgagaatgtgggcaactggagaactctggccatgggtgcaaaagggcctcccttgctgttccatgatggtgctccctcaggcccctcttcatctctcctctccagcccctcaccctctgcctgggctcaggccctcatcttctttttcttagattacctattccaacagcctccaagcctgtctgctgcaaatccagtctgtttacaacttacatctgaccatgtttctcccctgcctcagagctccctgagactccccattccccagaagagaacatctgagaagccttacaaagtgctgtctgcctcttcaatatcacttctgccaacctgctgccttgcagatgggcaagaagtccctcacacaccccaagctgttgctcagctttgtggctttgcaactgctgtcaccttttgccctctgcctatgcttcatttggttaaccctactcatccgtgaaggctcggccaggggacttccctggctgattgctcccaaaatatgctgtgatggatagcaccatcagtgygcttccatgaggtatcgtaactaactgtgcaatggttctctcctcaccgaggactgtgagatcctagagaacagggaatgggtattagtcatcacatccccaacattaaggacagtgattttgccccccaggggatatctggccatgtctggagactttttggttgtcataactagatgggggtactactaataccaactaagtggaggccagggatgctgttcaacagcctccaatgcacaggacagcctgcataaccaaaagttatctggccccaaaccgtcaatagaaatcttaatctaggacaaagactacaaacttaacgctgcttaatgaatgataaagtgaatatattttactgaatgaaactctgcccttaagtaaggtccacgtgacaattgttggatcatgggaaagaattcaagtaaatgtactccttctttagaacaagtaatggcataagcctagtcttttattgtggatttaagtttggctccagttaacaaggtatttcacgttatcaactgagcaactaggaataatataccgaaggctattctctacatagagtaagaatttctagactaaaataaagtcagaatgtcagaaataaaacaggtgttaaaaatcatccaactygagctactgattttataaatgaacactccaggtcctgcatgataaagtgactccccaaggtcacctagctaggagtgacagggcctggggccagtgaaaagagagcttgtgttatgacttcaccagaaatgaatatgagactactgggtccatctctgggatcctaacagagattaggtcagggctgggggtttgggagaggagaagagagaaatagagatagctgggaggtaggctttgttacatgtcttggtttctttcctgaacagtcggacctttcctcacatctcatggctactgaatttgaggactgcctagtgccaaagtctgtaccttgataccttagatcacacacaattcaaacttttccaccttctggggtctctcactggcaacactattaaaattttgggcaagacgattcttgtttgcaggactgactctttggaatacctggcctttgctcactaaatatctgtggcatctccaggcatgattattagaaaacaagcgaggatattttcaaatgccacctaggagggtggtactgcctcattttcctgtcccttcaattgaggatcaccaaagaccagttggcagggttgcatttgtgttgagcaaactgcatcttggtcagcacaagaaagcaatcagaatgatggatgagaatggtcttaatgaccaccttcaccaaaatgacctgtgttgtctgttaaaaataaaattctcaggccccactctcagggagtaggatgcaagaatatacatttttaatagtctcgccaggtgattctcatgcacactaaaagtttagaacctctgccttagcagtagcactcaaccctggctcatatgagaattaatgtttaaaaatgccattgttcaagccctactgtcagagatcctcagtttcaactacagtgaagccctagccttgcatgttttaaaacctgcctaggtaattctaatattcatctaaagctaagaaacactaccattatgaaatcttgctagttaagaggaaaccacaaattaatcccctcactttcgggttaaatgcaagaaacttaatgttttcaaccttggctgcacccttagtgagatttctaaaatcgcagtgccacaccccatgccattgatatcagaatcttctgaactaggacccagcttcagtgttttttaaagctcccagttgactctaatgtgcagccaagcttgagaaccatggattcagaatattttcctaaattctcccataaacctctgctcttggcttttagctttcctcctatcccctagttcaaaagtttgaggttgtgggggtcagggcaagaataataaagggagaaaggacaagattcaatccaatccagttcttttctccacttaatccctggctaccactgactyggcactctgggagtaaagagcagtggagaaagctctagacctattggtgtatatttccaagaggaagatccttggaccagcatcaagttggctttttatcttgattcttccctgaggtttctaaatattgttccagcataggaatttcagcttttattcttttccaacttttcatttatatggcatgcatgggtcacagaagcaatggaaakttggaaaccattgccttctaattagcagatgtctcagtggctaacattatttgccagtagcagtgccagcgcagcrctgggaaagttaattactgtcgacagtcctcgagcctgttttcataactggtaatgactgttaatatgtcaccactgaagttagagaytcagaaaagtcttttgtcctaggactattaaatgtcatggaagaataacccccaaatttgcctttgggtagataaagttcaatgggactggctgggygcggtggctcacgtctgtaatctcagcactttgggaggccaaggtgggtgggtcacgaggtcaggagttcaagaccagcatggtgaaaccccagctctactaaaaatacaaaaaaattagcggggcacgggggcgcatgtctgtaatcccacctacttgggaggctgaggcaggagaatcgcttgaacccaggaggcagaggttgcagtgagccaagatcgtgccgttgcactccagcctgggcaacagaacaagactccaactcaacaacaacaataaaaaagttcamtgtgacctttttaaaagaaatgttaaatctgaccccagttgctaaaggcagaagaataacacgagatttgagaccaagccagttcctgtttgactattttgaccccatttatagwcatgtcaaatgtcccccatttctgctggctccagccccatcttgttgctgcttccttgagatgtgaggaacaatcattctttcttctgttctaggccaggtcccagatgctgacaataaaactgtctaagtctggagtgttatggctcctagtgttaggttctttcaacacacaccacacacacatgttttatgtaaggtgcatcatttgcaatgggctggtggaccctgatatcgagttgggggtcaccagtacatgttccccttccctaatggtyagtagtcctgccctgccacatggccttagttaggaccagatttgaccatcagatagttaaataaatcagaactgcaaatccatcaagatcctttctccttatgtgagcttatgtctgcaaatagatatgtggtgaggatggggggaagaacacagcctgacaacatacaacaatagcatccatgcctcaaatcaaaaatgccctccagtgggtggatacttgcctgaaaactgcaagccccaaaagaaccactcaaatagttctacccagatttccagacatttcccaagtgaaacagcctcttagaacttaaaatgggaacgtcagagacattaatatctcattcctaccacctaccgcttaatcagtgtgttgctaagccccttacatatgaaatcttwctcagtcttcacacaacccacagagggggacaagatatcaccatccgtacttaacagaggaagaaatgcgctgaagwttacacaattaggacgtgtraggatatgattcagggtgtgtstggattcagaactgcacactgcacctgctgtgctttattgcattagctgctgctgctgctctgacctgggctgacgttgcagtgagtctggagaaaccctttgccatgtttctgtgttttcatcacagtttctgtcactactttcttgaccttatcactcttacagtcctggtcctattctgtctgtgatgggagagacctttgccaaccagcctctctgctcattaattagatctcaaacatggtgtctttgtgttctagtctttctatggtgcccttgtattatgaacataaaagttaagcttccagatctctcacaggtaccccattttctcctccctgtgcttctctgaacttgtttccctaaccacaaacagaacaagttctctagaggttgagtcagaagaatttttgtggtaaagargacattgaaagggggtwggtctactaaatgtcttgtgttagggttctccagagaaacagagaaatatatatatatttctatatatatgtatatatattttttatatgtgtgtgtatatatatatgtgtgtgtgtgtatatatatatatatatggagattgttatgtgaattaactcatgcaattacagaagccaagaagtcccacaatatgccactgcaagctggagacccaggataggtgtcattcmgttagagtcctaaggcctgagaactgtcatgggaagactttggattcagccatgactcaagtgtaccagtggacttttcagttacatgagaaaatgcattgtctttctctttaagcagttgggttcattttctgtcacttggaggtgaaggttcctaaagactacagcattcttcccatggatcattggatggcctcatgcaaaagtgttgcccggacactgtgtgggacagatgaacccaaaagcatttcttccctaatatgcaccccaacacccagaatctcatctatgcatgagaaacagctttgtaaatagtaaactaggtgtcaacataaagtcacattcctataactcagtgtgaattgaccttcttgatatgagagctgagtgaagacagagaatgtatgaggctttgggtacaggttcctgaggcgtgctcaaatgtacgttaagagaaaagactggaatagggaawgagagaaggaattgatggatgttaaaatgaacatattaattttgcctgtgggcatgtttccattaattggcttttggatctgaaccaagaatagcagaattgaaaacctaataaaaaccaaacccatgaagagaagaaaaattttcataatagcccaagtgagagtaatgacgtgagctaatccaatttgaagtataaacaaagaaatttcttcacgcaaagagactgacttattttgtttcagaactaaataccacgmagtagaggttaggtcagggaatctggcctaaatatatgggggggtcagggagatggaggttagtcattccattggaggacagaagaaaaagkaacaagaagttcttttatagtgactgaccataaagttttgaaaaaagaggtattcaaatagcactttaatccacactgcatgttatgagaggctatggggagatgtacaatttaaaagctcactaaaaaatggcaaattaaatttcattttctacttacggttgatagacgtgacttttcaaggtcaggcatattaattggctttcagatattaagcactgtagaaagaggggacatatttaaactttcctttaaaatagtggtttccatcatttttcatgttattatacacaaagaaagtgacaattttacggcactacggtaaatagactaggtcatttgaggcagagattgctggcctgggccaccccaggtccacctaggctccccaaagactgaggaatacctattttgyatacaagtgagctgcatccactagttaagaagccaaatcaaagactgtctatgaggcaaaacatatactgcagccatttgggggaaagaacaaagcactgaactagagggcaaagaccaacattttggttctagstctgccaagtgtaggacattggactaggcacttaactkcagtaagcctcagtctgcttgtgtacaaaacagagtaaaagatttcttgcatttcctactttacaaggtcaacatgaggatcaagaataccatgttcataaacatcatgtacaaccatagagtcctatagaaatgtgtggcctgatgatgacaatgagtatgacatttttcttcctagtcctacctccatttagaccacccttcctttcaagagtcccctgcaatggacaggagttgacaccaaggagaacaatacagctgctaaatctcaagtggctaggagcacagagtgtgggaagctattctgcagctgtgtttttgagttgggccaaagagctagtggggttttggcttcccaagtacctttgttgaaactccctggggaattttgctttatgaaatttccagcaattggagatcccactgggttggtgaatagaagcctaaagggctccctgttggatgaaaaaatgtgtttgaagtctgctgggaagagctgtaggagggagctgagggttcttccatgactcctactgtgcattgacagaagctgtccctaccactgttgattgccaattatttttgtctccagagccaaagaaaatatatttgaatttgacccatctttcactaggatctacagatggtgaaatattaatgaacaggtgggttgcacaatattccaagattgcgttagaattgatttttrtaggctaaattattaacaccagagttgctgacatatattctcatatgattagcaaacccagaagccttaatatcaacacagaatacattcagaaccatcaaacacaacatctactttgctgggaacagaatactaggtaaaggaattgagatctcacacaacactcctctgaaaatagggacagctaattttgtaatggattgccagcaaaagctgtgacaatgcctactctggaagtctctaaatttcttttcaayctgagaagggtgttccatgatatttactggagtaagaagtgatggaggaggtagaatagttctggaagtcaggtctctaaatagaacaaatcttgggatcctccaagtttcagtctatgcatggaattatgtttaaagaggcaatatctagtagctaaataatagctaaaattgttccaatcatgacttgcacctctcaaagatcattattcaagtaatgcttctatcctttcctccagctcagtgtttcctgaacttcccctgcactgatgctcttgcttacctaagcctcttcttcagcctcttctccatccctggacaattcaatgcactgcatggaccttgcttagattctgatttgagcaaaccaacttttcttcttctccttctccttctccttcctcctgcctccttccttcttctttcagatagcatctctctctgttgcccaggctgaatggagtggtgcaatgacaactcactgcagcctcaacctcctgggctcaagtgattctcccacgtcaacctcccccagtagcttgtactacaggcactcaacaccgtgcctggctaatttttgtattttttgtagagacggagtttcaccatgttgcctgggctggtctcaaacttctgagctcaaaagtgatctgcctgcctcggcctcccaaagtgctgggattacaggcatgagccaccacacctggcctcaaaccatcgtcaatgcaacactttgaagacaatgagggaaatctgaatttggatagtgtattagatgataccaataacatattattagttttgataggtgtgattaatggtattgtgtttatgtaagaaaacaccactatttttagcaatcaacacttagatacagaaagctaaaatgacacarttctgggattcggttatcatacatcagccaaaataaaggaggaaggaaggaaaaatgtacagaagtaaaagtaggaaaatactgataattctggaatttaagtgattgatgtttgaagtccagtactatattctctatttttgtgtatggttgaaatttttcctatttcctgggaaaattttccttgaaaaactttttaaagaattttaaaacttcttttcaaaagagaaaaagaaggactggggtggtggatcatgcctgtaatcccaacactttgggaggccaaggcaggcagatcacttgaggccaggagttcgagaccagcctggmcaacatggtgaaaccccatctctattaaaaatgcaaaaattatccaggcaagtttccacacacctgaagtcccagagaatctcttgaacccaggagccggaggttgcaatgagctgagatggcgccactgcactccagcctgggtgacagagcgagaacttgtctcaaaaaaaaaaaaaaaaaaaagggagaaagagaaaagcaaatgcaaatatcttcaaacgtcataagaaaaggcaaaagtgaatccgataaatatattttaaaacaataataaaagaggcattttgytgacagataaattcatgaaacaagactgacttttttgaatgccattcatagaactgccaggtcagctgtgtagtgtgaggtatatttcaatgcaaaatactgaaattataaaaacaggattatgcacacaaatgtttcaagcctttataatttttttaagtccaaatggcataggtccatttataaaatattttctgaatttatattatgatttmaactagcaatatcctattaattaacttatttaaaattcataaggagacaagttatttaaaaaaaaaaacactcttgaactgagtaaaaaatagcacgaagtgaggttcagctctggggagaagggaagttgtgctaaaacttttcaaaatggaatttaacctcagacttttaaagcatcactttctttaaggattcacggctttcctcccacactgtctggtctggggccagtgtctggagtaaagtattgctactcctaaatgagattttagaaagtagcatagtttctgaaaggagcagccactggaaaccaaaaactttctcagggtactcaaacggtttgaagagaactgatayttgaaaacggaaatccttccatttgtgacaacatggacaaacctggagaacattatgctaagtgagataaaccagtcacagcaagacaaatactgcctgatcttttgtatatgtggaatctaaaatagttamtctcctagaagcagagagtagaatggtggttgtcagggctggggtatacaggaaatgaggagatgttggtcaaagggtacaaagcttcagccatgcaagaggagttagttctggagacctaatatacagcatagtaacgacagttaacaataccgtattgtagacttgaaatttgctacargggtagatcttaagtgttctcaccacaaaagaaaagaggcagctatgtgaggtgatgggtaagtcaactagtttgattgtggtgatcattttccaatgtatacatatatcaaaacatcaagtcatataccttaaatacatgcaatttctatttgtcagttatgccccaataaagctgaaatttttttttttaaatgagaactgatgtttgcatccagttgctgctaaaggcacaaattttctttaaaaactattgaatgattttccagctcttacagacatactgggaagaaaaaagttaaaaactatttgagaaatttggattgaactacctcatcctgtatgaggtaaggccaatgtgcaatcttgcattgctaatcactcaagcagagtgctcagaagctgggaaacaggctgcggttaagaacattgcttaaggaagaataattagatcctttccgtgtctcatagccacaatttttttccagctttggctgttgtttgagcaagaccttgtgtatcaaacattgatctagccaagtggcttagtggagaatttgctcaaattggttttttagtatcttgttggcaggaggggaaatgactgcttgaacgtttcagccttaatgctgacatgtggtgacttgaagccaggtgaatgaaggttcctccagctagagaggtaagatgaacatgcmggaccaggaagaaagcaggtcatcatgttagacaggtgcaattatgtgcagagactataaaagaagagaaaaagacatttagtcatcagagagcagccattcaagtaagaccttgaaggaaagggagggtgaatcaaacagaaaatataatgtaagcaaacgcacagaggctatactgtggagaggatgtggggaagagggaagtggtccatttgactggaacagagggtaaatttaaggcagtaggaggtcataagacttatggaaaatttggaatgccaaaatgggactgttatgtgttaggttgatactgggtgggggcactgaggatttttaaaacgtgatcagggctgccttgttgaaggtaaacctagcggtggtaagtcaaatgaaawggagtcatgagagaacaggtggtactaatcactaccagtactgagtgctttgcagatgctacttcatatacataatctgatttaattctgatagcaagaaccgttattagcccactttacagatgataaaattgaggcttagggtgattaaacaacttgctcaaattcacacagctaaagcagaagaggcagtgttttaatctagacacaggtacctgcccttaatcactatgcttgacagcttcttaagctagaatgggtggtaggtgacyggggtctgaattaggaatttggaggtagtaatggaaaagagggatcaaattcttagaggtaggataggcaagacttcaccaacaggagcctacggaggtctgtgatttggtggctgcgtgaaaaagaagaatgatactgttactaacctaaataaagaaaccagaagaaagacttggcatcgattaaaagattattaatatggttttagttatattgactttgaaatgccatgagtagatccagtgaaaatgtccatccagccatcggaaatgtagtttggttgctaaagaggggagatggagctagaaagagaagctgaggcatcacgtgcaagcaatagaggggcaaatacgcaagggagggtggcagaagaaaatcatcccaggtgtttcttttcttcttactcagctcggaatagagatgacttctgagtttttatctactcccattcaggaatgaaatggagaaatgtaggtcaaaattttacaaaatggtcatgtagaataattctctgacttcccatctctgggaggaagagaggcagctttagtagaagtgtgaagattctaagcaaaatttaagtaaaattattaatttttttagagatggagtcttgctatgttccccgggctgaattcaaactctgggctcatgagatcctctcacctcagccaagtatctggaactgcaggtgtgcctcaccactcctggctgtctaactaaaattatgaagggcaacccattatctctttactttctcttgccccagaataagacaagaatgccgaggcctggtcagtatcccagggtaccaccgccagtgctggccagagcaggctctgagaggctaacrcaggccacagagcctagggccttgttttggagggtgaggtgaggcttaaagctggtaggataggcgccctctgagattcgccatctgagaagtcagtcagttctttattaaaccattctaaacaacagaaagtgcagtgggtgggcaagattccactgctgaattcttcagcaggccctgcaaatgaatgacatggtgtcaatgggagggaaagtgaagcaataaacacagatggtgtttgtgcaatctcatctgggtcaaggaaatcacctcatcactcttctttgatgggcagattcctatctcttagtttaccattttccttactaattccctcagctccatccaatgtgcattcttgtgtcaaattgcatgttcatgagtatattacatgttcctgttgtgagtatgcaggggttaccatgggatgacccctgtgctatgaacttggaacctcaagaaattagattgccttttaagaatgaatcagagaagaaatacaggaaaccactttaaataacaaatgtgttcctaggatagcaagatttgactggaccctgactgacgagattactatacctaaagaaagaacgcattcgtgagaaggagagttctgctcagttatgaacaaagcaactgcattcaataaatatttgttgagtacctactgtgttccagcagagagctcrcattctagctggggagacagaaaacaaataagtgcatttataattggatgtctgcttgtgatatgtgtgtatcccaggcagagggtccacagaacaaacarcagcatctagtgtggctcggagatgtgctcactcaagttctatgccagatttgagaagcctgcttgactctaacatcccaaatctgcatttccagcacttgggtgacattttgacctacctaatagctctcgggttgatttctcctgtgtgactttcatgaagacatacatagaggaaaaaaagcacatatcaaaagtactcaggtcaatgaattttccaaagtgagcacacctatgtagccagcaccccaaatccctccttatagccccttttaccacccytaccactgaaatgtaaccactatccygagaccagcaccataggtttgttttgcctttttctgaactttatatagatggaaatatacagttcatactcaatacatgctgcatagattctttgattcaatattacatctgtgggatatattcatgttgttgtttgtattggtgttttgttcttttttcattgtcagatttcatggtatcactacatcacagtgtattttatttaaatggacatcagggttatttccactatgccactattcttttaacaaactatttttctgcaggaatctgttagaagtggcttctgatgtttgcaactaagaatcctgcctgatccacatttgttttaattctaaatttgtattgggttacctaggttttgtattgattaagaaatcaagtgaaaatttcggggtttttgtagaaattcttctttttaaactacgcttttgaagacatagacatatttttcatgagctatttgccaacgaagatctgcttactctgtttcaacagtgaagcctaatgataaaaaataacattccatgtagataaaagctgtgacttcccagcttaaatacagcactttctggaactacagctataacttgtgttctcttaggttgctaaacaagttggttaggagcttttctcctcagggttcaaccacatgactgcttctgggcagttcgagtggttttcatcctcattgcacaatagcagaggttttgaggttgtgtttttctccacattgcccatttccctggcggccactctcaggagctgtgaagagctcaatttaaagacagtcatatcagttattcatcaattactgggatcttttcattttttaagcatatcatatcaacaccccttttgtaggactatagcctgtctgagcggggctgtaggagagaagggtatacctctctgtcattacatcattttcttctttgtccgggccatatcaattgccaatgcctcattcaaggcctgacttttgagcaatgagatggaccagccagcagtcattcctctcagtgactcaaggagactgacatttgtaataacaaggagttactgagcacttggtatgtatgccaagattcttagtatggacaccagggatctgcagagcaagcatgtccatttcattaaaaccaatctctccactcgtgctctggataccatccccttgtccttcccaaagactttcctcctgcaataaacccttctctccctaacatgatcaatttctctctccctcctggatcatttccatgagaaggcagatgtgttctggtgcctactttccaaaaaaaaacattctctcacatcattgctccctccagacacaatcctatttctcaactctttcacagcatgccttcctgcaaagaattgtctgtagtcactgctccacttcctcacctccttttcttagctcagccaactctggttaacttccttctctccatgcccctgaatctgttcatttcaaggtcatgaataacctcttttgccaaacgcagtggccaccactgtgtcttcatcttattcaactttcgaaaatatttgacatagttgatcacttcctcattcttaaagctgtctcctctcccagtttccatgacaccactttctccccttttcctctgacctcactggctgcattgtctcaggcctttttgctcgtttctctttctctgatctctcctggaatgactccaggctctgtcccagatcttcttgtactgtccatctataagctctttgtaagtgagctcattcagtctcatgtctctaaataccatctacataccgatggctctcaaaattaaaatttctgatcttgatttatctgacctatcccctaaggtcaagttcttatatcctactgacttctctatatcactacatgggtgtctaagaagtttctcaaatgtagtatagacaaaggtcttggtttcccaatgtccatctttgcctctctctgttctccctagtaaacagcagcaattttcacccattgaaggcaaacatttagaagtcatccttaagttctctctccctcactttcccaaacgaatcatcggcaagtcccgttggcaacagtttcatgtcaagagttaattttaagaatcttttattcaatttaaactgacaatttttaaaagtttggaaagtgggagagaaaacacccatgttttctcataatcttcataattatcattttaatagcacatgctgtatcattgagtagacatatcctaatttactttacagtccccctaatgttgtatctttggagtcttctcacattttatttctataaacaattttcaatgaatgtctgcatgcctatatagatgttttatttttstttttaaagtagagaagctgatttttgctgttgtttttgttgctgtataaaagatcactgagtgattgccttagttatgcaacaatagagaaataagtgtctattattctggtgttcaggtaaagtagaattctatcaaaattgtcacaaaattgtctttgatgagagccatcatagtgcaaagttgatgactaaaaggagatggttaagttgtytaaagagcaaggccataggagagaagaaactaatattcaaagcttcctcccacagttcaaagttagagaaacctgagaggggtgtactggtatgaccacccgagatcccatcgctgagaaagataatggccctggagacaaagactgatgaagaaagacagtatccagctgtgatgcagatgaaacatgcggcatggttgcactcactatgcagccaaggctggaagccactctggatccagccactctggcacagcgttcttgctctaggaagaacaactgaacatggccacacaggcctcacagctggcatatggaggctgttaataagctgagcttgaggcttcaaaggactcttgtagcctgtgctggatctagcagtgaccagtatgccagtggccatggatgcccaggcccatgttcagtagtgaagcaggtgctagcagcagaagcaatagaaatggaaactgggagatctgctgtggatgaatctcattatcttctttctctgaccctctttggactaaataaactcccagtattcttgaccaacagaggtagggttggaacagaacctcaaaagtcatcatyagacttcctactaatagggcattggaagttcaagcgactaactaggaaacaggttagtatttgtacccctacactgtgcaacagattacataccatttgctctatttggcatcctttccttaggctagattcccagaagaaagattactgattcgaagggcatgaacatttttatgactcttggcctaaattactaggccaaggttttttcaaagggatgcactaattttcactatttccccacaccctttcaggtgataaataattgacttgatttgtttacactgacgccaagaattcttgggaagaaggatcaaagtgaaaagtggtagcccatggtggggaggccacactcagtgcagttgtgaagtcagcagcatttttaagcccattcattgccagtagccctgagatgagcattcccaagctgcttcccaggtccctcctccactctctcagggacatccattctgtaccagccccctcagatactcatgcccttgccctcccttctccatgctcattaaaaccagcttaagagcagatatgacatcagtcacttaccttttcgtgtggctctaaatcaaagtgtcacctctcccaagcacatgcttgcatcttagctctgattgaggaatgaaaagctttgttctctgttaaaagaactttgagcttagatgccccagactgagaaatccaccaaaagctggacctttgacttgagcggcaaaggacccccatagtcaggctgtgatttgaggagcatcaagaggccagagtttccaagttgggacccagaaggtggggttggcagggggagggtaggagcagctggagactctgctctaccaggggaatacggaggtggggaccaatcccagggtaaggaatgaaagtaggagccccagaagctgaaaacatacttcaccgatgtcagcattttacccagagccattccaaggtgaccataactcacttaaaagcctgaaagctgttttatgccaactaataaagtgcagtttaataaaaaagttgtcaatcatttttatataaaatgtatttggggcatgaatggttttgatcttttataaagtcaaaagcttttagtgctgctcatggttataatcactgcgtgagcctgggcaagcctcacaaccttgctggccttgactttcttatttatgagctatagacaattacacccagcctgctgcctggagggctggkgagagtggtgaattgagtgttcaagttgaaagtaagaggtggtcttcagcggttgactccaagcattacttatgatcaaggtctaatttctaagagtccaaaattaaataacaggtagaattgaatgccttgagcttgtctagtgatatggaagtgtagctaatagcctacagcctaaccgtgtaagatacaactggaatataatacaaaccccatggagagtaaaggacaaagagaaattaaagtaagaggcaggaaataataaaacgatatttaatttggacatgtgcccccaacgcatctgtagaaaaatcaacaaagcataaataccaatgggaaaacctagccataattactctaaaagatatagagacaggaaattggataggagtttgcagtgttgttttgggctgcagggatgcccctgtgtgcctgcaaagggaaatgagagtttatctctgaataatcagatggaattgtacatcaaataagggtaaaattggtcatagtcatctcatgattgcagtggtttctatgttctccaggtcagtccaccatcattgaggagacgtgggtgcggagaaaggggtcaggtatgtggtcagacatctctgtgggatctctgctgctaactagctatgccacattaagtatgttttaacttgtctgaccctccagtttagctcaacaaaatagaagaaaatctccctttcaaggctgttggaaggactacagatgaaaagtatataaagttcccagcagatggaaaatatcaaataaatgtcagctagtagcagcagcaggagcaaagatgaaggccgactcctgagttttcagactccacagatcccagaatccttctctgctctgagttctgagtcccacagttctgatgcatccacctgtgcacctcaccggcaatcagtgggagcctgggaatggttaactaagaggggcttgagaaggcaatgagagaggagcacaaggaggtaaccagccactccactgaagctgtgtttaggtggtggatatgatctgccagcggcccctcagccaaaaccaccaatacaaatccaygtagacagtttcttaaacaaacttagtaaaatcaaatctagaatatctccccctttcaaacaatgcattttcccagtgccaaagtacagcactttcttagcatcttccttctacaaatgatggcgcgatgcagtttaaacacataccttgccaattctttttaaaatgtaggcttatatgataattttaatcacatgctttcccaattattacatgtgtatgtttatatggtaatgttaaccacatgctttgctacatgcttgctgtgagtgatgttttattttatttttagagacagggtctcaatctgtcacccaggctggagtgcaatggtgatcatagctcactgcagcctcgaattcctgggctcaagtgaccctcccacctcagcctcccaagtagctggggctccaggtgcacaaccacatgttgctgatttttaaattttttgtagggatggggggtctcactgtgttccccaggttggtcttgaactcctggcctcaaacggtcctcccaacttgacctcccaaagcactgggattacaggcccgagaaccacacacagcctgctgtgagtgattttaagagaagctgttagagattggggccctagcatctcattraatcactggttgacaccaccacagcctcccagctctcaagcaattcctaggaaaacaggaattcatcgggaaaatattcttgatcctgataccaaaattaacaaagggggctgcttcttgtgttgtattctcaacagcagaaatgacagttgtgcccatcaaaacccccagagaccctgaccagcagggaagagcagtagcaaggagataggagagaagggtggtataaagagtttaccttctttatttttctctgtccacagttcctttaygcggaaagctatttacagcagccacagtctctgtttggtttggcatgacactgactttctatggataagtcaggatctcatgtcctcatctaaaaatggtaccatattgaatgacgctttaccttcatttctctcacttcactggttttggatgagcataggggcacctttgggtcagagtacttttcagagagggacagtcaataaaaagccttcgtgtataactagtccattttcatgctgccgataaagacatacctgaaactgggtaatttayaaagaaaaagaggtttaatggactcacagttccacatggcaggggaagcctcacaatcatggtggaaggtgaatggcacgtcttacatggcggctgagaagacagaataagagccaagtgaaaggggttttgccttataaaaccatcagatctcatgagacttattcactaccatgagaacagtatgggaaaactgtccccatgattcacctatctcccaccaggtccctcccacaacacgtggaaattaagggagctacaattcaagatgagatttgggtggggacacagccaaaccgtatcagtgtgcccagagagagagtgggtaagaggaatagaccaaaacttgaactatgagaaagagaagtaagacggtagggaagactgtagttcagaatctgtaagttataactgacttctcacagcctggcaaaaaattggaagctggagtataggacataaattcatgagcagtagcaattttagccaagtcgagagaaaagcattgaacttcaaatgaaaataatgttcaaagaggtgaacatgaagttcattcaagatgtggagggaattatgagcagggagatgcatgccaagagaaactagatggtatttgaaaaaagtgagattcaaattaaggttcacacacagagagagagaaagagggataaaacaaaaatattttaatggtttccttttcctgtggtctgctttagaattcacccaaaagccaattgtttctgtggttattcaaattttgtttctcttctcactccctcctcttgtctatcctctgatcsccagcatttggacagaataagagagaggaagtaaaactcaaatcattttactttactttttcttggccatttggctaagagatgtgtggggtgaagaggtgcttgtggccaaagtgtgatttgtaaaatgtgtgggtattttttgtttggttggttttgcttttagctgctatacttatgttaccccagtttaccacatccagtcctctttgggcacaaagggaaagactcaacaaacatttgttgagtggcttgactcagctttgctccttctcctgagtattcctccgtggagttttagcaacttcccataggaaatccaggctaaggtctgattcatccagtcctgaataatgtgttaatcatgaattggatamaaatcatgaattggatactactcaagaggataagctgttttcaaacatcttagcagtaaatatttgcaaaccaacaagaaacacactaaatacaaatggcgtttctcaattcattagagcaagcctgcaagaaccttgacctgggagtagtgaggccactttctcagcsactagttcatgccattatatatacataccagttttaacaatacattatttttataattttcaatgtttgagattattcatgaacctgaactgcccttcaacctgtaaatctgaataagtgaggttttactatgatttacaaaaccataaaacaagrcagaaagaggtctgttcatctaatagtggctgtttgtttctcctttcctttttggagaggagggaaaaaaagagcaaatgtctatctagcaagatgacgtagggctggataaaaagataaatgcctctgaggtgtgtagggatattacaaatgtgatttggaagaaagacaagatctgagggggtgggaagttcagtgtagaaagtctcttctatcaggacatggattctaattctctcctaccacactgggcataaccatcagggaatttaaagtcccttccatgccaggcatgccccatcacctaggaagaaactcaacccatcagcaggcatccaaaaaggcgtcagccaggtagggtcccaaagagccccacacctygggttatctgggaaaatcccaagttatttagaagacagtgtacctcttgcctctacccttggtggtaaacattgcttcagagtcacacacacacaaaaagataagcttttttctcaattgaaaactggaaagttgaaagaggaagtaaagagaaaaagaaagacatatactatawtccaggagtcccacatgttcagaaactcttcacctgtgaatctacattttactgagttcacatctgccttctgaagggtaaccactctttaccccccaaattcaactcattacttgttcaactttgaccaagaggtttttttttttttttttttttttgagatagtctcgctctgttgccaggctggagtgcagtggcgcgatctcagctcactataagctctacctcctgggttcacgccattctcctgcctcagtctcctgagtagctgggactacaggcgcccaccaccacgcctggctaatttttttgtatttttagtagagatggggtttcaccgtgttaggcaggatgatctcgatctcctgacttcatgatccacctgctttggcctcccaaagtgctgggattacaggcatgagccaccgtgcccagccgaccaagagatatttttaagaaaagtctcataaaagcataaaattttatatatggcaaaagcaatcaacatctatagaaaactgataaacacatatgactcagaggaagaaatttccctctatgtattatttactgttaaacttactatggcttataaggccttgatcatctaaacacttgtttcgatttatccattctcttcctctcctcttcagccttcttgagattgtgggtcatctccagggatacttctccacagttctactatcagtgtctaagggattcaggttagggcaacacacacaaaaagtcaaattcagttattcaagcaccaattagataatgaacatctgcctggggtactcacgacattctgggctaaatattcccccagagagaagaataagggagtactcagtgggtactaatgtctggtctgtgacatgacaatgaagtgaagattaagttccatctttacccccattcaccatttatctcccaatctctcttcccaagtcattcttttttttttttttaattatactttaagttttagggtcattcttatcttcttctcatctcttacctgttttytcctgaccctaattcctcaaagaagcttaattcacttctagatcccctccttcccccatgaatataaagaaaataactatatctagttcttttagatgttcaaattgacttgattgctagctgaaatcaaaattgaccagctgaagtggttttcaagaatgttaattcttattctgaccactggattagcacaatgggccattgtacacataagtacacccacaaggcagtcagtaaaatagacaatgcctaaagctgtagatacactatatacatggcatgaatcttttattcatttgtttagtctacagcaggaagccaactgcctcacttcaggccagagggagaatgctgagatattgtacgaatacatgcaattttccaagcttcaggaaatttgaactgaaacattgacaggaaagagcccatagtacacttgcatgttgagctggtgtttaaactctttttcccatgtaatgagctcatatccaaaatgttgactcaacgtgcatgaggacttggcaagtcctgtggggaggagcgccctgtcacgggaaacaggagaaaaacaaggccggctcagcacattctctcagagcacacaggccttcatgggccagagtttctgttattaaaaataagaaaagaaaaaaaacagagaatgtctcctcttaatccagcaataactccaagaagataataagtcaacagtcacttttttcatggctacctactacagagtgtcctagtaaaatatatacttgatacattaatatacgctttaaaaagaayagcagttagacattaaccaatatcygttttggttatgttaaagtcacaaatgtttaaaatgcccatcgtttcacagtcaaccacatataagatatatcttgctttattaagtgtatttaacacctaaaagtgccacacactttccagggcacactcatctgagggagtttgtagaagatgcagtgctcatggggccctaggttgttagctctgaggctgccatgcttcattcaccaacatgtattcccttacaacttgggcccagcaacaacagatttactatataagcctccagtacttcctgaaaaagtcctttccaaataccctcaaaaacaaacaaacaaacaaaaacagtcctctttctgtgtttcaatcaaggctataaaagtaacccatgttaaaaagccaggatggctgcaatgaatggagcacacagaaggcctcctgagcagtatagactttatttttccatcgtggggctcctgtaatttttaaaagtctgtttgaagatattaatttggcaggaatgaggaagatggattcaagggattaggaactgtagggagatgtagcaagtggatgaaggcctggacatgaataatgttcacaagaatgggaaggagggaaagattaaaagggatatttagaaagaagaactgacaagccttggtaacggagcagatataggagataatgaggagagaggagttggagttggagttggtgaggagagatggagttggagttggatacagygacaacttcgaagtttctatccagaggctgggagtgtgatgggccattgacagaaatggcaaacggagagctggtttgcaatggatcaagatgagggttgaactcagagattcttaaatctaaaacatctcagaaggcaccaagcccaattttatacttcctttctgtatattagagactgaggcccacagaggagaggataaagacccgttgaaggtcttagttagttggcatggagcagacactagtacccagtctttggtctcttgtttctatgcctatgatcattattcaatggtcctgtgcctaagctagaaatcttttgattgcgagtgatggagaacccaacccaatttgacttgaataagtaaaggaatttattggctcttacaagtgtaaagtccagaggtttcagttgaggcatggtccaacagctcaacaktttcactgagcacctagtttccttttgtctaatctctgcccaatattgttcatagttccaagatgttcaccaagaggtccctgagctgtgtgctttctcatttacatccagcaggaaagaaagaaggtttttgttctagaattccaagcaaaagtcctgggattcactctaattggatttgcttggtcatatgtccacccatggccaaccacatggctggggagccaaatgtgctggtctgggtcacatgttccacccctggagccccaggtagaatcagattccatagagccaaatggattcccaaactccaatgagggctgctaggaagaaaataacagaagctacagcatcaaccaacaaatgtctattacacattgtttggctaaatctccttctgttttttccatagcaagtttatgacttttatttttattttattttattttgaggtggagtctcgctctgtcacccaggctggagtgtagtggcacgatcttggctcactgcaagctccgcctcctgggttcacgccattctcctgcctcagcctcctgagtagctgggactactggtgcccgccaccacacccggccaattttttgtatttttagtagagatggggtttcaccatgttagccaggatggtctcgatctcctgatctcgtgatccgcctgcctcggcctcccaaagtgctgggattacaggcgtgagacaccgcacccggcctatgacttttattgttagatacaatgatgaagtggtttgtccacaagttttaaaaatatacagaaatcagaattgccatactcaccatggaaaaaagggagcacagctttaacaagaacattttaaagagaaagaaaagtaattagggtgaataaattcaaattttagacaaagtcagtcatggtgacatgtgcctgtagtcccagccagctacttgggaggccaaggtgggaggatccctggagcctaagagtttgagtccagcctgggcaacatgggaagaccttgtctcttaaaaaaaagaaaaaaagaaaagaaaaaattggtaaatgcagccaagtctttgtcactaaaatatattctaggcaacattcttcaaagccaagcaaagtctgtggctgctgtgtgctggggctatttcctctcaattcaatcatgggttggggtgatggttaataaccctgaaatttaaggtcttttgtcagtctggcatcaatgatgagtggtgtgacaaggcttggtgtatcactgataattgcttagaaatgactccacactacccagttttttggtgtatttttcagcagtattgcataagaaagtctttagcagccactggtacatgcttctgagaagcatttgaccacagaatatcttagattcaaaacacattgctttgtgggaagaaaggcaccacccagcacacacacccatcctaattttgaatggacttaatttctgaattctagacactgcctcacaatgatataaaaacaacaagagcctcattaaaaccccagaggctgagcccacaaacaggaattcatagagtctctaagagaaagatatctgggcaacatttctaaattttgagctgtctggctggttgagacagatgatctgatggcaagaatgatttgcaaaaaattcaacactgaccaatcagagcagacagtctaaataaacaycgattcttacaaggctaccttccttaccagttaaatatcagtcctgcctcagagaaacataagatctaaagaggaaaatctacacaagattgtgtgtgggccagaaaggccgccgtgaatggtgagaaggtgagtcaatccatccatcctaagtcaaagaatccaaccagttccatggaggaggcacagaggaaaagaggaaggaacaaagtggaagaagaagagaatgaagaggtgggaagagatgggcaaggatgggagagcagaagccaatcaagagaagaaggaaaagcaaacagaagagagtagaaaggaatgggggccagaaacaagcaggaatcatgaagagtggggaaaggagagactttggaaattcaaacaagtagaggagtgaaaaaaatagtgatgaaaggtaagaaaggtaaggtaggagatgtgtgaaattgcaataagaaaaatggcagtgtttatgcgtgatcattgagtcttacttgcattacacttgcattacacttacactgtgtaatgcagggctcagaaaactttttctctaaccagtcacatggtaaatagtttaagttttgtgggtggtgcagtctttgctcagctactcagctctggtggtgtagcatgaagacagccatagacaataagtaaacaagtgggtgtggctgtgttccaggaagactacgaataccagtgatgggtcagacttggcccatgggtcatagtttgctgaatcctggtataatataaatcttctgcagacaaaagtgcttcttacatttttggcacccacaacacctagatacacaataccaggtatgttacaactgcatggaaaagccactttataggccaaatggcagcaattttcaatggctttttttttttttttataacttttgacctacaaaatgtcagtttcctgtgatgccaccctacctgctactagactggccatctgatccccactggagaagccacaatcatagggaaggaatattccatttggggacagataaagtcaatgaaaagatagatgttctcagtacagcccaggccagcatgrgcaaaggtggatacttaatgtctagtcagcttgcatgccatgacaaaataccacagactggggacttaaacaacagaagctgattttttcatagttctggaggctggacacaagatgagggtgccagcatggtcaggttctggtgaagtctctcctcctggcttcagacagctgccttctcattaagtcccatatggccttttcctctctctcttcctcttcttataaagccattcatcccatcatgaggaccctaatttcatgccctaatctaaccctaattacctcccaataaatttcatctccaaataccctcacactggggattagggcttcaacatataagcttggggagggggagatacaaatattcagtccataacccttaagaaaggcctttcattgattttcatcttaaacaaaaatattcttacctgttttttctggaaacgaataaccagcctgtatgacactccttgggctccacctctcacctggatatattacaacactgtgcataggagagattcaccagatagctgatagagaactttacattcagtacttaaagctttcctattgtgagrgagaactccatccagcataggaaatagctccacagagtttttatctgagccacatactgcctcagagatcagaacccaagcaaaaactctgcttctttaattcatacsctcccttatttcctcaccttgggctcttcaaatgcccccagcttgactgtggagctggcttcctctccaaccatcattaatttcccagaggggcctgtggtacttgggaatagcttcggtgatgagaggcaacaaggtctagccaagcacagctctcyaggtcttgaaacatccttaaggcctaagcctagtatcatagacacgggcttgttctaaccccaaactcagacctctaacaatgacctcacttccacttgcttcttttgtgatttagaagagcaccttgcagcctctgaaatgcgcagttcttgcttggtgaagggttcctgttttaggaagccagcactactatttcattgcctctaaggcacaatgcagggcatttgaggttgattttgtggtcggtttgtttcctttattttcatttgttacccagcaccatgcccatatttccaagtttgtcttggctcctgatttcagtcattctttgggcaccaatggctttcccaagtcatttaccagggtagcacaagatgccttacaaattaccagagtaaagtaatggccccaacaggtatgcttttgaggccacatgaggagatacacagctgcaggattccctatcagcaaagactgaatgatgtcaaacgttcagaaaaggagaaactaagtgggtgyagcacaatcaatcactttgcatttcaasgtgaacttgcagctcttatggggagggaattctctatgtcattttccacgtaaataaagtaatgagaccactttgttgtagcaaagaaattcagtttgtttctagaagcagatgtgtgtgcatgggtgagtgggcatgtgcatatttgcttwaaaacattttccartaactgctgacaacagcaacctgaagcctccaggcacccagtttctccccatcctgagatgatctttttgctcctggagcagcattgacgtgttccataggatcatccctgtcctcactggcctggcctcttcagtgacctgaaatctgcatttcctgacccttcttcctgggcctcttcttctcagtttctctactcttgtcacacaaagttactcaacacccagtaggagcttatcagagccacagcaccacgttccaagggcaaagaaggagaaagagctccacatttacatcccagccttggatttaagcctagagatcttccytcctctaccctcccacccccatcacttccccttccagcacccatcattgctccccctggttgaacctcgtccttgtgaggtccaagtgaaaatttcccctttgycctctgaaggtttactgaaaatcacagacaagaggtagattaataggagaaaaggcatgcaatttattgttaatgtgtacacgagagccttcagaatgaagacccaaagatgcaaagaaattgtccatgttcaacaaagtatgatagcttaggttcaattaagtatggacagccatgtagaaatatgattcgacaaaaaggctataatctaacgctaatagactgagtggggatccagcaaggcctgtctgcctaggttcctcttggcctctgttcagcattccttccttctggttatgggcaggaccctcactggaatgggggtcttatgacctacagtcaaacaaagtaggccagataatttctttgtggccagtttttacgcagaaaggcaggggaatgtcagagtaatatttttaggttttatggctggctttggagaaagggggtcctggtttctatgactcacctcgaagattctagtttccatggctagcctaggtggagactgggactgagacaggagggcaggataaggtcagggcaaaacttgtgcttcctttggggcactgctttctaagtccaaacactgttttctgcagcccactgctcaccattttccttcatgaggaggagaaagtctcagtttactaaacttttctagcctctgttcctgcctctataaatggtgataatacagttgtgctgtgtgctcgcccggggctatggtgaggaatcaatgaggaaatatacaaaagagccctagcacagaacctgattcatcactgatgctcggtgagtgttcattatacacccccaacacctctactaaccaygttgactgtgactaaagtaaatgtagattggcaagtcacactctggaataaagcttcccaaccctgacgcctgacacaatcacctgggagctttaaaaagcaccatgcctggccgccacaatcatctcttgccctgaaatatcctgagggtttggcctcccttgttccttgttttgatattaggcaacattcctaggccaccagagcagctatttgattttctttttcttgtccttctctttctcccttttccactaagttttggggataatctgttgcactgcaatagatacctaatatagtcctcttttcaccacgtggcattctgatgtccctgactttcatagctatttcatttttgcatgacttttctttcccagaaataaagtgttcattaaatttgcatgtcctgatgcattcatgcattattctttaattttgatatattggcctgatctgttagccttcttaaaaatgaatgtggccaggcatggtggctcacgcctgtaatccctacactttgggaggccaaggcgggcagattacctgaggtcaggagattgagaccagcctgaccaacgtggtgaaaccccatctctaccaaaaatacaaaaattaactgggcatgatggcaggtgcctgtaatcccagctactcgggaggctgaggcaggagaatcacttgaacccgggaggtggaggtttcagtgagtcaagatggcgccactgcactccagcctgggtgacagagtaagactctgtctcggaaaaaaaaaaaaaaaaaagaacactttctttagtagtagttgcttctcattagtggagccatgttgagatttcatctcttaagaaatgaaagatgacctccctccttagaatactgaataattcatcagggcggggtacaactgtggagctctcctgctactcctgatctcttgagccccattcctttctaattattaaatggcacaatgccgaggaatccctcctgctcctgaaacagacttctccaggggcgtcatggctgactctyaggtccctcagtttattctctcctgcttgtgcagaacgaaacaaatacaaatcaatattttaaaacagacatatacttaatattttttaaaagccagaatatctacgtatactaatttgcttgtctgttatattcacctctttttgtatgatagctatgtttttatacacttatctcattagagtattataccaaactcatagcctttcacaaaaacaacttgcattaatgaagccgtgattgccttttatttgatgttcacattttcacagtggggctagcaaaaactcctttaagtactgcctctgatattctcgaacactcctttttttcagtccacaacaaaaagatgttccaagccatcctcgctttttttttccctaagactgcaattaactaacttccamgaaaatttgattgctttgagaaaagaatagcatcagaaatcacaattcaagcttctcacctgtgcatcagcagtgaagagaaatgctggtcctttcactaccgccacttagggcctattttgtgacagagccagtaaagatgtttttcagagtgaggaattcctactgattttccttacagaatgtattatgttgctatatattgttttagtcagccagggtctcttaagaaaaatagagtgagtattactagaaaatctaaatgtgggtagatttccagtcaagcagctaggcagaggcgtccagagactccccgtgctcagcatagcgttgtgcagccttgcagggggatgccttgggagaagggagcagtagcagggctcacagctggctccgtggcactgcctgtggatctgcattgccttctgttaggattaatgctttgtctccagtttattttttttcttttttttgagacagagtttcgctcttgttgcccaggctagagtgcaatggcgcgatctccactcaccgcaacctcccgagtagctgggattacaggcatgtgccaccacacccagctaattttgtgtttttagtagagatggggtttctccatgttggacaggctggtcttgaactcccgaccttaggtgatctgcccaccttggccttccaaagtgctgggagtataggcgtgagccaccgtcttagtctccaaatttgttactggactccgagcaaccctgatgcactgctgtagagtgccaatctcccagtttgctcaagactgaggggttttccaggatccagaattttccattttcaagctgggattgtcctgggccgactagaatgagatggtcaccaggtcaccagtgagctagtagcagaaccactcaaggagctcatcacctcctgcacagagcaggaaagagacactctgccctctgctcagcagaataccagaggacagaataaaaatatatttgggacttactcagaatcaatgggaacttaagagtcccgctgcagtgcagacagattcagattcttcagtgcatagggccaaggtaattacaggcaaagctaaaagaggttgtggtaaacatatagctgtgaacaatcgtcttattaacaaagtcctggtctagctgtaaagcctggttttccttccctrtctcagagagctctgtggaaggtagttggtagatctgaaagtccacaagcagattctccaggtgcaaggagaagtgtacagaggaaagcctttgtaaatccacactcagaaactgggcctcacattagaggtcaagtttaggtgggagtgtattcacaagtaccctcatgcatattggttttactattctacactcagagccttggctacccaagagccaaatgtgtccatgaactctgggaagatcctgcgaaggccagacaattcctggggcattctgtgaagctaggaagccagagttggaagggtcccactctgcctcagccctcacatgacctggtccaacaytgccttacagatgaggaaaactgaggcctagagaggtaaagagacttacctaaaaggcatggttggccactgttaaagttgggatttaaaacccaaatttcccaactctctgcactaaataaattctgcaatgctgcttccattgcaatgagagtttgaatactgagtgtgagctacttttctgggcttctaatttctgagaacaaagtttagcagaggaagagaatcgtgaaataatttagttcatttcatggggcaccaatagcattcaaatactttcagtcgaggtcatgttcatccacagcacagccttgaccttagcaagagcagcaggcagattgagtggattcaattccaagattgtctcctattttgtctctttaggcttaaatgctttagcaccatttcaagggagaaaattcacatcacagaggacaaaaaaagctgtcattctttctaaacactaaacttattgtcatcttaaggtcttgactgttggtgttccttctgcttatttacattcacatggcttcttcyttgtccttggtcaagtctcaactcaaatatgattccctccaaaaagcctttccttgttaccccaattatagcagtttataatcagccccaatcttaactcatctgtagtgaattaaataacatctcccaaaaattcacctccaccaaagcctcagaatgtgacctgatttggaaatgccatctttgcagacatgattaaggtaaggattggaataagataatcctgcattagggtgggccccagatccaatgagactgtccttaaagtcctccacagcctaactccaggctacctcgccagtgtggattgtctacactgmctgcctgctcctggaaaactgatcttcctaccaaccaaacagctggcttcagcttctcgccatgcaagtkyctgccacatgccacttctctacctaggaagttctccctcctttcacctgaacctgtccaaatgttactcttccttcaaaatagggctccaatctcaaaatttctgctcccatggggtctttcctgatgycgtgctgccgggcacaatctcaggagactccagcaccactgtttacaccacccttgtgtgtgtgtgtgtgtgtgtgtgtgtgtgtaagtggacctccaatggactatgtgctcctacagaacaggagctgtattttgaagttgttttgtttgtctacttgttttggttttgttgttagtgttcttttctttccaggccttgaatgctctatggactatgtgacaatatgtagaataaaagacagattgcttggttacatgaacagattaatagcatgttacttcgctccaccctaaagcaagtcctctcagccacaccccactgcaatgcagtctacatgtgacttcttggccataattaccaaatggattcagaggcagagaagagggaaaatggcaagtcccttttctcaggctgctgagataatttgcttagaggacttaagaggtagctctttaggattcccagaaataattggggaaatatttgagggtcccacacaatcagggaagatagtaaaaaaatactcaccactttactttgaggtcactgttgctgccatcatcaccccagagttgtttcctactcttggttatctggagtcacactgagctcaaaacagatggccctgaaactgctctctgaagcagtgagcacacaccgtctaaacacacmaatatgcgcatgcacgtgcacacacacacacacacacacacacttgtatgtcaccactgaactagtaaccccaagcaagctgaccaagtgctcttctcctgaagtttcagagatttcattgcagaaacacaatttacttttatgagcagcacttctgtcccaaggcctcagactaagctggtaagtactgattccaggacaaaatgtgacccacatcccgaagtgtcctgcattcctctttctgccccttataggttctttacctgcaaactctctccctcttgtccaaaacattttacctgctctgtcacytttgcatgatcacaggtccttcgcgttccacaatcagttatttccgtaccaggtttgttttatcactttgaaccttaaaacacagggaacaaaattttacccactgtcaaactgaatctgtccattgtgagatgctacaccactgaattttgctgtgcatccgtccaattggaaaaggaatgaatgtgaaagtttcatttaaaacactccttcatgaaactctctgtgcatcaaataactgaaagcccaaaccactgatcagttagtaaagctgtgaagccctctcaattgtcagaagcaatttgaaattgaactgaaaaatatctcacggtctcttagaaacagacacgaattgtggtttgtaacccaatgtggaaatagttacggagaaagtgacaacctcttgtgaggtgtgtgcgctyttcctccaagttctttgttctaaggtcagagggctgatcacctcactgctgccctacatagtcccctcagcrccagaaaatgctcacttaccaccaaatttacttccaaactgtagtttatcagaatataattttattttctgaaagaagtgcttcaactttgtgtattggcacaagataactataaacaataccaaagaaaacggtcccctataatctggccatttatggacacagcaccagagggaaaaaaactttaaacataaattaagaaagttctctgtaagagctcttgttgaattatagctgacaacagtacacacagcacagtcacgccactgaattctttccagctccagctccataattcaccttctcccacatgtcctctattcttgaacttagaagacttttctcaataagggtcactaaggggatcccagttgggaatagaagaacaaaaaagtttagtaactattccaagagtcataacatcgtaggcaataaatgctgcatttaaagactacagatttaagattgtgagcagcttctaccagacactgcattaccctggtaaagtcacctgccttctttgagcttcagttttctcatctggcagttgttcaatgggtttagtcatttgcaatcatttttattaccttctaargtcccctttaggtactgtgatggagaggtagacagacagaaagatgatagatagatagatagatagatagatagatagatagatagatagatgatagataggtgggaaagccttaaaaactcaaaaaagtaaggaaggatgatcccaagaaataagaggaaccagagctcttctccctgggtctgagagaagctggcccaagccatccttccctgagtcctatcctgctcctgcttggacttcccaggacagaatcctccctgctatgtgtgaggcagccccaggccctttgtactgctccagaggtctggggagcagtgttcgaatgggaagaaaagcatccaaaaaagaaaaaccaaagagccaatgccataaatatgtaaatgcccttgaactctactgagaattcctctgtgccccaatagtttcctcccctccatgtgggttatattctattttcccaggcatggagtaagggagaagaataaaattggagctgggtggtgggggagtagcctggaaaagacacttatgaatgcaaagaggccatagatttcattaccaggtgcatagtatcatcagctcccggtccaatgcttactcatagcacaagctgattaaatggttgtggaggaagggagggaaggaaggaaaaaaagaaggagagaaggaaggaaggaaaattggttcttatgctttctactggaaactttttatctattcaaggaagaattaatttttgatgtttactggctatatattttgcactctccaccttgccaccaccacatatttatactgtgaccaacctagctgaaatgaacttatattttaaatgagtcattttgcagagcaagtaataaatcagctatcaggagtaaggagctctcagcaggccatactgctccattgccaggagggattattttagtagtatcacactaggatttctgaatttatgcccttaatttatgagacattcattgcaggggctttcccaagtgttattttcataaacagcagattaatataggggctttttcttgcatttctttggaaaaatcttgcccccatgtagaatattcaagctctgctacctataaataagctaatgtctttcctctgggctgttgtcccttagccttcaacatcttctagtctgaagcaaaaatcatgcttcaytttgttttgctatctttctaatacagtaagagcttcaggtcaaagaactgaagagaatgtgagagcttgaccctctgttatgtttttcgttatttgtagattttccttatgcacttgcccttctgtggaatctttcctcttcattcccttatccctattaggattctaccaatttattgttctaaccttgaagaaacagctttttatttaccttcagctgtaggtggcccaccaggtgtcaacaactgtagagttccatcaagagtcatcattttacagttacaagtcggaggggccttcacagatccgtcaggctcaacactgcctcctyagtgagcctgtgaaccacccaagacggctggtcatcagtgtcatcctcttccttttccggacaactatctttaaaagaaaaaaaaagagtgtctttgaatgtatccattttatccccaaataatcttgtttaataaattccttattaggccaaatccaatgtgctgaaatatctgccaagcatgtcattctacacaaaagggatttgcaaatagccagtagttggcgtgaagaaaggacatgtgaaagcgctgggtgtggaatttcccatcctcggccggaggtctactacagctcgctgtttgcagatctgggctgagctatgcatcacattgttcatgaaagaaaaagcaactgctctccccagtgccccttccccgctccacatggctgcgatcagcagccccaagaccctaattgccacagcctattagaaataatgagacttacatggcagaagccaagggtaaaagcgacatctcgcaacacgaaaggttaatatcaacatatacagctagtgagtgcaaagggcacctcagttggtggctcattatggcgggctgacccatagggaaagtgtcattctgcagagaggcctttctcaggatgtggcagcaaaagttacaaaagataaggacttgcctgtgaaacgcactcaactaatgagagctgaagattgtttgaaatatcccgatgacctcacagatgggggatgctgattaagatggctacaggaggctcctttcttgtctgacagcccattgagaagctttggtgagatgtgactaacaggccgtgaaggtgtctccatcttctctgacatggtccatgctttgggcaaaacaaacatgaaaaataagtctgaactgacacacatgtttgaatttagttttcagagccatatttgggggaaggagcactggtggggccgtcagcgatgattcctttatggtaaagggtgttcgtgactacttgcgtgactaatcgcatgactgcgctggggggtgagccaacggcaaattgaggtcttgaacacttgacaaaacaacccctgttctgtgggtgaaattctatagagcttcatgcgtaattaaatgaaagtttcacaagagtctacacctcaatcatttaatgccgatatgtagcacaaaggaaggatttttgccacatcaaaatacatccatgaaacaatggagaaatgtcccaagttttcagagtcagagatactcacagaagaaaccctggagttctcttgaccttcatttagtgcctgggactctgaaaagagatcaccattatgctctcctctacctcatactagaggtgaggatgagagcgcacctcatactgcatatcttaattcctctcccaggacaactggaaggaacacctatccgtttgccatgtcactaaaacaaaaatcactcgtgtcttgcaaaaacagttcagatctttctatttaaagagcttatcactatattaaacaaggttatattggagttttgtcatgagatttaagaacatttctttcaagtctttctaactagttgttttagttattgattgctgaataacaaattaactcaaaaattagtgacatcacagtagaaaataaaattacataaagatttttataatgagatttaagaaagatttttcaagctttactaactagctgtactagttaattaattgctttataacaaattgccacaaaatatggtggcatcaatgacaataaacatttattatctcatatagtctctgtaggcagcctcataaggttgcagtgcagatgttgaccaaagctgtgatatcatgtgaaggtttgtctggagctggatgatccctctcaatttggttcgctcacatgtctggcaaattactgttagtttcattcaggaggcctccgttgccacatcagcttctctacagagctgcctgcatatcctcacgacatgggagctagcttcccctacagcaataatccaagagaaaaaaaaaacccacaaattcttttttaacctagtgtgtccaaggtcatgccccaccatctccacaatatcctagtggtcacacaggtcagctctattcagtgtgggaggtgaatacacacaggcacgaataccaggaggcaagaatctctgggagccatcttgcaggctggctatcacatttattaaaagtatttcttaaagtatcttcacctgaccaaaaaatataaaaactatgatcatcgatgtggtcggcaaaaagtctgcaagcgagacaaaaatcaaagaactctatggtacactttgtaaagaacgtatattccatttgactgaaaatattttcttctactaactgatacgtgtttacatgtggcacctgtaagaccaaagtgaagacatgaattaagagattactcaagagaaattgattttagtagataaacaaggttttttgaaacaatttgctcccttttgatcacaagagcaggatttttggcctaaagcatctagaaaactgcagtcttccttttcagtgcatatccatggagtagtctacaaccattcaccactgtgccaggcatagggaattcaagagcaacaaggtgaagaaaatcttaatcagctgattgagaatccattttatggaaagatccacctctttggggaaatggacttgatatttagaaactaaaacaatataaaaattttcaacaatagaaggacagaaataggatatgaattaaacaccaagcctgtggtaaatttgctttcagtgaaaaagatgtagaagaggaaaaaaaaaataaggaagagacgaaaggagaaagaaggagcagtggacgtagctgaggagaattatttccaacttttgaaaccaacagttgaacaattgagacttatggtggtttagcactacagtcaaaacatcttgtctcccaccccaacttctatgacctaaataaatgcagagagatagcatatttatggattacaaaactctatattgttaaaatggcaatgctgcccaaattcctcccaagattcaacacaattccaatcaaaatttctataagcattcttataaaaattgacaagctgattctaatatttgtatgaaaattcaaggaacctagaatagccaaagtaattcgaacaaagaacatagttgaaggacttactctatttgacttcagtacttactataaagctatagtaattcgttctgtttaatattatggtaaaggtaggcatatagatcaatgaaacagaatacagtccagaaatagaccagctgagttttgacaaacaagccaaggcaactcaatgggggaaaataaagtctttttaataaatgtcattcaataaactatccatttttttaaaaaaaatcaatcctactccctaccatacacaaaaatcaactaaaaatatattccacatcttaatgtgaaatgtgaaactatgaaacttctagaagaaaacacaggaaaaatatttgagatcttaaggcaagcaaagatttcttagatgtgacaccgaaatcactatccataagagaaaaaatgttggtaattgaactttatcaaaatttaaaactttaactctttggaaagcaccaataagaaaacaaaagactcataaaaatatttacaacatatttatctggtaaagaactcacatctaaaatacagaaagaatgcttataactcgacaaaatgtaaacagacttttgaccaaagtcaagatatgaatggacaatcaacacatgaaaagatgttcaacatcatttgttatgacatatgtatacactgcagattaaaaccttaatgagataccactacacgcccattagattgcctaagattaaaaagatcgaataatacaatgagcctgagattcacttaaaaataaaaaaaataataaaaaaaaaagatcgaacatactaatctttttaccaagtgtttgtgagtatggggaagtggaactcatatactaatgaggggaatataaaatagtacaataatgtggtttgactgtgtccccacccaaatctcatcttgaattgtagttcccgtaatttctacatgtcctgggagggaccctgtgggaggtaattgaatcatggggcgattttccccatgctgttctcatgatagtgagtgagttctcacaagatctgatggttttataagcacctggcatttcccctgctggtactcattctgtctcctgctgccctgtgaagagaccccttctgccatgactgtaagtttcctgagacctccccagccatgagaaactatgagtcaattaagcctctttcctttataaattacccagtctcaggtatttcttcatagcagcatgagaatggaccaacacatccaaccaccaccaaaacaatttggcagcttcttaaaatgttaattatacacctaccttgcaactcagtcatttcacttctaagtatttaaccaaaaggaactaaaatgtacgtgcacacaaagattgcacatgagtgttcttagcagctttatttatgatagcccaaactggaaactatttatcaacaggtgaatagttaaataatggtatcatatcatacaatggaatactattcgttaactatagtgatgaactattgacataagcaaaatggccaaatcacaaaatcattatgagtaatgaaagaaaacagacaaaaacagacaatacagagttaacaattcattcctgggcatgaacccagagaatgcatataaccactaaaaacatttacacaggaatgttcaaagcagcattattcatatcatcccaacatggcaaaccaaccaaaatatccatcaacaataaaatggactttataaatagtggtatgttcccataatggaatattacacagcaggggtccccaaaccccaggccacacagaccagtaccagtttgtagcctattaggaaccaggctgcacagcaggaggtgagcagtgggtgagcaaacattaccacctgaacttcgcctcctgtcagatcagtgatggcattagattctcgtaggagcacaaaccctattgtgaactgcacatgcaatggatctaggttgcatgctccttatgagaatctaatgcctgatgatctcaggtggaataattttgttcctaaaccatcacctcccccaacccactgtccatggaaaaattgtcttccacgaaagtggcccctggtgtcaaaaaggttggggactgctgttatacagtgaacaaactacctctacatgcaaaaacatggaacattacaaacataatgttgaatgaaaaaagatagtcaccaaagagcacaaaagttcaactacatttatataaagttcaaatacaggaaaaactaattcataatgttaaaaattatgatagtgcttactattggggtgaagtggatagtgactggaaaaagcacaagaggtgtgtctgaagtgctggtgatgttctattttttttatcttggtgctggctacaagagtgtgttcgctttatgaaaattcctcaaatgtacacttattatttggtacatttgtctgcatttatgttatatgtcaataaaaaatgtaccctgtaaaatcatgttttatggttagatgatgcagttgaaattgaaaatgatgggttttgtggaaatacagatgttcagccaacaggaagaaaagtgacgtatacttggagttgacaggatattactggagataaatatgtcattccttacaacagtcacagataatgataaaggcaaagggaagagaaagctaaagaaggaatcttggtgaatgtttacctgtaggtgttggaagaagaaaacaaagagatggaaaaggaccaagacatgcatgcacatagaagccaggctaaagaatgcttcaaagaagagacaggggcagctaatcatcaacacaaaagcagcacagtggttaagagtgtgggctttggagccagaatttctggattcaaatcttccaattttcatctataaaatggggctattagttgatactacttca

SEQ ID NO: 12518 - DNA, 22262 bp, Homo sapiens
aaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacagtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcgcacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcagctctccagcttcctctctgaaatcccagtcccaaaatccagtttcctggccgcctcctggctcaggtcaggatctggcagaggaggtttctcagccggttatgttggggcctgcttaagggcgggggtgagaaaggtccccaggctactgtggatcctgtgtctgacttcagatccccttttcccacagttatagctccacttttttgggacaggtggggagcaaaagggtgcagaggtcaggtcttgaaatcaccaggggatttccgggtgaggtgggtggtgagaaaggaaacagcaagcagggctctggcagctgctgcagacggcttcacacagggacgcgggctgccatcttgctctaagygaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccagtgagtctgggagtcggggagagctggctgggagaagagctactgaagccccagggtgccaccctccccgagattccagaagagcaaaggggccggggatgaccccatcgccttctaagcccaacgggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccaraaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgyttcctggygaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttcyacctgtgtccttggtcctcccgggctccctccaccaggacagcccaggtcccgattacagcyacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacrtgcaggtctctggagggggacctagcatctccttggtgatgaagactcccagggtcrccaagaatgaggygctctggcacccracgctgaacttgccactgagcccccaggggactgtgcgaactgcaggtaagaaaatgaaaagyaaggccaggtgtggtggctcacgcctgtaatyccagaattttgggataccgaggtcggtggatcacctgaggtcaggagtttgagatcagcctggtcaacacggtgaaaccccgtctctactaataccaaaattagccgggcatggtggcgggtgcctgtaatcccagctacgagggaggctgaggcaggagaatcgcttgaacccggaaggcagaggttgcggtgagccgagatcacaccatggcacttcagcctgggcaacaagagcgaaactccatctcaaaaaaaaaaaagaaaagaaaagaaaagcaagtcacagaaagttttgcttttctaaagtggtaagatatggggsacagaagaagaaagggaacaaatccacctccatccacactggtcacctcagggcacccctaggccttggtcctttcttcctaaaaacccctgagtcaggccaggtgcgaaggcccatgcctgtaatcccagcactttgggaggscaaggcaggtggatcacctgaggtcaggagttcaagaccagcctggccaacatggtgaaaccccctctctactaaaatacagaaattagccgggcatgatggcaggtgcctgtaatcccagctactcaggagactgagacgggagaatcacttgaacctgagagacggtggttgcagtgagccgagattgcgccactgcactccagcctgggcagctgagtgagacaccgtctcaaaaacaacaacaacaacaaaaaccctgagtccacaagagaatgcttcgcagcccctacctgaasgtccccaggcacacagacaacctgtgttatttccaaaatggagatcgttctcatctcactgggctgccatgaggaaataagacacatgatgctattctgtacatgggtgctgtccactgtagtcttatcgagccaaaacccggttttctsccagtgaaatgctaggctgctctggtgcttcaggggtaaagctcagggatgcatcatttgttcatgatcttattagtaaacccagtacttgccctctccagctcagcacatcctcgagggcacaagaaattgagaacatgatgacagggttccccagagcccattaatccaatactctgtgccctgcttctttgagtctccaagaagaaacagccaagtccagagaaaattaggggcaaccgtcctatccttggaaaaccccagaacactctaacctctctgtggtccaacctaaatctatcctgacccattagaaaaaggtcttcatgtctgtccagtgtctaccatactcctggcatgcrtaggtatttctctctttttattccaaacctacaaaaaaaggtgaaataataatataatgaacacctatataccctacacctagatccaccagttgttaacaatttgccacattctctctcccccgactcctcatgtgtgtatatgtgtacgtgtgtattttcctctgaactgagagtaagttgcagaagataacacttgaaccccaaacgcatgtttgaaccccgaaacgcatgtttraaccccaaatacatccatagcatgtattagtttacaatgaaggacaaggatgtaatccttcatagttacaaagccatcatgtcagaaacaaaccaaagtggggaagtagtctacccgtagcgcaggcaataagggagtgcagactgtaaaatatttcagaacaaaaataaaatcagctaaaagtcagatggctttatagtctcaccatctcccgacactggcaattctgaatattatcagtgataaaatactcctctctgctagggcagactgtccctatctccccacacgactgcctagtatgccacagatcttcatacttttagatattttttaattgatatgataatagtctcaactataaagtccagggcatggkggtgcacacctgtagtccagctactcaggagactgaggcaggaggattgcttgagcccaggagtttgagtcctgtctgggcaacatagagagcgagaccctctttttttttttttttttttaacagtctcattctgtctcccaggctggagtgcagtggcatgatcttggctcactgcaacctctgcctcccaggttcaagtgattcttgtgcctcagtctcccaagtagctgggattatagacgcccgccaccacaccagctaatttttgtatttttagtagagatggggtttcaccatattggccaggctggtcttgaactcctgacctcaggtgatccacccatctcggcctcccaaagtgttgggattacaggcgtgagccactgtgcccaacctaagacccttctctttaaaaaataattaaatgtctccaaattcaaatttctccacttgtcccaatatttttttttttactgctttttctaagtacacaattcaaacaagaatcatgcagtgcatttagttgtgctgttccttgttttaatctagaacatgtttcatagaattgacatttttgaagggtccaggctagtggtcttgtagagtatcccaacatttagatttgtctgattgttttcctcatttcctcatgactggatttaggttaagcatgtttggcacagatactactatcacatgcttttttttttttttttcgatatggagttttactcttattgcccaggctggagtgcaatggctcgatcttggctcaccacaacctccgcctcctgggttcaagtgattctccacctgagcctcccaagtagctgggattacaggcatgcgccacgacacccagctaatttttgtatttttagtagagacggggtttctccatgttggtcaggctggtctcraactcccaacctcaggtgatccacccgcctgggcttcccaataccacgtgtgtttttttgttttgttttgttttttacattttttttgagacggagtttcactcgtcgcccagactggagtgcaatggcgcgatcttggctcactgcaacctccacctcccggattcaagcaattctcctgtctcagcctcccaagtagctggaattacaggcacctgccaccatgcccggctaatttttgtgtttttagtagagacagggttttaccatgttggccaggctggtctcaaactcctgacctcaggtgatccacccacctcggccccccaaagtgctgggattaccggcatgagccaccgcacccagccaccacgtactttttaaactattgtttctagtcttcacagcatccttgcttaagcaggtgagcttggtaacaccaagtgacttgtcaaaggtcacggagccagtaagtggaacaaccagggtttcagagctttttctgctactctagtagttcttacctgaagattgatggtaactcttaattttgcatgtgtatttttcctggtgggagatccatagctttcactaaattatcctagagtaagtgatcccaaaatggtgatggccatcatgtgtaccatgctacctttccagagccccatttctttgtggttccatgtgatggaaaataagctcaaccggcctgtcaggcgaggaagaggcaggtgtatgcccacaacatgcccacagcttggagatcaggtgacctcaaggaggaagtagcccacaaatcacccctcttttcctcttcacagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaaggtgaggccaggacatggttatcccagggaaggggatataacatgtctactgggagcgtttccagattgggacccaaatgcaagaatgatttcctgagaagcaggcttcaatcccacaacttaaatgccatcttcaccatggaagcacagatggcatcagataaggagtcccgttggactccaggataattccaccaagagatttccagcccaggatcctgctgccctgctgtggctggctgtctccatcaccccagtccttttggaccacatcctgaggagcagcagcagcaaaccaaggcagagcagtggaagcggttctgaccattatcactgctatcctttaaaatctctggcttagaggccgggcgcggtggctcacacctataatcccagcactttgggaggcggatcacgaggtcaggagttcaagaccagcctggccaatacggtgaaactccgtctctactaaaaatacaaaaaatagctaggcatggtggtgcgcgcctgtagtcccagctactcaggaggctgaggcagaagaatcgcttgaaccccggaggtggaggttgcggtgagccaagatcatgccactgcactccagcttgggcgacagagcaagacaccatcttaaaaaaaaaaaaaaaactggcttagaatgacagtaagaagccarccaatctttagttggctttactatctgttttctggaaaatgtaaccctgcccccttacggcctgcatccaggtgggcccctcacacacccccgccttggtacaccaccaagggacactgtagcctccacaatctactctcatcttggcaggaagaaaaggcttcaggctcctccgctgtccccagttagatccatgtgtaaycttattcctcattctttctccagcttcccctaaagtacgactgagcttggcaaacgaagctctgctgcccaccctcatctgcgacattgctggctattaccctctggatgtggtggtgaygtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccaggtactgggagtgtcctccttttccccacctccacactagggctcatggctctcctgccccagctcatctatggccttgttctgctgcccatccactttgttcgcagccctggcttcatgctcctgcctctgctcctgactattttcccaaggcggcagctgccacagcttctaccacacatcccctgagacttcattatactccagcctccagggtgtcaggcaatgtgcttaaggctggagatcacagatgaataattcctgatcatgccctccaggagcttagtccagtaatagagacaagactaagtagacagagaagatggcatttgagccaagttaactagcttagagggaagggaacactcaagatagaaacaatagcatatatgaaagccaaatcataaaacagcctaaagagaatttggagaattgcaagtaattcagcacagctagagcytagggtatatgggaaaaagggaaagtggctctgaagcttcggaggtaattctatttattgagcatttacatgaatcaagcagtgtagaaagcacttaaatgtatgatttcatggatcatgactcccattttacaggtgagtaaactggcacttgcagatgtcaatgaatttgcccaaggtcacctatcaatcaatggtaaagagagaatgtgaaaaacaggcaaccggattccccttacgggcttaattaaaccctgtagatctcactgggccttcaagctggaacttcctgagagccatagcatgctgttgaaaggttttatttatttatttatttatttatttatttatttatttattttattttattttactttttttcgatacagaatcttgctctgttccccaggctggagtgcagtggtatgatctcagctcactgcaacctccatatcctgggttcaagccatcctcttgcctcagcctcccgagtagctgggattacaggcgcgcaccaccacgcctggctaattttgcgtttttagtagagatggggtttcgccatgatggccaggctggtctcaaactcctgacctcaggtgatctgtccgcctcggcttcccaaagtgctgggattacagatatgagccaccgcaccctgcctgtcgagaggttttaagcaggaaagggacaggaaagaacccgcaacttgaagtggaaacatccaggagcactgggcattatttggttgctcattagactgtgaacttccccaaaactgaggtttcacttcagctcacatcattccccaactatttacaaaatcccagttaactggtggttttttgttttgctttgttttattttgttttgttttgagatagggtctcactctgtcgcccaggctggagtgcagtggcacgatctcagctcactgcaaactctgcctcccaggctcaagtgattctcccacctcagcctcccaagtacctgggaccacaggcgcacaccaacatgcccagttaattttttgtattttttgtacagacagggtttcaccatgttgcccaggctggtctcgaactcctgacctcaggtgatccacctacctcagcctcccaaagttctgggattacaggcatgagccactgtgtccaggcaagttaagtgctaacaaataaacccacctaaatctcacttgcaaagcaatttttaaaaccttgtccttaggtgggaagaggtagagaattctgtgtggagtaactcacaagtatccagcaaccttgaataagaacaaatgctgctgagtgccttgttccaggctcctcaaccagggactcacacacacaatccttagctcctcctccctggggtggacactgcaggtgagggctcagctcatgattcctgygcacgatgatccccrcccacgttgctctcacctacagagcggagaacagccttgggagtcatctttgccagcagtctcttccttcttgcactgatgttcctggggcttcagagacggcaaggtaagagcctgggtgcccttggctctggccctggcccacctcacccactctaaccaccyccccrcccagaccagggtggaagcccasatgccccaagctccagccacccacccatcacagcctcctgcttttgagtttgccctaaatgaaaatgaaaccagtcgtgttccctcgttttctcctagctacctcactaaagtctgtcactctcctgcctcagagtagaaagaaagagtagtcacgtgctcccagaaggactctaagtcaagtcacagagctaaaaatacatgaaggtggcaccagctcatggggcactgggcctggctctgcagaggcctctgccttccttcactgtgcaccctgggctcatgcaccaaggcagagaacaggaagaagtgaggggacaagaagaaggcagaatgtccagatggaggwtaagaccaaagagccaggttggtggtgtgacggtaggaaaacaaagctggaggaaatggagaaggaacaagtgagggacaatgaggcatgggttggggctgggctacccctcccaaactcagctctgtcaaaataaaaggcccttgtgtctgctgcgaccaagcttttccactttcctgtctttctccacactggtcccaactgagccctgtcaccaagcctagcggctccaacttgcaaagtgtttaagtatgaaacaaaggccctcagaggcacccccgkggctccatctcagttgcacctcagctgcaattagggttctgctccctcgggtgactgctgggaggttcaggatacctgcaaatgcctcactccctcagctgcaaggagagacttctcctttttattcgtttctaaaatgtgcctratcaatacggtggaactcagcataccaaaactgtacgtgaggatgatggggaaaagggggtaagggggtgttcactgacagccttatctgggcacatcccctgggacaggacaagcaggccaaggacctaggaaggagcacaggaggcagatggaagaggcctgagggaacctgtgcttgtttgccagtgtgagatgcccacgcaacttcctgtcttcacttcctcttaccagcacctacaggacttgggctgcttcaggctgaacgctgggagaccacttcctgtgctgacacacagagctcccatctccatgaagaccgcacrgcgcgtgtaagccagcccagctgacctaaagcgacatgagactactagaaagaaaygacacccttccccaagcccccacagctactccaacccaaacaacaaccaagccagtttaatggtaggaatttgtattttttgcctttgttcagaatacatgacattggtaaatatgcmacatgcctttggtggaagtacaactgttgttattactctatacaagtatgagatcagggttaggaaaaaaagacaaagaggtgatgacagacacacagtggaaaccccacatcgtctcatggcaaaccgaagaacgggatgtgggaagctcagcttcatttgactgcaaagtcccagggttttgttgcacatttgctcatgcacatgggtggtgggaggaaagggggatagcagagacacacagaagagggtacagggtgggtgagaaagaaagtagaagggctaatacccccaaagaacaaggccaactacacctggtgagcctcagagggacagaaacccaggaatgattcctgtgatagggctgggagagccaagaggacggattcgctccaggcttgggacacatcgaggacagtggtggttcttctccagcggtgaccccctgcattaggcaaggaggagcccagaggagagtggagaccttcgaggggggccgttgggagggtactgactgctttcttccagctcttcagtcccgcccttgggcaggacgaagggaatgtgggaaacaagggcgaaaggaaaggaaggatggttttgagcaatgaaatgctgctgcatggaaagtgggcatccagaccctgcccagcatggcctcagcctcttcctgttcgtggaccgagggaagaaggaataaagggccatgggcattctccgctctgttcccagcctgccctcctccccttgcacctgggcttatcccacattaatagcccatcctgaagctcagcaattgccccgaagataggctgagcagatcccatcctcaggttccactgtctatacacacaaaccatgcaaagaggaggaagagaaaggaggcaaagtagaattcagacaggaaagggtggttcaaaggggaatatactacaggaagaacagagaggcggctctcaaggagagggccccatgacagcacagcaatacacaagcacacctgacacaggctggcacgcctccccccaaggtggggctggtgggtctacatgacttctctgcatcctgaggatcggccgggccccaggaagaaccacttgcctcatccctgtctttggcaagtgcacgggtggtgtggaggaaaggattccatgggtgtccaaagatctcacactgctaacaccctcacgctccttcatcaacaggaagagaggaacaggaccctctttaacgagggcaaggagtggcttcctctgagcttgttactttcaaattaagcacttgactcactgtttctctataactaacaggcaatctctctctttatgccaacaattaactgggagctaggttaaattatttggctagataaaactaccagctagatggatttatttggtgccctcatacagaatgctgtagaaaatgtaaagaagagaaagctccttccagctagaagcacatgggactgcttctaggatggaaacaagtcctgctattttcacaatccctaagtgttctccaggcctctggagaacaaagtaaagttgtaagatccccaaagacacggaaaatcctggacgaacagattagaaataactacaaaaaacaagtttttactttcgaaaagggtactgcactgaaaccaagttggactttggtccacccccaggaccctcttcaggcctggtccaggaaggaaagctccacatgaccaggcagtactgagtgagctgccatcttcccagcccctccctagctcctaccagtggccaggttttctagaagtcaccatgggcaccgatactcttctcctcccaagtctgggcagcttcatgggtacttcgcctcagccactcccctccctgccccttcccttggcctccaactctttggggctttgggggaacttgagagtacagaaaaagcaggcagggaggaggcgccagctgttgctcttcgggtaatgacttagattgtgccacgagcagcatttctagtgttgagggacagagtgcaaatgaacgcaacgaaaaaggaggaatgggtgatggagaagcctgggctggaatggaggacggtgggtggggaagtgtgttgagagagcaaacagagggcagaggacatgaatgtggatggcaatggacaacagggaaggggtggtacattctcaagtaaaaaagtagactggacacaggaatcaggaagtcccagacggaaaagagaaagagacaggagaaaacaagagggtgaattacaccaagttaccagacattcaggtctctccattgttaagtgccccatccccatggtctccctccaacccaagccagtgacacacagcatagccccacttcctcagaacaggaggcgccatctccctgcaatgcgttgcagggggaaggcttgtccatcaaagaaatcccttgtctctgcccttcccccgtcccgaaccaggtgacgatcccatagcagcggtctccatacctcagtcagagcagccccactccccaggcaggcaggcaggcagggagaagactccaggaccttcccacctcttcaccccaccagcaacttcagcgatacttacttacaataactaccacgatgatggcacagatggctcccagcatgatcatcatctgaggaaacatggacaaaaaatgagcccttggatttcaggaatgaggaaaagagccacatctctagtgggaaacagaattccttccatccttgggacaatggaaaaaaccacccatcacccaggagacctgcaggcctcttagagaggccctacccttctgcttcccaggggatcataaccacagtatgtctgtagcttttcagattcatcacaggacctgcattgagctcctttttgcttagttcctggtgtcttggggctttagaaggcattccaatagagatacagactctggatatttaaccaattagttcaattttcactgtgaagtgttcagctcattctcaaaagttgcagttatttaaaaatatatatttcaatctgagaaagctgatttaaaagaaaaagaaaaaagtatatatatatataaatgtatatatatgtatatatatatataaatgtatatatatgtatatatatatataaatgtatatatatgtatatatacatatgtgtatatatagtgtgtgtgtgtgtgtgtgtgtgtgtatgtatatatgcctgagccattgtgctgatgttgggtgtgtctgaggatgagacaggtgaaattttttgcaggcaactcctttggggtaaagctccttaactaaccattccaaactcctcagggtatcactttttccctgatagcggttctaaatactctagcctaccctggtggccaattctgggtaatgcaatctcaagaggaggctttccagatttcctcccaagcgttatgctggtcagagagatcctgcaccattagagggaagaaatgtagaagctgagggttttcttgccttctaccagtggaagcccaggaaaagatggaggaggggacaagaaaattcaccttgcagtttttccaccaatacttcctctttagcttggcagcactgctctcaaattgtgatgctcctgcctgcaaggcatcagctcggtcatccagctctgacagcttctggtccctctccaggaccttgtccacgttcacacgtatgatgtccaccacctgaggagggcacagaaacaaagctgctaagcttcctgccagagacagaggaaaggacaacaaccagagaatcacaagtctggccctgtgcaactctaaagggtgctttgcctctcagggcctttgactattctcctacgaaaaaaggagaaaagataagaagttcccttttgtttccaaactcctagatttggaaactttcagagaaacagctatctacctacctcctccacttgtgcctgggtttgctgtagtcgtctgttactggtcatgttaggaggagggccagggggacccccacctggggcagtcccttctgtcccttcagcaggtggctgagctggagcagacctgtggaaagacatgtgcagagtacacaaagtgaccaagacaagaaaggagctgggcgtggtagcacacacctgtagtcccagctactcaagaggctgaagtgggaggagcgcttgagcccaggagttcgaggccagcctgggcatcatagcgagaccccatctctaaaaaaacagacaaaaagaaaggactcacatgcatcctcaccccaaaccacttaaacaattatgattaggctatacaaaactagaatggattcttgctccttggcaatctgaagtagggagacaaaccatagaggcaagaagtaaaagatgaaagactctgcaacaacatttggatggggttcagggacatccaggatggcatcaagacatctcatctggggctatcctttgactcaactcaaacaagtcctctgccatgatggctacagggacatatggcctagccttgtcctaaatggcatttccccgctgatatggtttggctgtgtccccacccaaatctcaacttcaattgtatcacccagaattcccacatgttgtgggagggactcaggggaggtaactgaatcatggggcccatctttccggtgctattctggtgatagtgacgaagtctcatgagatctgatgggtttatcagtggtttctgcttttgcttcttccacattttctcttgctgctgccatgtaagaagtgcctttcacctgccgccatgattctgaggccttcccagccatgtggaactgtaagtccaattaaacctctttttcttcccagtcttgggtatgtctttatcagcagcatgaaaacagactaatacagtaaattggtaccagtagagtggggtgttgctgaaaagatacccaaaaatgtggaagcgactttggaactgggttaacagggagaggatggaacagtttggagggctcagaagaagacaggaaaatgcgggaaagtttggaacctcctagagacttgttgaatggctttgacaaaaatgctgttagtgatatgaacaataaggtccaggctgaggtggtctcagatggagatgaggaacttgttgggaactgaagcaaaggtgactcttgttatgttttggcaaaaagactggcagcattttgcccctgccctagaaatttgtggaactttgaacttgagagagataatttagggtatctggcagaagaaaagacgcagtactaaagaaaaaaaccatttttttgagaagaaattcaaggcagctgcagaaatttgcataagtagcaaggaacctagtgttagcccctaagaccatggggaaaatgtctccaggccatgtcagaagccttcatagcagcccctcccatcacaggcctggaggcccaggaggaaaaagttattttgtgggccaggcccagggtccccatgctgtgtgcagcctagggacttagtgccctgtgtcccagccgctcccactgtggctgagaggggccaatgcagggctcgggccgtggcttcagagggtggaagccccaagccttggcagcttccacatggtgttgagcctgcagatgcacagaaggcaagaactgaggttcgggaacctccgtctagacttcagaagatgtatggaaacgcctggatgtccaggcaaaagtttgctgcaagggcagggccctcatggagaacctctgctagtgtagtacagaagggacatgtggggttggagcccccacacagagtccccactggaacactgcctagtggagctatgagaaaaaggtcaccattctccagaccccagaatggtagatccactggtagcttgcaccgtgcgcctggaaaagccacagacactcaatgccagtccgtgaagggagccaggagggaggctgtacactgtaatgtctgtcagctcacccctttttatattcaagttattggttatggttattggtttatatgcccagttatt

SEQ ID NO: 12519 - DNA, 12405 bp, Homo sapiens
tggtgttatcgggttattttgcccgttaattgatgcagtttcttcacagcatcgatagtctttacaatttggcatgtttttgcagtggctggtactggtgtttctttccatgtttagtgcttcctttaggagctcttgtaaggcaggcctggtggtgacaaaatctctcagcatttgcttgtctataaaggattttatttctccttcacttatgaagcttactttggctgcatatgaatttctgggttgaaaattcttttctttaagaatgttgaatattggcccccactctcttctgtcttgtagggtttctgcagagagatctgctgttagtctgatgggcttccctttgtgggtaacccgacctttctctgtggctgcccttaacattttttccttcatttcaactttggtgaatctgacaattatgtgtcttggagttgttcttctcgaggagtatctttgtggtgttctctgtatttcctgaatttgaatgttggcctgccttgctaggtttgggaagttctcctggataatatcctgaagagtgttttccaacttgtttccattctccgcatcactttcaggtacaccagtcaaacgtagatttggtctttccacatagtcccatatttcttcaaggctttccttgtttctttttactcttttttctctaaccttgtcttctcactttatttcattaatttgatcttcagtcactgataccctttcttccagttgctctaatcagctattgaattttgtgcatgtgttatgaagttcttgtgccatggttttcagctccatcaggtcatttaaggtcttctctacagtgtttattctagttaggcattcatctaaccttttttcaaggttcaaccttccttgcaataggttcgaacatgcacttttagcttggagaggtttgttactaccaaacttctgaagcctacttctgtcaactcgtcaaagtcattctctttccagctttgctccattgctagcaaggagctgtgatcctttggaggagatgtgcttatgcgctatggtttttagaattttcagcttttctgctctagtttccccccatctttgtggttttatgtaccttaggtctttgatgttggtgacctacagatggggttttggtgtagatgtcctttttgttgatgtttatgctgttcctttctgtttgttagttttccttctaacagtcagatccctcagctgcaggtctgttggagtttgctggaggtccactccagatgctctttgctttggtatcaccagtggaggctgcagaacagcaaatattgcagaacagcaaatattgctgcctgatccttcctctggaagcttcataccagaggcgcacccacctatatgaggtgtctgttggcccctactgggaggtgtttcccagtcaagatacacagaggtcagggacccgcttgaggaggcagtctgtccattctcagagctcaaatgccatactaggagaacgagtgctctcttcagagctgtcagacagggatgtttaagtctgctgttccccacatgttcagaagttgtctgctgccttttgttcagatatgccctgcccacagaggtggagtctatagcggcagtagcccttgctgagctgcggtggactctgttcagttccagcttcctggatgctttgtttacctactcaagcctcagcaatggcggacacccctcacccagccaggctgccgcctcacagttcaatctcagactgctgcactagcagtgagcaaggctccgtgggcatgggagctgctaagccaggcaggggagagaatctccttgtctgccagtttataagaccttgggaaaagcacagtatttgggtgggagtgtcccgtttttccaggtacagtctgtcatggctccccttgtctaggaaagggaaatccctcaccctcttgcacttcctaggtgaggcgacgccctgccctgcttcggcttgccctcagtgggatgcacccactatccaaccagtcccaatgagatgaaccaggtacctcagttggaaatgcagaaatcatccatcttctgcgtcgatcatgctgggagctgcagatcggagctgttcctatttggccattggtgctgaagcttccgttctcctctccaacacctcctttttttttccttttctcttccagtttttcaatgtgaacatattctctagagttaactacattggctcaaatcttcactatcatctcagtggagcagaacaaattgggaactgtggcacaggtcactcttgctatgccccttaagaattccacattaacaaagctaattttcgagtgtggtaaagaacaggctagtgtatttagtagtgagtccattgactgtttcccaacatgaggtcacactagatttaatatggtttggctctgtgtcccccaccaaatctcatcttgaattgtaatccccataatccccacgtgttgaggacaggacatggtgggaggtccccacctcctaatctcatcatagtgagtgagttcttatgagatctgatggttttataaggggcccttatcccttcacttgcaagctattcctctttctctctttcatgtaagacgtgtctttgcctctctctcactttctgccaggattataagtttcctgaggcccctccagccacatggaactggagtcaattaaagctctttcctttataaattacccagtcttgggtatgtctttatagcagtgtgtgaatggactaatacagtaaattggtgtcatggagagtggggtactgctataaaactacttgaaaatgtggaagtgacttggaactgggtaacaggcagaggctggaacagtttggagagctcagaagacaggaagatgtgggaaagtttggaacttcctggagacttgttgaacggttttgaccaaaatgctgataatgttgtggacaatgaagtccaggctgagtctcagatagagatgaggaatctgttgagaactggagcaaaggtcactcttgctaagctttagcaaagaaactcgtggcatttttgcccctgccctagagctctttggaactacgaacttgagagagatgatctgaaattggaacttatgtttaaaagggaagcagagcataaaagtttggaaaatttgcagcctgaccatgtggtagaaaagaaaaacccattttatggggagaaattcaagccagatgcagaaatactagctaaagaaatttgaataaataaggaggaaccaaatgttaatcaccaagacaatggggaaaatggctccagggcatgtcagagacctttgcagcagaccctcccatcacaggcctggaggcctaggaaggaaaaatggtgttttaggctgggtccaggcccccactgctgtgtgcagcctcaggacttggtgccctgtgtcccagtggctccagccatggctaaaaggggccaaggtagagctcaggccattgcttcagagggtgcaaacctcaagccttggcagcatcgatgtggtgttgggcctgcgggtacacagaagataagaatttaggtttgggaacctccacataaattttagaggatgtaaggaaatgcttggatgtccaggcagacgtttgctgcatggatagagtccttatagagaacctctgctagagaagggtggtaaagaaatgtgaggttggagcccccacacagagtctccactggggcactgcctagtggagttgtgagaagaaggccacagtccttcagaacccagaagggcagatccaatagcttgcactgtgtgcctggaagagccacagacatcaatgccaccctctgaaagcagccaggacgagggctttaccctgcaaagccacagggttggagctgcctgagaccgtgggagcccatttctggcatcaccttgatctagatgtgagacatgaagtcaagggagattattttggagctttaagatttaatgactgccctgcctggttttggacttgcatggggcctatagcccctttgttttggccagtttctcccatttgaaatgggaacatttacccaatttctgtacccccattgtgtcttggaagttactaacttgtttttgattttacaggctcatgggggaagggacttgacttgtctcagatgagaccttggactatggacttttgagctagtgctgaaatgagttaagactttggaggacagttgggaaggcatgattggtttttaaatgtgaaaagacatgagatttgggatgggccagagggcagaatgatatgatttgactgtgtgtttccacccaaatctcatctcatattgtaatttccataatccccatgtgttaaggttggtacctggtgggagctgattgaatcatatcggcagttttccccatgctgttcttgtcatactaagtgagttctcatgagagctgatggttttataagggactctttctcctttactcacaagcttttcctctctgtctctcgcctgctgccatgtgagacatgcctttgcttatctctcaccttctgtcatgattgtaagtttcctgaggcctccccagtcatgtggaactgtgagtcaattaaacctctttcttttataaattacccagtctcagctgcgtctttatagcaggctgagaatagactaatacaagattggtggtgattgaagttatactgaaagggtttaaaggagagtctgagaaaaggaaatgaatctgcatttattgagaaagttgatgagaaagtggaattagaaattcctagaaaggtaagttgttgtgtgaattatttcccaaaatggggaagtctctctacctgtttggagacagaaagtggaatcagaggagaagaagatgatggacagaaaggatcattccctcttccagatgctttccagtgtgtgatgtaagctgaactaaaatcagctgtgttgaactccagccagaaaaaatgtccggcattttgttttttgggaccctaatgaaatggttacaggtctccaggtctcttggggctcacagggtcatgcctttccttgcccagtgtacttggtgagaaggtacaggtgtttccatggagggtgttcattttagggatttcaagagggtcatctttgcaccacaggaaatgcccccttttacactctgaaaaccttatcaaaccgttgtataaaagatgaatacccacataacaggctctagcactgttctgtttttgagctgagacattttaaaaggagatttttcaattctaaaaattctttaaataaaatgctcttgcagggacaacatagtaggtcaacattgttcccatctccacaaaaagttttttttttaattagctaggtgtggtagcatttctgtagtcctagctactgggaatgctgaggaggaaggatcacttgagcccaggaattcgtggttacagtaagctatgatcttgcctaggtaacagctacagagcgagaccctgtctttaaaacaaacaagcaaacagacaatcaagctttacacttctataaaagcaacactttccatttatgacagcactaatccaggatatatcaaaactgaacttgtgtttgctttcaactgttaaaactagccagagttgttacagacccactacctctgagtgacactggtatgccactctttgctgaccactgaacaatgggatttatgtacccaattgtgtagatacacaccaactcattctactctacccagagtagtgatttccaacacacaaaaccacaatgaaactgcccatgcctttctaccactttgaaactcctttcatccctgaactgctccaaaagcaaacctactcagcaaactactcagtgagtatcttcacacatgtaagttccctcgtctgatgtacaaaaaactgaactcatttttcaaaagccttaacagtctgtcttattctgatacttcttttatggttattgtatgagaatcaactacccaggcacctcggagyatgttgatttcagagttcagtgtcagaccccatgagcccctgtgggatggtgccagctgactgccatgttcctgctgtttattgcttgggtgccattacatgcagagtggactctgagggttctagagcatatccaaacccatatcacactctttgttggttaatgatgtgttcaggccatgatttttctgtaaaaaattaccagcatgctgctcttaatttttttcagcctatccagttcagttgccttttgctctcatgccttatgcaaacctttcctcagaggtgaccctagaagaagggaccctttgtgatggaaaaggtcytcatttggggcataacctgtgccaacagaaaggtactttcttgttgtgtttatggtgcctcacccaaaaaatattacagatacacttggctttcatcaacctaatttgatatgtcccaagcatagcaataggatagttctgtgtggccttatggagatcctttttttacatttccaggacccactgccaagaccagcttggtcgtggagaccctaacccagcagcgctagacgaattaaagacacacacacagaaatatagagtgtggagtgggaaatcaggggactcacagccttcagggctgagagccccaaacagagatttacccacatatttattgacagcaagcctgtgataagcatcatttctatagattatagattaactaaaagtattccttacgggaaacaaagggatgggctctggctaattatctgcagcagaaacatgtccttaaggcacagatggctcatgttattatttgtagtttaggaacaccttaagcggttttcctccctgggtgggccaggtgttccttgcccttattccagtaaactcacaaccttcagcataggcatcatggctatcatgaacacgtcacagtgctgcagagattttgtttatggccagtttaggggccagcttctggccggaattgggggcttatccccagcaacctaccatagttggagaaccacgttcaggctgaagacagtcctagtataccaccgaccaaccatgtaaccccaaggtttgtcctcagccttcagagggaacatgcttccaccgatttcagctcagtgatatgggattcaaatgtctgacctccaaaatattaagataataaatgcatgttgttttgaaccatcattaaattaagccagaagtattgatattatttgtagatttcaccactacacactaaacaataaagtcaaatgatttagagcaaaccacctggctcacactttcccaacggaaaaaggtaatgctcaaagtgctgaactgaacattctgtcctaccactagcaaataatcattgtctgcctcaggcttaagtttaataaatagcaaattgcatacagatattttacaacgattgaaagacaaacagaggtcctatccgtgtagtcccaacgataagaacaggtgttggcatgaagtgtttataaattcttgggtacagctgttctgaaagtaaagttcactttcaatcctaaaaaaagtccgctattcctccagatgtgcttaaagtcaaatgtggactggaattacttggtgtcaatgcggagtaactgctctttgctatttattatgaaggactttaactcaactctccatcttcctccacttccaccctttcttggccattctcaatgattctcttggtggtgatttttttaccatcaactatttcagtggaagtcgacatggacttgaagctgcctgtcccatcactaccgtaggacatgcagaaggaagaaaggcccccacttcccagggagccaaaggaacgaaatcctgtatcaaaagaagaaaaaacacccccaaaagctggaaattcactgaaggcagagaaaaggggtgcagacgctctgcttctgcttccccagcagttcctctgacccccccaaaatattctccagcgggtttcccaagaggtcaaaggagaatgggtcctggccgccgaagaactccctgaagacgtcggctgggtcgcggaagctgaagacgtactcgaaggggtcctcgaagggcctgccgcctgtgcagccgccctccgcccccgcctcgccatagcggtcatagatatcgcgtttcttggcgtccgacaacacctcgtaggcctcggccacctgcttgaatctcctctccgcttcctccttgttctcagggtttttgtcggggtgccacttgagcgccagcttgcggtacgccttcttgatggcctcggatgaggcctgccggggcacgtccagcacctcgtagtagtccaccatgctggatggccagaacggcccaccaggcactggcacagcgagcggcaaggctgccagcacccaggcgcaggcccgagtgctcggagacctgggccgcctggagagacgccccttatgacgcagccacatctcattggtcgaggcctatgagcgcctcgcatcccaagatgcagtgcttctgggactggccctgctctctgtgaggctctgtgaggccctgtgatgctccaagaccaggccccgcccactccggcctccaaccagccatggtctccaaaaaggatgggaaaaagaggttggggaaaagagagggccttgactttggctgcctgaagaactgtttttcttaaagtaggctttatatcagtctttttcctcggccacaggagggaagagggtggtgggagtgagtttagtctgactggggctgaagacatcctgttgtttaggactgcagttctccaacgttccagccccggtgcccatttgcttttgttcatgtggattatatctatcatacgtactgcattagagattaaaacagaattaaaaagacatattaattgggcaatttagtaagaataaacccatgacacaatagcaaatcttatttttatgtaaattttattaagacaaaatgtagtgagaagagtggcatcgttttacagtttttgcatctctctttagtacttggctctatagagaggtggattctcatgtcagcttctgtattcaatctactgtgatattacacatcacccatgtagcttctggaaaactccactgtacacttgtgagagaatgacggtgaaaaaatcaagtagcattattatggaaatagttttaactttgcaaaattctcctgaaaaattcttggggatccctaggatttcctggctcatactttgagaatcgctagtctagcagagtagtccttggtattctgaagggattagtttaggacaaccctcctctccataccaaaatctagatgctcaagctccttttataaaatgacacagtatttgtatataacctaccaatatccttctttaagcctctagtcatctcttgattacttttacctaataaatgtaaatgctatgtaaatagttgttttacagtattggttttttatttgtattatttgtattgttttttcattgctcttccccccaaatatttttaatctgctgttggctgaatctgcagatgtgaagcccaagtatatggagggtcaaatgtgcatgttattcacttttcttgactgctaaaacaaccagggagatcctctcagacaaaaggaaatacagcactatttactgtatcgaaaccattaagacttgcaggccgtgtgtatagcactggggataaacgtgggatgcagtgattatttccactagaactgctatatcatgaccatgaattttgggggaatttttttgagatctgagttctcttcacctccttattctctttttgacactggattcttttctttgataaattgtgaggcaatacactagtaaaggtcactcagttctaaggggaaaatgattaaccaaagaacattctaagatttcctatagggtattaggtctaatggggatgtgttatgtcaccagaacaaacttctaagtttatatagcctctagtgacataacctgagacccggacttggcacttggtaagcacacaatgaacagtcatagaaagctggccgagggtagagttcagtgtgaacaaagcaatttgggaacatcaaagcaagtttggagaacaacaagtgatccagaatggctggagggtaagaggcagagggagggggcaagcagaaggggtggagaggaggaatgagcttagacaggggggctggggtctatcccagagttttgagagcaaggcagaggactctgaattttcttctgtgcccaggaagctgctgaccaaggttccagaagtgttggtggggtggcgtttttcagggagcagctgaggcagtgattcagaagggacagctgggggttgggcaactgggggacaggggccctgaaatgggaccatgacagctgggtctgagagacagtggtagaaacatccagattcagcacttacttgctggcttggatgcagggtctagaacgaaaagagaagaggagtcacttctatacagaaacatgtccagagtgcttactgtctgcaaaactgtggactggcacctgagtgatagcatgattccaaagccaaaatcttgcctgtaaggaatatatgtataggatatagctatactctaatagcaaggacagatatgcaaactgctaaaagatacaaggcagaacagaacaaaacgctgtggggattcaaggaaggtggctttgtttcccttggagggccctgtagatgatctacagggcaatggacatgtttatgttgctcctttagtaacaagtcccttcattctgatttgatgaaaggagctgggagtgtgtccaatggtgacctattaacttatgtcttcagcttaaaaagaaagtaccttcaaaagggttccagaaacactttccatggacatgtcactctttagtagcccccaaagcaagaccatcatattgctgccctgctgtgtgacttcttagcccctagagcaccacaccctgtaattgcctagttgtgagtttgtctctgttcacctgacccctcctttcaggcaaggaccatttctaacttggctttctgtcccgagttcctagcatagtaggtagggctcacacattccataaatatttggtggataagggaattagcaatggattctgctttggttccaaagcagagattaattggattgcttagtagtggttttctgttgtaattcatgagcgtgaatgtggattgcctactattgcctaccactgttggggacctctcagacctcagctgcagcctgataaacgtggttaacagagaagtaggaggctgtgacatgaaatgggtttccacaggcctttgttgggaattggatgagaaacaagagcttgaacttggatgttccccagagcgagcgcagggtcagatgagtttttcaagtaggagtgatcggtctttcccgaagtgggacccataatgaaagacaatgattggttaatcggtaataattaactaggaggagagcactctatcttccaattacatgatgatttgctaagtggctcagtgacaaggtaattaagatgaagaaaacaaatgtaggaggcacagcgtggggtggacagtcagctgtccgtgtcttctgctgagatggccacaggaccccaggttcccctgctgtggctggccacaggagtgctactccttctcagtgcccagccctgggctgagagtgggaaggtgctggtggtacccattgatggcagccactggctcgcatgcgggaggccgtgcgggagctccatgccagaggccaccaggcggtggtcctcaccccagaggtgaatatgcacatcaaacaagagaaatttttcaccctgacaacctatgccatttcatggacccaggatgaatttgatcgccttgtgctgggccacactcaactgtactttgaaacagaacattttctgaagacattttctaaaagtatggcaattttgaaaaattcatctttggtctttcataggtcttgtgtggagctactgcataatgaggccctgatcaggcacctgaatgctacttccttcgatgtggttttaatagacccaatttacctctgtggggcagtgctggctaagtacctatcaattcctgctgtgttttttttgaggaacattccatgtgatttagactttaagggcacacagtgtccaaatccttcctcctatattcctaagttactaacgaccaattcagaccacatgacattcctgcaaagggtcaagaacatgctctaccctctggccctgtcctacctttgccatgctctttctgctccttatgcaagccttgcctctgagctttttcagagggaggtgtcagtggtggatcttct

SEQ ID NO: 12520 - DNA, 12866 bp, Homo sapiens
gttacagacccactacctctgagtgacactggtatgccactctttgctgaccactgaacaatgggatttatgtacccaattgtgtagatacacaccaactcattctactctacccagagtagtgatttccaacacacaaaaccacaatgaaactgcccatgcctttctaccactttgaaactcctttcatccctgaactgctccaaaagcaaacctactcagcaaactactcagtgagtatcttcacacatgtaagttccctcgtctgatgtacaaaaaactgaactcatttttcaaaagccttaacagtctgtcttattctgatacttcttttatggttattgtatgagaatcaactacccaggcacctcggagcatgttgatttcagagttcagtgtcagaccccatgagcccctgtgggatggtgccagctgactgccatgttcctgctgtttattgcttgggtgccattacatgcagagtggactctgagggttctagagcatatccaaacccatatcacactctttgttggttaatgatgtgttcaggccatgatttttctgtaaaaaattaccagcatgctgctcttaatttttttcagcctatccagttcagttgccttttgctctcatgccttatgcaaacctttcctcagaggtgaccctagaagaagggaccctttgtgatggaaaaggtcttcatttggggcataacctgtgccaacagaaaggtactttcttgttgtgtttatggtgcctcacccaaaaaatattacagatacacttggctttcatcaacctaatttgatatgtcccaagcatagcaataggatagttctgtgtggccttatggagatcctttttttacatttccaggacccactgccaagaccagcttggtcgtggagaccctaacccagcagcgctagacgaattaaagacacacacacagaaatatagagtgtggagtgggaaatcaggggactcacagccttcagggctgagagccccaaacagagatttacccacatatttattgacagcaagcctgtgataagcatcatttctatagattatagattaactaaaagtattccttacgggaaacaaagggatgggctctggctaattatctgcagcagaaacatgtccttaaggcacagatggctcatgttattatttgtagtttaggaacaccttaagcggttttcctccctgggtgggccaggtgttccttgcccttattccagtaaactcacaaccttcagcataggcatcatggctatcatgaacacgtcacagtgctgcagagattttgtttatggccagtttaggggccagcttctggccggaattgggggcttatccccagcaacctaccatagttggagaaccacgttcaggctgaagacagtcctagtataccaccgaccaaccatgtaaccccaaggtttgtcctcagccttcagagggaacatgcttccaccgatttcagctcagtgatatgggattcaaatgtctgacctccaaaatattaagataataaatgcatgttgttttgaaccatcattaaattaagccagaagtattgatattatttgtagatttcaccactacacactaaacaataaagtcaaatgatttagagcaaaccacctggctcacactttcccaacggaaaaaggtaatgctcaaagtgctgaactgaacattctgtcctaccactagcaaataatcattgtctgcctcaggcttaagtttaataaatagcaaattgcatacagatattttacaacgattgaaagacaaacagaggtcctatccgtgtagtcccaacgataagaacaggtgttggcatgaagtgtttataaattcttgggtacagctgttctgaaagtaaagttcactttcaatcctaaaaaaagtccgctattcctccagatgtgcttaaagtcaaatgtggactggaattacttggtgtcaatgcggagtaactgctctttgctatttattatgaaggactttaactcaactctccatcttcctccacttccaccctttcttggccattctcaatgattctcttggtggtgatttttttaccatcaactatttcagtggaagtcgacatggacttgaagctgcctgtcccatcactaccgtaggacatgcagaaggaagaaaggcccccacttcccagggagccaaaggaacgaaatcctgtatcaaaagaagaaaaaacacccccaaaagctggaaattcactgaaggcagagaaaaggggtgcagacgctctgcttctgcttccccagcagttcctctgacccccccaaaatattctccagcgggtttcccaagaggtcaaaggagaatgggtcctggccgccgaagaactccctgaagacgtcggctgggtcgcggaagctgaagacgtactcgaaggggtcctcgaagggcctgccgcctgtgcagccgccctccgcccccgcctcgccatagcggtcatagatatcgcgtttcttggcgtccgacaacacctcgtaggcctcggccacctgcttgaatctcctctccgcttcctccttgttctcagggtttttgtcggggtgccacttgagcgccagcttgcggtacgccttcttgatggcctcggatgaggcctgccggggcacgtccagcacctcgtagtagtccaccatgctggatggccagaacggcccaccaggcactggcacagcgagcggcaaggctgccagcacccaggcgcaggcccgagtgctcggagacctgggccgcctggagagacgccccttatgacgcagccacatctcattggtcgaggcctatgagcgcctcgcatcccaagatgcagtgcttctgggactggccctgctctctgtgaggctctgtgaggccctgtgatgctccaagaccaggccccgcccactccggcctccaaccagccatggtctccaaaaaggatgggaaaaagaggttggggaaaagagagggccttgactttggctgcctgaagaactgtttttcttaaagtaggctttatatcagtctttttcctcggccacaggagggaagagggtggtgggagtgagtttagtctgactggggctgaagacatcctgttgtttaggactgcagttctccaacgttccagccccggtgcccatttgcttttgttcatgtggattatatctatcatacgtactgcattagagattaaaacagaattaaaaagacatattaattgggcaatttagtaagaataaacccatgacacaatagcaaatcttatttttatgtaaattttattaagacaaaatgtagtgagaagagtggcatcgttttacagtttttgcatctctctttagtacttggctctatagagaggtggattctcatgtcagcttctgtattcaatctactgtgatattacacatcacccatgtagcttctggaaaactccactgtacacttgtgagagaatgacggtgaaaaaatcaagtagcattattatggaaatagttttaactttgcaaaattctcctgaaaaattcttggggatccctaggatttcctggctcatactttgagaatcgctagtctagcagagtagtccttggtattctgaagggattagtttaggacaaccctcctctccataccaaaatctagatgctcaagctccttttataaaatgacacagtatttgtatataacctaccaatatccttctttaagcctctagtcatctcttgattacttttacctaataaatgtaaatgctatgtaaatagttgttttacagtattggttttttatttgtattatttgtattgttttttcattgctcttccccccaaatatttttaatctgctgttggctgaatctgcagatgtgaagcccaagtatatggagggtcaaatgtgcatgttattcacttttcttgactgctaaaacaaccagggagatcctctcagacaaaaggaaatacagcactatttactgtatcgaaaccattaagacttgcaggccgtgtgtatagcactggggataaacgtgggatgcagtgattatttccactagaactgctatatcatgaccatgaattttgggggaatttttttgagatctgagttctcttcacctccttattctctttttgacactggattcttttctttgataaattgtgaggcaatacactagtaaaggtcactcagttctaaggggaaaatgattaaccaaagaacattctaagatttcctatagggtattaggtctaatggggatgtgttatgtcaccagaacaaacttctaagtttatatagcctctagtgacataacctgagacccggacttggcacttggtaagcacacaatgaacagtcatagaaagctggccgagggtagagttcagtgtgaacaaagcaatttgggaacatcaaagcaagtttggagaacaacaagtgatccagaatggctggagggtaagaggcagagggagggggcaagcagaaggggtggagaggaggaatgagcttagacaggggggctggggtctatcccagagttttgagagcaaggcagaggactctgaattttcttctgtgcccaggaagctgctgaccaaggttccagaagtgttggtggggtggcgtttttcagggagcagctgaggcagtgattcagaagggacagctgggggttgggcaactgggggacaggggccctgaaatgggaccatgacagctgggtctgagagacagtggtagaaacatccagattcagcacttacttgctggcttggatgcagggtctagaacgaaaagagaagaggagtcacttctatacagaaacatgtccagagtgcttactgtctgcaaaactgtggactggcacctgagtgatagcatgattccaaagccaaaatcttgcctgtaaggaatatatgtataggatatagctatactctaatagcaaggacagatatgcaaactgctaaaagatacaaggcagaacagaacaaaacgctgtggggattcaaggaaggtggctttgtttcccttggagggccctgtagatgatctacagggcaatggacatgtttatgttgctcctttagtaacaagtcccttcattctgatttgatgaaaggagctgggagtgtgtccaatggtgacctattaacttatgtcttcagcttaaaaagaaagtaccttcaaaagggttccagaaacactttccatggacatgtcactctttagtagcccccaaagcaagaccatcatattgctgccctgctgtgtgacttcttagcccctagagcaccacaccctgtaattgcctagttgtgagtttgtctctgttcacctgacccctcctttcaggcaaggaccatttctaacttggctttctgtcccgagttcctagcatagtaggtagggctcacacattccataaatatttggtggataagggaattagcaatggattctgctttggttccaaagcagagattaattggattgcttagtagtggttttctgttgtaattcatgagcgtgaatgtggattgcctactattgcctaccactgttggggacctctcagacctcagctgcagcctgataaacgtggttaacagagaagtaggaggctgtgacatgaaatgggtttccacaggcctttgttgggaattggatgagaaacaagagcttgaacttggatgttccccagagcgagcgcagggtcagatgagtttttcaagtaggagtgatcggtctttcccgaagtgggacccataatgaaagacaatgattggttaatcggtaataattaactaggaggagagcactctatcttccaattacatgatgatttgctaagtggctcagtgacaaggtaattaagatgaagaaaacaaatgtaggaggcacagcgtggggtggacagtcagctgtccgtgtcttctgctgagatggccacaggaccccaggttcccctgctgtggctggccacaggagtgctactccttctcagtgcccagccctgggctgagagtgggaaggtgctggtggtacccattgatggcagccactggctcgcatgcgggaggccgtgcgggagctccatgccagaggccaccaggcrgtggtcctcaccccagaggtgaatatgcacatcaaacaagagaaatttttcaccctgacaacctatgccatttcatggacccaggatgaatttgatcgccttgtgctgggccacactcaactgtactttgaaacagaacattttctgaagacattttctaraagtatggcaattwtgaaaaattcatctttggtctttcataggtcttgtgtggagctactgcataatgaggccctgatcaggcacctgaatgytacttccttcgatgtggttttaatagacccaatttacctctgtggggcagtgctggctaagtacctatcaattcctgctgtgttttttttgaggaacattccatgtgatttagactttaagggcacacagtgtccaaatccttcctcctatattcctaagttactaacgaccaattcagaccacatgacattcctgcaaagggtcaagaacatgctctaccctctggcccygtcctacctttgccatgctctttctgctccttatgcaagccttgcctctgagctttttcagagggaggtgtcagtggtggatcttstcagccatgcatctgtgtggctgttccgaggggactytgtgatggattaccccaggccgatcatgcccaacatggtcttcattgggggcatcaactgtgccaacaggaagccactatctcaggtcggtgttcgtgccttcatccaatcaatgttccaggcaaaacagtttttaaaaattgtatttacttacaattgcttccatatctacttatctttctggtgcttttatttctgcttgtcgtaatagccttcagtgagataaactgttaaggggtctctagtagcgtatttcaggttttaaatggtcaatgagaggaagaagaggcagacatgaatgtttatcaaaggatggactaggactgatgtgactcatggagactgttcgtttgtaaaggcaccatcttcatggttgtgcatgtccttcattgggaaggagcagggacactacattgagacttgacccatctggattttttgtttgcacaattttcaggggaaagatgatgcaacagcaaattacaattgttaatgtgataatttttagtggtcctgtcttgcgaatgatagagaggtgaccacaggagacctaagcactcgcaggaagtagaagtgttaaagaggttgactcagttcagtggaagtagagcaacgaacgtgggatatatgtctgtgattatagaattacacactgagttcagtttccagagagggatctgtgctgacaaaagatttttctggtcaggatttggggtctggtgcatgatgtggggacatctcagagttcggaaggcatagttttggttgcaggtcaattgggtcttctacttggaatgctgaaattatcaagaaattgtggaagggtctagggaggagataaaactgtgagcgtataagcccagttaagctggggacggtgatgaatggacatgtgtccaagaagggaagtgtttctcaggtgaagctgaacatatcaccaaacccaccctatcccactccaagtttctatagtgggatctacttctttaccaacaatttcaaaggcagctttctttaatccagaatatttggggttcattgatgtggtactctgggacctgaatattgtttcttattccttggtgtgccatgtatttcatgagagaattcagcctttttatgtcatattcactgaatgcatatgaacttccatgacttgatccttttgtatttttatttctgtacttctttttattaacataggtattattgccaaacactctaagcttcattttttaaaatcaaaccacatgatttttttattggtgattttctcccttatgcagtgtagttattcaattataaaatatgtgtttattagatttgtaacaatgttgaaaagtgggatggaatttaaatagtgactcttgcccttttcttccagtttttcaatgtgaacatattctctagtgttaactacattgctcaaaacttcactgtcatctcagtggagcagaacgaattgggaactgtggcacagatcactcttgctatgccccttagagaattagagaacactagcaaggctaattttcgagtgtggtaaagaacaggctaatgtattcaatagtgaggccactgactctgtctcaacatgaagtcacactagatttatcatgatttggctctgtatcccccaccaaatctcatcttgaattgtaatccccataatccccacgtgtcaaggacaggatctggtgggaggtgattggatcatgggggcagtttcgcacctgctggtctcatcatagtgagtgagttcttatgagatctgatggttttataaggggccattgtcccttcacttgcaagctcttcctctttctctctttcatgtaagacgtgtctttgcctctctctcactttctgccaggattataagtttcctgaggctcccccctccagccacctggaactgtgagtcaattaaagctctttcctttatgaattaccgagtcttgggtatgtctttatagcagtgtgagaatggactaatatattaaattggtgccatggagagtggagtactgctataaagatacttgaaaatgtggaagtgactttggaactgggtaacaggcagaggttggaacagtttggagagctcagaagaagacaggaagatgtgggaaagtttggaacttcctagagacttgttgaatggttttgaccaaaatgctgataatgttgtggacaatgaagtccaggctgagtctcagatggagatgaggaacttattgggaactggaacaaaggtcacccttgctatgctttagcaaagagactggtggcattttgcccctgccctagagatctgtggaactttgaacttcagagagatgatctgaaattggaacttatgtttaaaagggaagcagagcataaaagtttggaaaatttgcagcctgaccatgtggtagaaaagaaaaacccattttatggggagaaattcaaaccagctacagaaatactggctatagaaatttgcataagtaaggaggagccaaatgttaattgccaagacaatggggaaaatggcttcagtgcacatcagagacctttgcagcagaccctcccatcacaggcctggaggcctaggaaggaaaaattgttttgtgggctgggtccatgctccccctgctgtgtgcagcctcaggacttggtgccctgtgtcccagtggctccagccatggctaaaagaggccaaggtagagctcaggccattgcttcagagggtgcaaacctcaagccttggcagcatcgatgtggtgttgggcctgtgggtacacagaagataagaatttaggtttgggaacctccacataaatttgagaggatgtaaggaaatgcttggatgtccaggcagaagtttgctgcatggatggagcccttatagagaacctctgctagagaagggtggtaaagaaatgtgaggttggagcccccacacagagtctccactggggcactgcctagtggagttgtgagaaggcggccaccatcctccagaatcccaaatagtagatccaatagcttgcactgtgtgcctggaaaagacacagacactcaatgccagcctctgaaggcagccaggaggagggctttgccctgcaagccacagtgtccaagttgcctgagactgtgggagcccacttctggcatcagcatgacctagatatgagacatgaagttaaaggtgataattttggagctttaagatttaatgactgccctgcctggttttggacttgcatggggcctgtagccccctttttttggccagtttctcccatttggaatgggaatatttacccaatttctgtacccccattgtgtcttggaagttacttttgattttacaggctcatgggggaagggacttgccttgtctcagataagactttggactatggacttttgagctagtgctgaaatgagttaagactttggaagattgttgggaaggcacgattggttttgaaatgtgaaaagacatgagatttgggaggggccagagggcagaatgatatggtttgactctgtgtttccacccaaatctcatctcaaattgtaatctccataattcccatgtgttaaggatgggacctggtgggaggtgattggatcatgtgtgcagtttcccccttgctgttctcatcctactgagtgagttctaatgagagctgatggttttataaggggctcttcctccttcactcacaagtgaactcttcctctctgtttctctcttgcttgctgccatgtgagacatgactttgcttatctctcaccttctgtcatgattgtaagtttcctgaggcctccccagccatgtggaactgagtcatttaaacctttgtcttttataaattaccccgtcttgggtatgtctttatagcagtgtgagaacagactaatacaagattggtggtgattgaagttatactgaaagggtttaaaggagagtctgagaaaaggaaatgaatctgcatttattgagaaagttgatgagaaagtggaattagaaattcctagaaaggtaagctgttgtgtgaatgatttcccgagatggggaagtctctctacctgtttggagacagaaagtagaatcagaggagaagaagatgatggacagaaaggatcattccctcttctagatgctttctagtgtgtgatgtaagctgaattaaaatcagctgtgttgaactccagccagaaaaaatatctggcattttggttttttggaccctactgtgatggtcacaggactccaggtctcttggggctcacagggtcatgcctttccttgcccggtgtgcttggtgagaaggaacaagtgtttccatggaggaaattcattttaggggtctcaagagggtcatctttgcaacagaggaaatgcccctttttccattctgaaaacctgatttatcgaacccttttataaaagatgaatacccacatataggcctctagcagtgttatgtttttgagatgagacattttaaaaagcgatttttcaattctaaaaattctttaaataaaatgctcttgctgggacaacatagtgggtcaacatcattcccatctctacaagattttttttaaaaaaacattagctaggtgtggtagctgttgtcttagttactgggaatgctgaggaggaaggatcacttgagcccagaaattcatgtttactagtggggtatgatcttgcctaggcaacagctacagagagagaccctgtctctaaaacaaacaaacaaacaaacaaacaataaccaaacaagctttacacttctgtagaaggaacacttcccatttatgacatcagtaatctaggatatatcaaaatttgaactttgtgttagctttcaactgttaaaactagccagcgttgttacagatccacctctgagtgacactggtatgccactctttgctgaccactgaacaatgggatttatgtaaccaattgtgtagatacaaacccactcattctatcctacccagagtggtgatttacaacacaaaaaactaccatgaaactgttcccatgccttcctcccacctcaaaactccttttattcctgaacggctccataagcaaacccatccccagcaaactactcagtgagtatcttcacacatgtaagttcccttatccggatcactaaaaaatgaactcatttttcaaaagccctgacagtctgtcttattttgatacttcttgtatagttattatttaagaagcaactacccaggcaccttggagcatgttgatttcagagttcagtgtgagaccccgtgtgcccctgtgggatggtgccagctgactgccattttcctgctgtttattacttgggtgccattccatgcagattggactctgagggtactagagcatatccaaacccattgtcacagtatttgttggttaatgatgtgttcaggccatgatttttctgtaaaaaattaccagcatgctgctcttaatttttttcagcctgtctagttgttgcccttttgctctcatgcaaacttttcctcagaggtgaccctagaagatgggaccctttgtgatggactaccccaaggcaatatgccccaaaaggtcttcatttggggcataacccgtgccaacacaaaggtactttctcaattgtgtgtatggtgcctcacccaaacaatattacagatgcacttggctttcatcaacctaatttgatatgccccaagcacagcaataggacagttttgcgtggccctttggaaacgcttttctttacatttccaggacctaccatagttggagaaccacgttagggctgaagacagtcctagtatatcattgaccaaccacataaccccaaggtctgtcctcagccttcagaaggaacatgcttcttacaccgatttcagctcagtgatatgggattcaaatgtatgacctccaaaatattaagagaataacgtgtgttgttttaagccaccaagtttgggtaatttgttacagccatgataggaaacgaatgcatccactttgccaggtttacctgcttttataaagcctgggtttaaccttt

SEQ ID NO: 12521 - DNA, 13100 bp, Homo sapiens
gaatcttttctttatccttgacctttgggagtttgattattaaatgccttgaggtagttttctttgggttaaatgtgcttggtgttctctagccttctcatacttgaatataggtatctttctctaggtttggaaagttttctgttattatccctttgaataaactttctactcctatctctttctctacctccactttatgggcaataactattagatttgcccctttgaggctattttctagatcctataagcatgcttcattgttgtttattcttttttcttttgtctcctctgaccatgtattttcaaatggcctgtcttcaagctcagtaattatttcttgtgtttggtccattctgctattaaaggactttgatgcattcttcattatgccgattgcatttttcagctccagaatttctgcttgattctttctaatgatttcaatctctttgttaaatttatatgctggaattctgaattcctcctctgtgttatttggaatttctttgagtttcctcaacacagctattttgaattctctgtctgaaaggtcgcttatatctgtttctccagcgttagtccctggcaccttatttaattcatttgatgaggtcatggttttcctgaatggcgttgatgctagcagacattcttcagtgtctgggcattgaagagttaggtgtttattgtagtcttcattgtctgggcttatttgtagccgtccttcttggaaaggctttccagatatttgaaaggacttaggtgttgtaatctaagctgtttctgctttagggggcaccccaagcctagtaacgctgtggttcttgcagacttgtagatgtattgccttgatggtcttggacaagatccaagatacttctctggattccagcacatactcttgctttcttcccttacttcctcccaaaaatacagagtctctctctctctctcactctctctctctctctctgtctctctctctgttctgagccacctcaagctgggggtggagtgacacaagcatccttgtggccatcaccactatgactgtgctggatcagacctgaaaccagcacagctctgggtctcacccaaggcctgctgtaaccacctcctggctactgcctatgtttgctcaacgcccttgggctttacaatcagcaggtgatacagccagccagacctgcatccctcccttcagaatggcaaggtcccccaggccctgggtgggtccagaagtgccatctaggagtcagggactagagtcaaaaaccttagcattccacctggtattttattgtattgcagctgagctggcactcaaaccacaagatgcagtccttcccattcttccctcttatttgcaaagacagaggagcctcaccttgtagccactgccacccctggccatggacagtactgccagacttctgctggtgttcccttaaggcccaaggtcttaagtcaacttgtggtgaatgctgcctggcctgagacttgcccttcaaggcagtgggctcccctctatcccaggggagctccagaaatgctgtccgagtcaagtcctggaatcagggaccccaaaagccctcttgatgctctatccccctgcagcagtgttggtacctaagttataaggcaaagtcccctttacctttccttgtgctttcctcaagcagaatgagttttgctccatagccatcacagctgagaatgtgctgaatctcacctagagccagtaagtctcagaggctcaccaaggcccttgacgtagtacgaggtttcactgctggtattcaggttccaaggtctcttcagttagcaggcgatgaacgctggcaggactgggccctttcttttaaggcagcaggttcccttctagcccagggtgtgttcagaaatgtcatctggaagctagggcctggcacaggggcctcatgattctgaccagtgccctatcctgctgtggctgagctggtctcctaaatgcaagacaaagtcctccccacttttccctctcctctcctcaagtagaaggaaagggtctcttttggagccgcaagctgtgcatcctgggattaggggaggagtgatgtcggtactcccttggctgcttcagctagtgtttcagtatgtcatactcccctttacccagttcactgtctctgggcctagtacagccctagaactcacctaagagttgcaatctttatggactagactgcctttcaagtttacttgaggccaagaccattttggccctcggtggtgaggtctgtgggcattcaagttcagacctctgagatcagcaatttccctcagcctagggctggtttaaatgctccctcaatgctgggcacggtggctcatgcctgtaatcccagcacttagggaggctgaggtgggtggatcacttgaggccaggagtttgagaccagcctggccaacatggcgaaacccaatctgtactgaaaatacaaaaattagccaggtgtggtggtgcatgccggtaatcccagctactcaggaagcagagattcgcttgaacctcggaggcagaggctgcagtgagccaagatcataccactgcactccagcctagatgacagagtgagactccatctcaaaaaataagaataaataaataaataaataaataaacgctctctcagtgggtgggtgtcagctgagtttggtctgggtttcctttctgctctaacagaatagcactgatttcagtgcctcccaattgtctcccaccagggctcagggattctctttatgccacaccgccactgtgggttcagggggttgggtgacataggagatgcagaacttttttttttctatttcttcagtgtctctgagttatataaaatgaaaaccaggtactatgagtgctcacctgagttttggttcttatgaaggtggtttttcctgtgtagatagttgctaacttggtgtcttctctgtccagattcttttccagtattgacaatcctttacatagaaaactgtgtgtaatgagttctaaaggttcttatgacccctgattgagaagctgaattagagatattgggtttgggagcaggtagaccactttgacacctttagggttctgggtggctagggacattgtccaatatcaaaagaactttaaaaaacaatcccttactggcaatgcattttctgccttcagggacaaagcatcgatgaaagcaatccagaaaaattgttcttgttgactaggcttcttgagagacttattcactatcaagagaacagcatgggaaagacctgcccccatgattcaattttcccaccaggatcctcccacaacagtgggaattgtgggagttacaattcaagatgagatttaggtggggacacagccaaaccatatgattccaccctggtccctcccaaatctcatgtcctcacatttcaaaaccaatcatgccctcccaacagtcccgcaaagtctcagcattaactcaaaagtccacagttcaacgtctcatctgagacaaggcaagtcccttccacctatgggcctgtaaaatcaaaagcaagttagttacttcctagacacaatgagggtacaggtattgggtaaatacaccattccaactgggaaaaattggccaataagggggctacaggccccatgcatgtcagaaatccggcagggcagtcaaatcttaaagctccaaaatgatctcctttgactccatgtctcacatccaggtcttgctgatgtaagaggtgagttcccatggtcttaggcagctccacccctgtggctttgcagggtacagcctcccttccagctgctttcacagagtggcattgagtgtctgtggcttttccaggtgcacagtgcaaactattggtggacctaccattctgaggtggagggatggtggccctcttctcacagttccactaggcagtcccccagttgttgctctgtttgggggcttcaaccccaaatttcccttctgcactgttctagcagaggttctctgtgagggtcctgcccctgcagcaaacttctttctggacatccaggcatatccatacagcctctgaaatctaggcagaggttcccaaacctcaattcttgacttctgtgcacccacagtctcaaccccacatggaagctgccaaggctcggcacttgcaccttctgaagccatggtgtgagctgtactttggctccttttggacacagctggagcagttgggatgcaagacaccaagtccctaggctgcacacagcagggggccctgggcctgtcacacaaaaccattgtttcctcctaggcctccaggcctgtgatgggagggactgctgtgaagacctctgacatgccctggagacattttccccatggttttggggattaacattcggctcctcattacttatggaaatttctgcagccggcttaaatttctcctcagaaaatgggattttcttttctatcacattttcaggctgcaaattttccaaacctttatgctctgtttcccttttaaaactgaatgcctttaacagcacccaaatcacctcttgaatgctttgctttttaaaaatttctcacaccagttaccctaaatcatctttctaaggttcaaagttccacaaatcactaggtcaggggcaaaatgctgccagtctctttgctaaaacataacaagagtcacctttcctccagttcccaacgagttcctcatctccatttgaaaccacctcagtctggactttattgtccatattgctatcagcattttgggcaaagctattcaacaaatctctagggagttccaaactttcctacattttcctgtcttcttctgagccctccaaactttgccaacctctgcctgttacccagttctaaagtcccttccacgttttcaggtatcttttcagtagcaatccactctactggtaccaattgactgtattagtctgttttcatgctgctgataaagacatgcctgagactaaggaatttacaaaagacagaggtttaattgacttagagttccacatggctggggaggcctcacaatcatggcaaaagtcaagaaggagaaagtcacatcctccatggatggcagcaggcaaagaaagagagcttgtgcaggaaaacttccatttttaaaaccaccagatctcgtgagacttacttactactatgagaacatcacgggaaacacccagccccatgattcaattatctccctccaggttccttccatgacacgtggaaattgtgggagttccaattcaagatgagctttgggtggggacacagccaaaccatatcattattgaatttgatttgctgaaatattgttttacattttcgtatctaaggtcatgaggatctgtagtttttgtatcttgtcacatctttatctggttttggtattgtggtaatgttggtctcacagaatgaattagggcatttcacatccttctgttttccggactagattgtgagaaattggtattatttcttccttcagtgtttggtagaatttatcagtgaagtcatcagaactttaccgttttgtttgtgggaacatttgaagtcaaaattcaatttgaatttaaaaggtacagattatgtcatttgtgttattaatttcttcttgtgtaaagtctgacagcttgtgtcttttaagaaatttgtccattccatctaagttgtagattttattggcatgaacttgttcatgtttcttattgttttaatacctgtagaatttatggtgatactactgctctcattcctgatattggtaatttatatcttctgtcttttttcctaatcagtctgggtagagatttatcaagttaattgatttgccccaaaagctagctttggtgtcattggttttctccattgtttttctatttcctatttcattgatttctacactgaagttagcctccagggaaggtagatcactcactgcccatggatgggagccactggttcaccatgtggtcggtggtggagaaactcattctcagggggcatgaggtggttgtagtcaggccagaggtgagttggcaactgggaagatcactgaattgcacagtgaagacttcttcaaccttatacaccctggaggatctggamcaggagttcatggcttttgccaatgctcaatgggaagcagaagtacgacgcttattttctctattaatgagttcatccaaatgtttagaatttaatttttcacattgcaggagtttgtttaatgactgaaaattagtagaatacttaaargagagttcttttgatgcggtgtttctggatcctttagatatgtgtggcttaattgttgccaaatatttctccctcctctcggtggtcttcgccagaggaatactttgacattaccttgaagaaggtgcacagtgccctgcttctctttcctacagtcctagatatgtctcagggttttcggatgctgtgactttttattattattattatttttatttatttatttatttttgagacggagtcttgctctgtcacccaggctggagtgcagtggcgtgatctcggctcactgcaaactgcacctcccgggttcacgccattcctctgcctcagcctcccaagtagctgggactacaggtgcctgccaccacgcctggctaatttttttttgtatttttagtggagacggggtttcaccgtgttagccaggatggtctcgatctcctaacctcgtgatccgcccgccttggcctcccaaagtgctggaattacaggggtgagccaccacacccagcctggaygccatgacttttaaggagagagtaaggaaccacatcttctacttagaggagcatttattttgcccatattttttcaaaaatgccttaaacatagcctctgaaattctccaaacacctgtcatggcatatgatctctacagccacacatcaatttggttgctgcgaatggactttgttttggagtatcccaaacctgtgatgcccaatatgatcttcattggtggtatcaactgcaatcagggaaagccagtgcctatggtaagtcattgctcctttagcacattaaaagtattctggatttgaatatttaaaaagattccttacggaactgggatttgacatttgtgtttgttgcatctaaaatttcttttctgtgtaaaaaattattttgtgccatccacgtgtttgttggttagcaacttttatataatggcctcgttaatatgtatgtgtatacgattggttaattgctcataatttccactgcatttttaaaattttgaaacagagtattgctatggtgccctggctagactcaaactcctgggctcaagtgatcctcctatctaagccttccaagcaattatgacttttttagtatttttggaaaagtatttaaaagcacaataagaaatgaaaatttcatttttaactaacctgtactacctgctgcagtaaaatgttctttgcagttttgtatgcatgtgtttccatctgttgaaattatatataagcatatatgtaaatatttatacttattttatgaaaatcaaatcaactatcaggctggacatgttgttctttactatgcgtttttacttgccagtaaaccagagacatcttcacagatttgacatgttcttttaataattgcataaaagtctttactttggatgcaacatagacacaagctttcccaggtgtttttctgctaaagatttggctaacttcttcaaaacaacaatgataagcagatgttatctttctttgaccctgaagaaagtataaagcagaatgcccttagccacccaaaaaactgttaccatgatgtttggtcttgtccagtctgcttttgatttgactggatcactttcatctcttggtagccattgctttgcttgtgctttgtcttcattatcatactggtaaatctatgtttcatcttctgttacaatctttgaagagatacttcaaggttttttgtttgtttgtttgttttgagacagagtttcactcttgttgtcgaggctggggtgcaatggtgcgatcttggctcaccacaacctctgcctcctgggttcaagcgattcacctgcctcagcctcctgagtagctgggattataggcacatgccaccacacccagctaattttgtaattttagtagaagcagggtttctccatgttggtcaggctggtctcgaactcctgacctcaggtgatctgcctgcctcggcctcccaaagtgctgggattacaggtgtgagccaccgtacctggccaaggtctggatcccacttgtttataatttccattgaagggtttgttcttgtctgcagctgatctggctgcaatgattttggcacccaacaagtagaaaatttgttcaactgaaatttttgtcagaattgtgtaaactgtcctgactgagatatctattgtgttggctattgtttctgctgttaattgtcagtcttcttcagttagagcatgagcaagatgaattgtttccttgcaaattggtatggatggtctgctggtgtaggctttatttgcaaccttgtcctgtcccttcttaaaaggaattactcatttgtaaactgcaaatttcttttgaccatttttcccattaacttttttttaaagcatcagtgatttcaccattcttccactcatatctcagcataaattttatgctattgcttcaattgctgcagaattcatgttgttttgatgggggcttttttccaactgatgtcctatccttcttagtgcctcaaactagatcctattcagacatgttttaacaagttagtaaaagtttgtttggcacaaagaaatttgaaatccatgcttaagtttttcataatatgaattttcatgaattgtttgatgatccctcatctattacttttttagcaatggaccatgcaattttggctatgttctggcttcttacaaggttcagtagactttgtaacacagttgtatgtctcacacatcggcagctgtttggtaaaggattgacttttagccaactcatgggaaaatgaaataatgtaaaaaacaggaagactacagttttagacctttcaagtgaggcatggctttcagctcttggcaagaacaggcgaggagatgcaagcctctacaaggctagacttttcaaagtgcttctctcccctttaccctccttcagttacagcaccaagcaccacccaggtattacctgcagcctcaccctctacccagttgtgggatcctgccacttcctgaacccacactgagttccttgtggctcacagggtcacccagagggcttccgagatacggaaagctatgtgtgattttatatcacctatcatgttaagatatgtataaaataggaaacatattggccatatatcattttatatatttttggttttacatgtctaaaaaatacatgtttttttgtatgtattaaaggataggtatgtataagaggttttatagaagtggaaagttatattttttgcatatctttatgaattataataaaggaaggaaaattctcaaagaggaattcagatatcaaagagtgccctttgacaaagagccttggttacaacatacctacaaaagtgaactgtcattgaaagacctatggacactggatttctctttccttatttagaagggcaggctgtgtcttggaaaagcatacagtttgttgtatcttgctggacaacaggagtcatagtctgaagtgtctgatgagaaggaagcatcacttgatggagtgtgcatctgtgcctgtgtgtgtccacgcgtgtttgtgtgtgtgcatgcacacatgtgtcagcatgcagtgtctcagatcctacataggggtttttcctgaaggtctccagtagcaaaaactcattgagtctatccaggggaattacatccaatgctgtaattaaatactttaacaaagatagcagatcatcattcaagagaacatcaagatagttttaattaagaaaaaaaaaaggaatcactgccaggcttttttagtttttggtgagttccagcagaattgatgactaggtccagtaggaaggaattcaggattactctttaccatccagggtgagtgtagctctggagaactggggatgggaggtgactgcacagcaagaaaagatctgggcttcccccattgctctaagatctggttccattgtgagattcaaattaagagtaagctgttaatgggcaagtccaaggcctctcaccaggattatttatttcaacttttttttgtcaaagttttcaaatgtatagcaaggagagactacagtgtaatgagcacccatatatccatctttgtgttacataattttcaatattttattatactgattcatgtatctgctcttttgttctttttttaaaaataaattttggctataattttttaatggaaatgctggagatatcattctatccccaaatacttcactaaatgtaagaaataaggaaaaaaggaaaatttgttacatagccacaatatcattatcattcctcacaaaatcaataactctttaatattgtctcactcataatgcataatgaaatttcccctaattgtctcaaaaatgtcttgtacatgcagatcagtagaacggagttgagaatccagatataaacccatacatccttggccaattgatttttactgtggtgccaagactgttcaaatgggaaagaataatctcttcaacagaggtcgctgagacagctgcatatccacatgcaaaagaatgaagatgcacccttatatgcaaaaactaacttgaaatggatcaaatagctaaatagaaaagctagaagtgtaaaagtttagaaggaaacatttggggaagtatttatgacccagatttggaaatggtttctgtgatgtgacacacacattgttgtgtatgagaaacaacaacaacaaaaaacacagacatcaaaataaaacacttttgtgtgtcaaggacactatcgagagagtgaaaagtgaacccacatggcctctctaagatgtgcaagtaaacatgtacgtgcctgacatggaggctcctgggaggcaaccacagtcccaaaagacctgaaatttcaaaatcctgaatgttaagagcctgagagatcaacgtcctacaaatgtaattccagaaaaaataactttaaaaattatttatttgaaagataatctgtttacgttttaaaaggggatttatttgaaaaacatataaaaacacgacagaccacttcataggccactttacaccataaaataggtaataacaacatacaggtatctttgcaagcgtaaaccctcaggtgtactaatgaccttcatataggtgtatcaattgtgagaagatgaatcatattcttaaagtaataggttaaaaaaggaaaagtatcaatatttattactgtggttggtaatcttgtgcactcaggtttgcagctttgatcatctgaaataccatgaaaaatgacctgagacttatcatgaggtcagtcagaaacctctatgggtcaccaccgcatacacagttgcttaaagtgcccaagtcttgagaaattttgttttgttttgtttttttgagacagagtctcgctgtgttgcctatgctggagtgcagtggtgcgatctcagcttactgcaacatctgctgcccgagttcaagcgattctcctgcctcagcctcctgggtagctggaattacagatgcccaccaccacagtcagcaaatttttgtatttttagtagacatggggttttgccatgttggccaggttggtcttgaactcctgacttcagatgatctgccctcctcagcctcccaaagtcctgggattacaggcatgggccaccacgcccggccaagaaatgttatctttcacagatgcagatgtacaaaagggacatctcttcattattgaggacatttcaacatttgtacgtacatgcctaatgcttacacacttactcttgtgctaatgcacttccatggagtcaaatttgtgagcataaaatgaattagaattctccataagtctatacacagtctctgccttcagtattggaaatgatatgaagatgaaatacatagcatagcaaattgtaaaaataatgctgacaatttaaccttgtgaaaaaacctaaaaagaagaaaaagtaaaagaaaaaaaggaaaaaaacctccaaattaacctattctgtgattgtgatttttgggattttagctgttagagagtttagatttcagggagttagaccttagggatttggatccttagggaatcaatatttcagaattcaaccttcaggattatgtgttttggggttatgtctttcaggattgtgatccaaaccctatagcatcttgtttcttagcataacctgtactaatcgtagatatatctctgtactccagcagagcatcataaaattaagtagtttacagcagagagtctcaacctatcagtgattaaggaatagaaaaaaacgttttctgcagttgattatatattcataattgtttgtaatatataacaaaaatgaaaagctagaaagtgaaatgaaataaaccacagccctataaaatgcaaaactactgatgattgcttggcgacatagcaacaccaattgctacaggaatttctaagcatttcctgcagggtctgcacccatgctgaggtggttaggtaacacaacgagctgcaaaccacatcttgaacagactgttttagacccagtccagtggctctatgtgagtagtgtttaatcagaaataaggcccagcacagtggctcacgcctgtaatccctgcacttagggaaactgaggtgggcggatcacctgaggtcaggagttcgagatcagtctggccaacatggcaaaaccccgtctctactaaaaatacaaaaattagcacagtgtatggcgggcatctgtaatcatagctactcgagtctgaggcagaagaatcacttgaacctggaagatggaggtt

SEQ ID NO: 12522 - DNA, 13815 bp, Homo sapiens
caatcacagatgacctatgtggctgatcttaggtccacaccctcccagaagtcaggttttaactttagcctctagttctggaagtttctggcctatcatagatcacagatctatcatagttcgtatttttaggctgtccagtggccaaaggacccaagcaaacaaagacactaccattagcaagatattccagaagcccagagctcaccctccattagcttgaacacaaaggccaaaactccctttgttcaattatttactatacaataaggacttggcattttctacaaggtgaaagtctaaaggaaatctgtaaactccaatccaagtcctgttcagacaatatcactttcaactccctgtctccaaatctatattcaaacaccagttcagctatctgttcattgagaaccatttgaaagtcctggaatcctgccatattcccaggatgtctaggttttattccaagttaaatccagactgccacaaggctgaaattaacttgtgttggtccctgtgtttactgtttgcttagtctattccgtaacagtatataaggagtccttcaagaaacagccacaggaaacctgcatctgaatttatgagaaggctgctattctggacaccatccaccacatcaactctaggaagaaccactgaagaaatttcctgagaccaaagtgccatgaaataatggcaacccccaggaagtaatctgttttatcttcaaaaacaggacataccatgtaaattatgattttcttgtgacattggctgtcagagatattagatgcaagctgacagctaatataatccacaggatcctccagccatgcatggtgtcacaaaattcataatttagtgttaatgctatgaacattatattccttatcctactattttgcatgatattgagtttaaaaactaagcttacttctctccagatcctgctttttgaaatttatactttttatattagtgaaattgatgtttataggcttctacaaatctattatggaacaaaggaaagaataaaacaaaccaaaagtcagttacctgggcctggatcattttcttctgttcttggaagacagcattcaactgggatggtctgtctttgtatcttctggccttctcttcagaagtctcagttttcaatcaagtgtgccccaagaaatggtgaaccccaaatccacttcctccctcttcaggttatgttttttgctcctgaggagtcagaacctgtgggttgaagagcaaattcaatgtaagtggtacattttttccaggcccagatactgtcactgctgctaggcactcatcttaaagcaatgcccccaatatagttaactatatacctttgtttggagccccagcggattttatacctgtggccaataatgtctaggattcttaatgtggtggaggtatgcctttcctctgtgacgtttccgtggaaggactgtgaaggcaggtaggaaatgagacccaccatagcaccagcctcaggagatggtgaactcttaggcagattagttttagaaaagagacaatcagcaaggagaggacctggtctttgttttcctttaaatcatgtgtgctcccacacctcttcaaaagtctttgtacatacaccctgtgaagacatgtacttcagtttgaaagccaatgtactgggcaaatcataagcattgtcataaaaacagtactgacaatattttaggaggttttaaatacataaaaagctaaaatacacaataatttactggataattaggtggtgaataaagttgacgtgctctaaggtttctgtagaatggaaaagtgccaattagcagaagaatatgacaaaggttgcacactacatgtaatctctagttacaattaacactagtaagtccaggcacagtggctcacgcctgtaatcccagcactttgggatgccgaggcgggcggatcacctgacatcaggagtccgagaccggcctagccaacatggtgaaaccccatctctataaaaatacagttattccagaagctgaggcagaagaattgcttgaatccgggagatggaggttgcagtgagacaagcctgtgccattgtactccagtctggtcaaaaagagcgaaacctcgtcttaaaaaaaaaaaaaaaaaaaaaaactagtaattgttttaaagtacgtaagttccatgccaacaaaagggggaaatgtaataacaagaaattcatccaaaagaagagaatcaaaaacagagcaaaaagagcaaatacaatgcatttagatagctgttttaaaataaaatgtactaagaaaattacattacattaagtattttatgctaagtaaaaacagagcatggatcccagttaattacattaaatataaatgcctcaaaactgtcagaatggattaaaaattaaaatccaataacatctggggtttattttattttattttaatttttgagatggagtctcactctgtcgcccaggctggagtgcaatggtgtgatctcggcctcccgggttcaagcaattctctgccttagcctcccgagtagctgagtttacaggcacctgctgcagggagccgaaggctcgtggcccgtgggacgtgaccaactcagcattccactggaggctacagatcaaacagcaaactgtttatcatgaatgcaggatgtcagcaaactcatgactgctccggctgatgaaggtttgctggaggcaatcactccctggcgccgttatctactgcgacatctagagaatgcagtcttgcaagactactctggacccctggcgccgttatctactgcgacatctagagaatgcagtcttgcaagactactctggacccctggcgccgttatctactgcgacatctagagaatgcagtcttgcaagactactctggaccgagcagctgaccccttcttccacctccccttctcactgtctcttttgcctaataaatatgaagggctgtgtaaagctcagggcccttgtcccctagaggcaaagcgcccccgatcccttcttccaaatacactcttttgtctcatctttattcccgtgttcaccccactttgtttagtccacctaggtccgtgcaggttacaaatggcaaccagaacagggactccaagcacgcccaactagcagcatccaaacatgggacttcaaggacgtgaatgaagaaggtctgctggagcagaggaactgaaattgacaaggcgaaaggggaccctgggaagagtctgccggcagcagatataaggtcagtgccctaaagaggtactgggagcagtgctttaaagaagtactgggaagttttctgactcagggtaacaagggaaagaatttgtctattgaagaaaaacattatgtgcagttgcttaaagttctgttgagacagtctgcagctcaggttaattcgcagacactaacctcctgcagaagccacaaaaggttattacacataacccatcgtttccacaggcaggcactcttgatgtggaaaattgggatacagcaggagaaggattaaaacaggctcatcaaaaaggtcttaaagtcgattcttctgttttctccacttggagtttagttcgtactgtacttctgccattatctcattattattctgcaggacagcaagctgaatctaaaaatctgaaagaatttgttgacccacccacagctccaattaaaaataaaaaacaggagagggaggataaaaattggcctatactgcctccttcagttgcagaaacatctgtactgcctccttcggtggcagaaatagaaaccctaatacaaagaatttaatgctctgctgccatagctggagagcccttaggacattgtgcttttcctatttccatcaggcctgatccaaaaaatccacagcaggttattcatgaacacaccccactagagtttaagttgttgaaggaattaaaagcaagagtggtaaatgatggcatacagagcccattcaccttaggattgctagaatctgtgtttggtgctatgcgttttttaccctttgatgtgagacacttggcgcgaacttgcttgtctgctagtgcatatctgacatggaatttaaattggcaagaaatgtgtgcagaccaggctaaacagaaccatgctgctggacacggagacattacagaggatatgctgttaggtcatggcccttattcagatgtagaacgtcaaatggcactcccagatgctgcttatcagcagtgtacacaggccgctaaatgcgcctgggccacaatcctgaagagggagtccctgtacaatcctttttacatatcatgcaagggttgcaggaaccctatgcacaatttcttgcaagattacatgaggcactgaagcgtcagattcctcatactgtggctgcagaaatgctaaccttaactttagcttttgagaatgcaaacgtgtactgtaaacgtgcactggcaccagtgaggtgtacaaaaaacttgggaaattttctcagagcttgtcaggatgtaggaactgagattcatcgatctgcaaagttagcataagcaatggctaatttagcagttgacaaatctaaaaggagccaagggtcaaaccctaaagtgggaaaatgttgtaattgtggaaaaactggacatctaaaaaaggaatgccgccagatctcaggacagaaaggatattacaatgcagttcactccctagcagaaaaaacagcaggactctgtactcgccataacaaaggaaatcactgggctacccagtgctgctcaaaatttcatcagaatggcaccccattggtaaatgagatgggggcctgcacccgggcccctcaaacaatgagggcattcccaatgcagaccacaaccccacttcagggatgggttcctggaggcacattgattccctcaacccaggaacaccaggaagtgcaggattagatctacccaccagagaaagaatcacattagttaggggagacaaacctatttgggtatttggggacctttaccgacaggatacacaggactaattttaggtaaaagctgccttaacttgcaaggcatcactgtagtcctaggaatgactgactccgattatgaaggagaaattcaagtagttttaatgtcacaaaatctttgggtttttgaactgggagaatatattgctcaattattgcttattccctgtgaattacacccttccccatgaaaagagaaatgaggaaataaagggtttgggagcacaactacatgggaaatctatctttcccaacccatagcctctaatagacctacctgtgtagtacacattaaaggaaagaaattttatgggcttatggacatgggagctgatgtgtcagtcatatctataggatgggcacatcaaacattacaacgcatgttgaaaaaacaaaaagggggtataggaggccaactaccacctcaatcaaaactacatttagccttatttactttaaattttctgactcccggtatggatggtaagactccagcagaaagacattggcaagtgttagaggaaaaaagcaaagtttatctgaaagtgttatggaaatccccagaaggacaacaatggaaaggcccggtagatttactgacctggggaagagggtatgcttgtgtgtttacaggagatgggacaagccatgtgggtgccctcaaggtgcatgcgaccatggaatgggagactggaggaacccagggtggccaaccatgggcccagtccctcctgtacgagctatgagtcagctgagcctgagtgcaaagatggagagaaggccaaccagagtcatgatgacatcaacccccataacctggggacaactcaagaaaaccacacaggaagctgagaaactactggagtgtcagggacaggcaaaacccctgattccatgctcttggccatgttagccataatgtcctgtgcactacgttttccctgtgcacaggcaaaaacatattgggcatatgttcccaatcccccagcagtatggcctatactttggagctcactcctcctgagatttatcacgatcagggagagtgggctccaggacccctaactccccgtgacatagaaaagttagactctcagaacaatgtcattaattataccactccactggaaggactccctttgtttatcaccacaaagacgtcgctcagccatagctgtcttgcaattcaagctcaaacatggttgagtcactatggaaaaattatgtacttattaggtcttggttctattaatgtaactggtgtgctaaccaatcattcccagtccagtcaccctaattgtgctgattatacagaatggattccattcaatagttcctaccccactctgtggacccagtgtcttgatccactggctagtaaacaatatatgtcaactgaagacactgtggattgggaacctaaaggtcaattagatggaaaaggtgaaagtcagaaatcatggcacaaacttcactggcattggcggcaagcttttaatgcttcttctttatacaacagcagaatccaatcccagtctgctgctcagattgcttggcatggagcaggctttagcccacctcttcctcagttgcattatctggggaggaaaggaccaattcaagaaactatatggaaggcagcactcccatttatgaatggcaacatctggattggaacactgtctaataatagcaatagtaagcaacacagtcttaatgttgcatttgtaaagaatatcaccactcagtttacagtttgtgtttttaatccttatgcctttttggcagctaagaagaaccagcttcaggtaaacaatacccaattgacctgtaaatcttgccagttatatcacactgcattaatcatagcacattacgaacacataatatctctactttgataatgttgggttgcatccctgggctatggattcttgttaatctgtctgagccttgggctgccacacctgctttgcatttttgtaacacttcttctaactcascttactcactgtgtccatagagccttaggcataatttttgctattgtttccttggtcaaactaataacttctgttgtgatatcttctgtaactctgcataattctattcaaacatctcagtaggtggagaactggacacgcacagctgaccaagcgaggctacttcagaataaaattaacactgagttacaaactgaagtggcaatgttgaaatccatggttctgtggttaggagaacaggtacaaagcttgcagttgcagcagcaattgcgtcatcattttaatcacattcatatttgcgtaactaactcagaatataaccaaagtgagtatccgtgggaccttgtgaaagcccatttgcaaggagctttcacatccaacatcacctttgatattggtgaattacaaaacaaaattattgatttaaataggcaaactcaagaatttcagccttctttagaagaytggaccgaattccaggaaggcctggagagcctcaacccttggacctatctaaggcaccacattaacatcttatatgtagttcttggaataatgttgttttgtctctgtcttcggtttatagtctgtaaaatcggatggaccaccaattggagaatgagagcykcccagcccagccttacattctttcaattaatacataaacagaaagggggatatgcagggagccaaaggcctgtgggacgtgaccaactcagcattctgctggaggctatatgatcaaacagcaaactgtttatcatgaatacaggatgtgagcaaactcaggactgctcctgccaacataaggtttgctggaggcaatcactccctggcaccgaggttatctactgcgacatctagagaatgcagtcttgcaagcctactctgaactgagcagccgaccccttcttccacccccccaccctcctatctcttttgcctaataaatacggagggctgtgtaaagctcagggcccttgtccactagaggtaaggtgctccctgaccccttctcccaaatatactcttttgtctcctgtctttattcccacgttcacccccatttgtgcagtcccatgggtccatgtgggttacggcccgccaccgcgcctggctgatttttgtatttttagtagagatcggatttcagcatcttggtcaggctggccttcaactccggatctcatcacacacccgcctcagcctccccacatgcggttattatagttgatatgtctgaaccaaaatgatatgggaagcttgagaataaaaggttggagacaatatgccacagagagagtaaccaaagataatctgttataactatatctcagacaaaactgaccagaaatcctaaagaattaacagagagaaagagaaacaatgctcactgaaaagaggtgaaatttggctcttcattcatagaaatacaccatatgtatacccctaacaacagtcttgaaatgtatacagcaaaaaatagaaccaaaaacaagaaatagaaaattcagactaaagactttaacagacctttcctagtaactgacagaacagaccatcaacaaacaaaataaaatttataaatgagaaagaaatgaatcttttatctgaggaatgtgactccctttaaattatcaggtctagagaggcattaaaatgtgacagcagtctttctgataggggttcccctgaaaaaaagaaaaaagaaaaaattaaaaactaaaaaaaaaatttaatgtgacaatagtcacatctcatttccccctcaagctaaataattatctcttaaagccacttgctatgtaggctctagactaactcacactgagtagccataaaatgccattcactggacatcctaactcataaaaccccatagttaacaatgtacagccaattgttaattgatattatttctgtaaaccaatgagaattcttgccaaacaactttatgtcagctcacggtttgttcccttttgactttaaaacctgtttctaacaaaatcctaacagagcacttaaccaaggcaacctgaaagtattttcccaggcagctgtcctcattttggctcaagtaaactctttaaaattgtattttgtgcagtttcctcttttaggctgacataaacgatatcatttagaagaactcgaatatatttttaaaattagatttactgagataaattttaacagttttaaataaatgcaaagatgtactataaagatgggctggaaaacaaagcattttaaaaatgtcaagtctcccaaatctacagattcaatgaaatcacagtcacaatcccaaactgatactgaaaagtttaaatagctataaacttttttttaaagtttgaaaaaaaagttagaagacttgccatatcagttatgaggacttataaagctactttaattaggacagcacaatattagtacaataacaggcaaataggacaaaggaacagaataaaatccttataagcagaattaagcacatatagagactcaatggcaatgatagcactacagggaagtagataaaagctgtcttttcaataaatggaactaagggcgccgtggctcacgcctgtaatcctagcactttgggaagctgaggaaggtgtgggggaaagagagatcagactgttactgtgtctatatagaaagaggaagacataagaaactccattttaatctgtacaaagaaaagttcctctgtcttgagatactgttaatctgtaaccctagccccaaccctgtgctcagaaacgtgtgctgtgttggctcaaggtttaatggatttagggctgtgcaggacgtgctttgttaaaatgtgtttgcaggcagtatgcttggtaaaagtcatcaccattctccagtctcaagtacccagggacacaatgcactgcggaaggccgcagggacctctgcccaagaaagcctgggtattgtccaaggtttcctcccactgatacagcctgagatatggtctcgtgggaagggaaaaacctgaccatctcccagcccaacactcgtaaagggtctgtgctgaggaggattagtgaaagaggaagacctctttacagttaaaataagagaaagccatctgtctcctgctcctccctgggaatggaatgtcccggtataaaacccaatcatacattctatttactaagataggagaaaaccaccttataactaaaggtgagacatactggcggcaatactactctttactacactaagatgtttgtgtaaagtcaaacataaatctggcctacgtacacatcaaggcacaggacctttccttaaacttatttataacacagagtcctttactcacatgttttcctactgaccctctccccaccattaccctatagtcctgccacacccccctcaccaagatggtaaaaatagtaatcaataaatactaacaaaactcagagaccagtgccggtgtgggtcccccatatgctgaacaccagtcccctgggcccacttttcttcctctgtactttctctctgtgtctgatttcttttctcagtctctcatttccaccttgcaaaaaatacccacaggtgtggaggggcaggcccccttcaggcaggtggaccacttgagccagagttggagaccagcctggccatcatggtgaaaccccatctctactaaaaatacaaaaattagccaggcaaggtggcacctgctggtaattccagctactcgggaggccgtggcacaagaatcacttgagcccagaaggcagaggttgcagttgagccaagcacgccactacactccagcctgggcgacgagagcaagactctatctaaaaaaattaaaaaaaaaaaaaaaaatcaataaatggtactggggatggggacagaaagttaaaacccccctcacaacatacacaaaaaccattttagaatcaactgtcaatttcaatggtagaaacatatcaataaagctttaaagaacattaatataggagaatctctcaatgttattagggtatggccagatattttaaagaggccacataaagcaccctataaagcaaactatatcctgctaggggaactgtaagtggtacaaccactttagaaaacagtttgacatctatttagacggagtttatacacactctatgaagcagcaattttcctccgaggtgcacatctagatatacatctctgcctcccccatatgagagcacatatgaaccaaaagacatttacacaaattttcacacatgcattattcttaataatacaagctttaggtaatacaaatgtaattaataatagaaaaaactgctatattttacataatggaatgtgatagaaaacctattatacctttggtccagcctgcaagaatgctttttacatttttgaaagactgtaaaacaaaaagcaaattagcatatgcaagagaccatatgtagcctgcaagccctaaaatatttactgtaaattcgcctgatccttgtcattgagcaaagaaaatatactcagatgcaacaggaaagaccctcaccaataatgagcaaaagaaggctgacacaaaaaaagagtgatgtacaattccactgatatacagagtttaaaataggcaaaactgtattaactacaatgataaataatgattaattatataaagaaaagcctaaaatacttttcggtgtgagaatggaaaaagactcacagaacaccactggtgtgctgaccatattctatttcttgacctgggcaatgactgcttatacatatattgcctccatgataattaaattgtacatttaaaatatataaatgtagaaaaattaacaaagtaaaggaagagatcaaccataccaaacagtttacctccaggaaaggtgttaactccagacaacacaacgggtgaattttacaggtgggtaataaaacaagaacgtccactaacaccctattttcctactttatactggaaagttgagccaatgcattaagataagaatgaattataagcattacaaagtaagacagaaaattaatgttattttcaggcgatatcatcacgaacatggaaaaagagattcaagaaattacatatttaaaaaagaaaatgctccctcagaaactcccaggcagattttcacatacatagttggctagaattgcaccatacgcctaagctcatttccatgtcaaacctatcactagcaatggcaattggaaccagcaagattggctaagaccaacaaggccttactaagaaactgggatttgggtcgccttgccacagggatgaatacttcacgaaatggagattctgttaagaaagtgtgaatataaggcgggcaagcaacactcactatatattaagaagtgaaggccgggcgcggtggctcacgcctgtaatcccagcactttggaaagccaaggtgggcggatcacctgaggtcaggagttcgagaccaacctgcccaacgtggtaaaaccctgtctctactaaaaatacaaaaactagccgggcgtggtggcgtgggcctgtagtcccagctactcaggaggctgaggcaggagaatcgcttgaacccgggaggcggagattgcagtgagccgagatcgcgccattgcactccagtctgggagacaaaagtgaaactccgtctcaaaaaataaaaaaaataaataaaaaataaaagaagtgaatgcagaggttggcaacattttcgattttgccggccacgaggtctctgtcacaacaactcaaccgctgcctttgcagccatagacaatatataatcggagggtatgactgaacttgaccccccgatctgtaaatagccaccccaaggatcagaagagtagatatatggtttcgaactaatgctgggggctgtgtcgccttttgccccagtaaccgaggttcgaacctcaacccaggacccagggctccaaagtctcgaaagcttcagccctcacaagcctttgtaccacagacactggccccatgcctcttactcatccgaaccacggaccagacactctacagcgatggacatcctcccagactccaacatcactgagttccaaattaaatcctgaacccgaagcagacgccgcatcgatcctaatcgccacctccatcctttacaagcagagtgatccataccttgacagttaggacacggccgttgatcactacagacccttagtcactgtactcacaccaaaggcacgcggaccacagacagggggatcacagactcccaccaggtacctcccaaatgcctataccccggcgctccccagtcttcctgccaaaaactatgtggtccagggtacaccacgtcctcagatctcccaaaccttccactgagacaaaacctgaactaggacaaaaaactttcagggacaaaaccacacactgacctctattttctccagatacacaagaagggcctcaacgttacacttccgtaaactgctcctacttctggagtcctcgcacgggtttatggtccacctacggcggccgaggagaacctaaaatgtttaaaagagcaaggacaagcgcatttacggcatttcctactctgtaaaatggccgcgcccatagccgtggctcctgacggcagccatgtttgaaaattggacgcacagaaggcagtggcaggtttttgagccaggagccagggaagaagagaagtcactgaaatcgcctcgtttcctggcacttaaagtcttgcgaaagggggcagattttc

SEQ ID NO: 12523 - DNA, 17507 bp, Homo sapiens
cgatctttgttatttcttttcttccggcagccatatgtttggtttgttcctgttttctagtttattgaaatgtgacattaggttgttaatttgtgatctttccattcttttgatgtatgcatttaatgctataaactttcctcttcagactgctttttctgtatcccagaatttttggtattttgtggtttcattgtcattcatttcaaaaaatttttgatttccatttttattttatcatcaatcaaaagacgcttcaggagtacgttatttaatttctatgtgtttgtatagtttcaaaagttcattttgaagttgctttccagttgtgttccactgttgtttgtaagatacttggtatgattttggtttttttaacttattgggatttattttgtgtgacaacatatagcctatgttggagaatgtcccacgtgctggtaataagaatgtatattctgcagctgttgaatagaattgtctgtagatgtctgctagatccatttggtctattgtgcaaactatgttcagtgttcctttatttttctggattatctatctagggctgtcaatgaggtgttgaagtcccctgctattgctgtattgttgtctatatttttagatatggtaatatttgttatataaagttggatgctctgatgttgggtgcattgatatatcctcttattaaattgatccctttattattatataattgtgttatttgtctttttttactgttgttgatttaaagtctgttgcctttgatataagtatagctactcttctttacttttgtttcctgtttgcatgaaatagatttttccacttttaacttcagtctgtttctttagcagtaggtttgtttcttgtaagccacatagcgttggtttgttatttttatcctttatgccaatcgatatattttaagtgaaacatttaattcatttactaccaagattaatattgatatgtgtggttttgttccatcataatgttgttatctgtttgctttgtagatttactagttctctattctgcctctgtcaatttttgtggtttgttggagttctgtcatgctgttttatttattttttttctttttgagatggaatcttgctctgtcatccaggctggagtgcaatggtgcgatctcagctcactgcaacctccacctcttgagttcaagcgattatcctgcctcagcctcctgagtagctgggattacaggtgcgtgccatgatgcctggctaatttttttgtatttttagtagagacgggatttcgccatgttagccaggccagtctcaaactcctgatcttgtgatctgcctgattaattgttacatggagtatgatacatgaagcattaatctccaaactatccctattatgactttacattgttactatacagaaagtttcgaaacacagaaaattttattatttggccaatcaaccttcaatagttctgtgaaaactccagcataagatccaaattcccttcattatttggtacctgaattttttccagtcttatctctaacactcgtcagtatctataatacactatagtcacatacacatagaaaatgctttgtgatctaaaattgacaaatgggatctaattaaactaaagagcttctgtacagcaaaagaaactaacatctgagggaagaggcaacctagagaatgtgagaaaaattttgcaatctacccatctggcaggggtctaatatccaaaatttacaaaatacttaaacaaacttacaaaaaaaaaaaaaagaaaacaccaccatcaaaaagtggggaaagaacataaacaggcacttcccaaaagaagacatttatgtgaccaacaaacatatgaaaaaaacctccacatcactgatcattagagaaatgcaaatcagaaccacagtgaaataccatctcacgccagtcagaatgacaattattaaaaagttgagaaacaacagatgctgatgaggctgtgaataaataggaatgcttttacactgttggtgggaatgtaaattagctcaaccattgtggaagacagtgtggcaattcctcaaaaacctacaatcagaaataccatttgacccgggaatcctattactgggtatatacccaaaggaatataaataattctattataaagatacatgcacacatatgtttactgcagcactatttacaatatcaaagacatggaaccaacccaaatgcccatcaatggtagactgcttaaagaaaatgtggtacatatgcaccatggaatactatgcagccataaaaatgaatgagattatatcctttgcaggggcatggataaagctggaagccatcattctcagcaaactaacacgggaacaggacaccaaacaccacatgttctcattcgtaagtgggagtagaacaataagaacacatggacacagagaggggcacaacacactctgaaacctgtcaggtggtgggggcaaggggaaggagagcatcaggacaaatagctaaaaacctagatgacaggttgttgggtacagcaaaccaccatggcactcatatatatatatatatatatatatatatacctgcacgttctgctcatgtatcccaaaacataaagtaacaacaacaacaataacaaaatgctttatgtaggggagaagtgtgtacgcgtatgtgtgtgtgtagtgtcactgttcaaatgaaaatcagaaacgaaaatccattggtgggattttctgagccattttaaaataaatttacattttttttaaattttgtttttctgtaagttattggggtacaggtggtttttggttacatgagtaagtcatttagtggtgatttgtgaaatcctggtgcacccatcacccgagcagtatatactgcaccatatatgttgtcttttctctcttttgcccctctcccatgcttctccacaagtccccaaagcccactgtatcattcttatgcctttgtgtcctcatagcttagctcccacatatcagtgagaacatacaatgtttggttttccattcctgagttatttcacttagaattatagtctccaatctcatccaggtcattgcaaatgctattaatcattcctttttatggcttagtagtattctattatatatatacgtatatgtatatatatatatatacgtatatgtatatatatatatacgtatatgtatatatatatatacgtatatatatatatatgtatatgtatatatatgtatatatatatacgtatatatacgtatatatatatacgtatatatatatacgtatatatatatacgtatatatatatacgtatatatatataccaaagtttatccatttgttgattgatgggcatttgggttggttgcacgattttgcaattgttaattgtgccgctataaacatgcgtgtgcaagtatctttttcgaataataacttctttttttctgggtagaatacccagttgtgggattgctggatcaaatggtagttctacttttaggtctttaaggaatctccacactgttttccatagcagctgcactagtttacatttccactagcaatgtagaagaagtgttccctgatcacctcatttacaccaacatctactgttttttgatttttttattatggccattctttcaggaataaggtggtatcgcattgtggttttgatttgcatttccctgatcattagtgatgttgaacattttttcatgtgtttgttggccatttgtatatcttcttttaagaattgtctattcatgtccttagcccactttttgatgggattgattgtttttttccttactgatttgtttgagttcgttgtagagtctggatattagtcctttgtcagatgtatagattgtgaagattttctcccactctgtgggttgtctgtttactttgacgactgtttttttttttttgtcattcaaaagctattttgttgaattaggtcccagctatttatctttctttttattgcatttgcttttgggtttttggtcataaaattattgcctaagccaatgtctagaaaggtttttccagtgttatcttctagagtttttatagttttaggtcttaggtttaagtctttaatccatcctgagttgatttttgaataaggtgagagatgaggatccagtttcattctgccacatgtggctagccaattttcccagaactatttgttgaaaagggtgtcttttccccactttatgcttttatttgctttgtcgaacatcagttggctgtaagcattttggtttatttctgggttcttattctgttccattggtctatgtgcctatttttataccagtaccatgctgttttggtgactatggccttatagcatagtttgaaatcaggtagtgtgatgcctgcagatttgttctttttgcttagtcttgctttgtctatatgggctcttttttgtttccatatgaattttagaattgttttttctaatgctgtgaagaatgatggtggtattttgatggagattgcattgaatttgtagattgcttttggcagtatggtcatttttacaatattgattctacccatttatgagcatggcatgtgtttccatttgtttgtgtcatctatgatttctttcagcagtgttttatagttttccttgatttgattctccacttggtcactgttggtgtacagaaaagctactgatttgtgtacattaatcttgtatccagaaactttgctgaattattttatcagttctaggagctttctggaggagtccttaggattttcaaggtaaatgattatatcattagtaaacagggacagtttgagttcctctttactgatttggatgccttttatttatttctcttgtctgattgctctggctagatcttccaatactatgatgaagaggagtggtgatatagtgacagtccttgtcttgtttccattctcagagggaatgctttcaacttttccccattcagtattttgttgactctgggtttgtcatagatgtcttttactacattaaggtatgtcccttgtatgccaattttgctgggggttttaatctaaagcgatgctggattttgtcaaatgctttttctgcatctattgagatgatcatgtgatttttgttttaaattctgtttatatggtgtatcacatttattgagttgcatatctttaaccacccctgcatccctggtatgaaacccacttgattgtggtggattaccttttagatatgttgttggattcagttagctagtattctgttaaggactttagcatctatgttcatcaaggatagtggtctgtagttttcctttttggttatgttctctcctggttttggtattagggtgatgctggcttcagagaatgaattagggagggttccttctctatatatcttgtggaataatgtccacaggattggtaccagttcttccttgaatgtatggtagaattctgctgtgaatctgtttggtcctggactttttttatgttggtaatttttaaattatcatttaaatctcgctgcttgttattggtctcttcagggtatctacttcttgctgattaagctaggtgtaagattgtccccatggcctgaaagcttaaggagatatataactcctcgcttctcaggcccagtcccaaggcgcaaggccacttgcgtcagcagtgtgtgcggcagcatgcaccagcaagatagcagaggcagaaaaatagccagtcagaagacacctacccctgaagattgagaaagaggccatatgggtaaaacatagcagttacgtcagactaggacacttcctgtttacaggagactgtaaaacatttgtcccatcctcacttggtgctaacgccattttaagcctcagcccgcctgcacccaggcactcattaagacagcatgttgctccacactgcctcgtgttgtctgttggtgcactctcggggttcaaactgttacaagaaccttatattttggtgctgaaatctgggaggggctcaggtctgcatcccccatggacctagccctccaccccaaagagcaggccacagcagctggacaaaggaaggtcctcagcctccagtcgcctctctgtgcatgcagtcggtcactgatctcgcctactggtaagtttccccagaagcccagttaacagagaaaaatctgcacagcctctcttggtttctccagtccaaagccccaacattggtccaagaaggctctggcatgtgccaggcacccgataattatctagtcttaaggggacgcctctaagccatttaatcctgttccaggaacaaaaaaggcagcagtgatgatggctccttttatcttctccctccggctgtccaggatggcctccttttccctgttctcccaagcccaccctcccttatgggaaactcccggtcctctgttccaaaaaaaaaaacagtcctctaggctgcctcataaaaaaacctgcaaacattaggcctcaagctagatatgtgccctaagcgccttgtctttttttttttttttttttttttttgcaattcagtctggccacaatatgaattaaataatgggtccaaatggcccgcaaatggaacattcaactttgcaattctaacttatttaagcaattaatgctgacgactggagaaatggcaagaaattccttacgtccaggcctttttacactcagatcacaacctgtcctctgcaattcttgcttatctgttcaaatccttcccctccattctagccgccctaatcacctttctcctcccaaccgtacctctttttttctcattaaatccagcagactgctgtccacccctcccagcccctacctcttcctctcaaccatcttctttaaccccccaagcctcctcattgtcttctcagctgccatcttcccagtcagctgtatccacttatttttctacaccgtcccctcctcagracaattctaatattacctatacctattctcctccccaacgccctctcctgaggcttgtaaacctatcctgccaccttacgcctctgtctatcctccactgcctattaactcaaccgcgctttccccttcaaaccctcagaaggaatcagtattttaaaccttcagttcatctcctaatccacccccaatgtttggctcaagctccagaagcttgacgacggccgtcaaaccccacaacaagtccttcttaatttagccttcaaagtcttcaacaattgtaatgaggaaagtaaaaggcaaaaacaggcagagtttcaaatgcttgcctccaccatcaggggccctgcaggcccacggggccgcagctccacacagaagcctcctaaaaatccacctccacctggygcctatttcaagtgtggcaatgaaggccactggtccagacaatgcccaaacccaggtaaagccagcagtccatgcccctctctgcggagaaccccactggaagtcggactgtaagcagctcccacaaggactgcccccatcccttcctgagctagccaaaacctcctacttatatctcatcggccttgccactgaagaatgatggtgccctggaacagacaccctggcaactacctttgcctcatccaagccaarggtaaccctgatggtggcaggtaggccagtatatttttaaattaataccaggcaacctactctgctttacctaatttttcaggaaccacccagtcctcccaggtgtctgttgtaggaattaatggacaagtctccaaacctcgagtcccccctccacttttctgctcccttcacaccttttccttcactcactctttcttagtcctgccctcatgcccaactactctcctaggcagaaatatctttccaaaactccacactactttccacttccacattccccatagtacccaacacatcaacccagacccctctggggcttctaactttcttctactcctccaaccacccaccttaaaacgtgcaactttttcttgtcccccatctgtagttaaccccgctgtttaggatacttccacaccctcagtcgcaggacaccacacccctgtccacaatacccttaaatagcccacccagttcctatcacagaagtagtatgccatcccccaagtagctctcataagcctaaagcctatcatttctcgtctcctctccagtcacctactctgcccaacaaactccccttttaacacaccagttctacctgtgaaaaagctagatggagcttatcacttagtctaggacctcaggctcattaaccaagctgtactcccagtatgtccagtagttccttacccatatactttactttccacaattccctccgataccactcatttttctgttctaaacctaaaggatgcttttttttcataattcctttacactctgattcccaaaacctcttttcctttatgtggaatacccccgacacccacctttcatgtgagctcacctggtgcatactacctcaaggtttcagagacagcccccacttttctgtgtccaaaaggcccttgctcatgacctctgtagcttatccctaaagctgtccactctctttcaatgtattaatgatctgctcctgtgtagcccctctcaaaaaaactgcaactaccatactatctctcttttaaacttcttcccaaaatgcgagtattaggtctcccctaaagaaacaaaaatatgcacccccctcagtcacctatctatgcctaactcttaccccatgaacctgagagctcacaaccgaccacatatccctcctccagtccctcctgcctccgcaaactaagcaaaaaaatctctcttttctaggactagtgggatattgtaggctctgggttccctccttcgctctatctgccaaaccattataccaggctgctaaaggccctctctatgtgccattaaactctgcacagcctattacccaacctttccatctactccagaaggctctcayctcagcctcatcctcactctcccagacctcaccaaacctttctccctctatatmgacagatgatgtaaagttgcattatgtattctaacccagtctaagggacctaccgcccaggttgttgcctacctctctaaacagcttaaagccaccattctccgatggcctgcctgccttcaagcattggtggcagctgctgtcctcacccttgaaagcctaaaactatctctccatgccaacctaacagtttattcaacccataacatcaaaaacatgttagctcactgcagtgtactaagtctcatctctgccccatggctcctccaactgtatgctctattcatagaaaaccccctcctaccaatcaccatactaaccagctcccgtctaaacacagccatgctcttacctgaagttacaaccgcccaagaccctacacacttctgtgtaaacactgttcaaaccttccttataccttttccaaacctaacagaacaaccctttccagatgccccctttacttagtttgtagatggcagctccttcctacatcaaggacgctggcatgctggctatgctatagtgtcaccccacacacacacactattgaagccaatctgctcttgctaagcaccacctctaaaaaagctgaactcgtcgctcttcctcaagctctcactctagcagccagacaacaaatcaacatatattcaaattctcgttatacattctacatagtgtactcacactcgtccatctggaaaaaacgaggcttcctaattgcaaaaaacactcctgccataaatggctctctcatcagcaaactccttcaagctgccaggcttctacagaaagttgccatcatttattgcaggggccaccaaaccccggatgatcctatatcagctggaaataggctagcagatcagataaccaaacaagtagccctccaacccatgcaaggccagtttctgtccctgtcctttttctctcctctttactcctcagaagaaaaggaggacttccaagcccaaaaccttcaaaagcaaggaccatggtatgtcaaggaaaggtgctttattcttcctcactctcaaagccttcctcacctccaaagcctccacaaccctttccatatcagttacaacctctcttgcaacttctctgccctattctcacttgccctcacctttccagccatgtttgagaaattacctagtcctgctctgtctgccactcagtgtcaccccaaggctccttccagccaccttttcctacccaccaagcccagggccaggtacccaggcaaaattaacaaatggacttcactcacatgctggccaataaacggctccactatcttctagtctttatctgtactttctccaggtagataaaagcattcccaacaacttcagaaggtataaatgtcatcacacaaactctcttcatgcatataattctccgttttggacttccaacattcatccagtccaacaacggaccctccttcatcagccaaattatccaaggcatctctacatccttaggtataaaatgggttctccacacaccctataggcctcaattctcaggcaaagttgaaaaaattacgtctgtccttaaagcccaactcaccaagctggctctaaaaactcaccagtcgtaaacaaaaaatctccctttcacccttataagactccacacaacaccaaaagcaccctctttttatagtccctttgaaatcatatatggccaaacttttgtcttggggtctccacccttaccagactctgagccactcagatattacctcycctccttaatccagacatggtctttcattcgtgaagcagcaaataaggccatgcctctccctgttaacacctttttgtcctctgaacgtaactgtcttacaggcacagacgtgtttccagacaatccagatgatgcttctgctacagcgacatggtaaataccaacccgtctctcaacaatacccccaaaattaagattttctttttccaagatgtccacgtcaccccctatgtcatgcctgaagtaattattgagtaagtggtcccttttcccttttctctaaccaaatagacaggaatgtaagattctcccggggcctgaaagcttaaggagatgaataactcctcccttctcaggcccagtcccaaggcgcaagggccacttgtgtcagcagtgtgcaccagcagcgtgygccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgccattttaggcctcagcccgcctgcacccaggcactgattaaaacagcatgttgctccacactgcctcgtgttgtctgttggcatgctcttggggttcaaactgatacaagaaccttacactaggagggttgtgtttttccaggaatttattaatctcttccagattttctagtttatgtgtgtaaaggtgttcatattagccctgaatgatcttttgtatttcagtggtgttagttgaaatatctcctgtttcatttctctgtgaggttatttggatagtctctcttattttcttggttaatcttgctaatggtctctcaattttatttatcttttcaatgaatcaactttttgtttcatttatctttcgtaaaattttttttttcaatttcatgcagttcttctctgatcttggttatgttctttgtctgctgggtttgggtttggtttgttcttgtttctctagttgcttgaggtgtaaccttatattgtctgtatgcactttttcagactttttgttgtaggtgtttagggctatgaactttcctcttagcgcctccttagctgtatccgaaagtttttgataggttgtgtcattattgtcattcattttgaagaattttaaaattttcatcttgattttgtttttggcccaatgctcattcaggagcaggttatttaatttccatgtatttgcatggttttgaaagtccttttggagttcatttccagttttattccactttggtctgagagagtatttgatataatttcaattttcttaaatttgttgaggttcattttatggcctatcatatggtctatcttggagaagttccatgcactgttgaatagaatgtgtattctgcagttgttggatgaaatgctctgtagatatctgttaagtccatttgttccaaggtatagtttaaatccattgtttctttgttgactttctgtcttgatgacctgtctattgctgtcagtggagtattgaagtcccccactattatgattctatctatctcatttcttcattctattagtaattgttttataaatttgggatctctagtcttaggtgaatatttgtttaagattatgcggttttcctgttgtatcaggcctttttaccattatataatgtccctctttgtgtcttttaaccactgttgctttaaagttcattttgtctgatataagaatatctactcctgctcagttttggtgtccatttgcatgaaatgcctttttgtacgcctttactttaagtttatgtgagtctttttgtgttaggtgagtctcctgaagacagtagacggttggttaattcttatccattatgtggttctgcatcttttaagtggagcatgtagggtatttacattcaatgttagtattgaaatgtgaggtactcttgcattcatcatgctctttgttgcctgtgtactttgtttttgttgttgttgttttaactcgtgtttttgttttataggccctttgtaatttatgctttaaagagattctgttttgatgtgtttccaggatgtgtttcatgatttagagcttcttttagaagttcttgtaatggtggctttgtaatggtgaattctctcaatatttgtttgtctgaaaatcacagtatctttccttcatatatgatgcttcatttggctggataaaaaattcttggctgataattgttttgtttgagaaggctgaagataggaccccaatcccttctaggttgtagggtttctgctgagaaatctgctgttaatctgttaggttttcctttataggtttcctggtgcttctgtctcaaaactcttaagattctttccttcatcttaactttcgataacctgatgacaatgtgcctaggtgaagatctttttgcaatagatttcccaggtgttctttgtgcttcttgtatttgcatgtctaggtctctagcaaggctgggaaagttttccttgattattcccctaaatatgttttccaagctttcagagttgttttcttcctcaggaataccgattattcttaggtttggttgtttaacataatccaaaacttcttggaggctttgtttatattttcttattcttttttctttgtctttgttggattgggttaattcaaagactttgtcttcaagctctgaatttctttcttctacttgttcaattctattgctgagactttccagagcatcacacatttctaaaagtgtgtccaatgtttcctgaatttttaattttttttttctttaagctatctatttcattggatatttctcccttcactttttgtattattttttggacttacttgcattgggctttgccttactttgatctctccctgattagcttaataactgacctcctgctttctttttcaggtaaatcagagatttcttcttggtttggatccattgctggtgaactcgggtcggggggtgttgaggagccttgttttgtcatattaccagggttggttttctgcttccttctcatttgggtagactctgtcagagggaaggtctagggctgaaggctgttgttcatattatattttcccacaggctgttccctttatgtagtactctcccccttttcgtgtggatgtggcttcctgtgaactgaactgcagtgattgttgtctctcttctgggtctagccacccagtgagtctacctggctctgggctggtactgggggttatctgcacagagtcctgtgatattaactgtctatgggtctctcagtcatggataccagtgcctgttccagtggaggtgacacaaggggcaatggactccatgggggtcctcagttttggtggtataatggcctatttttgtgctggttggcctcctaccaggaggtggcactttccagaaaacatcagctgtagtagtgtggagagggactggtggtggatagggccctacaactcccaaggttatatgtcctttgtctcctgccaccagggtgggtagggaaggaccattgggtgggggcagggccgtgtctgagctcagactttccttagttgagtcttgctgtggctgcagtggtggatgggggtgagactcccaggtcactggagttgtttaccaaggcagattatggctgcctctgctgagtcatacaggttgtcagggaagtggggtaaagctggtagccacagaccttactcagctctcactcaaaccgaagggctggtctcactcccaccatgccctcagcaacagccctgaacctgtttccaggtgaagggccagtcaggcttgaaaattttcccaaggttttcttcacatttgcaaatgaaaagggctttagttctttccccacctgtgaagtctgcaaactggattcgcgccctcccctgagttctggccttgagacttctcgccctgttcaaattgttagaaatttcagctagagaagttcttctcattgtggagttttaccccctgctcctctggccaccctcctgatggatccctgtggtgccaggcaggaattgtctgcttggggatccagcgagctcccagtgcctttctgctacttcctctatccctgtgtttcgctgggtttggctctctaacttgactcggctccaggtaaagttgggaacttctcccacaaacagaccttcagcttctccattggggatgtctgtttgggagaggagggtctcccttttccacttccatggttggggcactcacagtatttaggttgtctcccgtgtcctgcaggagcagtctgcttcctttagagggtctgtgggtcctctcaggattgctggtctgttattgcagtcgatctggagctaaaattcacaatgcaagcctccgtatgctgctctgtccggagctgcaatctagtcctacctcccatcaaatttacacattttaaaataccatttacttcctaatctgacaggatatcaaaccaggttcgtccagctttcctgtctgacacctctttagtttccttggtaacaaaactttgctccatgattccggtaacaaaactctttagtttccttggtatcaaaactctgctccatgattctggggtctgattttgaataaatgcaacgtcagaagcaagagtgagctgagtactttacagctgtggaacctaaagcaaaaaaaacagacacagcatcccaattctaattctgactctgatttggattcagatccatatttcccccagactctacagacacatcacttctcctcctttgttccccttccagttctgctatggaagaagcaacatctaagatgacggaaattatttcagagcccacagttacactggaaaatgaggtaaaaaaaaaatagaattctgctcactaccttacagaaaaacaagccagacaaaagggtggaatggttaagagacagtgttgacaatgagcacttggactatcgctcatctaaatgctgctgcatttatcaaaagcctcatgcctttggtgaaagctcctcagagagtgaaaaagaggatgaagaaaattgtaatttcatgctatatttctggggtcatcacaatggacggcatcattcccttcccaatagggcttctagtactttatctaaaaaaccttgagacacatctcatcctcttccttcacccatgaagggctaagcttactttgcttcccccatccctgaatgagactggactaaaatatatccacgttgctattcagggattaaacatattttgaatcttttttgatgtgtgttctatctctcttctgtctgatggaaagggtagcaatgaaggaagacaaggggagagaaacaaagggatcaatagaatacctggaagccctggtactgcatgactactattctacaatacacatgtcacatgtatattcttgtcttttttagagatctggaataacttctcctatattttcttggctagtctattatcatgacaccaaacccccactttccacagagctaccattttctctatacttgttacccataatagtttctatcatctaatgagtaccagattattctttaccattaattggaagctttgtaatcttgtcacctgatatttacccattacactttattcttgcttttatcctgggtgatttcaatatccctgtagataagatttcatataaactaggtatttctcctctacttttatttaggaaccccacagccatagtcataccatgaagctaatgagcactagtactattccacatctaagttttataattagggatcttattttctcatcccaaactcctatcttttgacttctgtctcatactcgcttacaacactattttgtgaattcatggagactcctagtcacccaaatttgtgctgacctctcaatcagtcaaccttctgggtataacttcttttccacccaaacttctgacccatcaacagcattctttcccgtgttcttacttcttcactcttttgtgaaacctctcttgccaattccaaattatgacatgtgactcaggaaaactaaaatgaagtgtttgtggacttggggaaaggtggtatcaaagaaacatcaggaaactatcaagaggtagaatagtagtttaaatttattacatgttttgtgtgtgcctagcattttcttcaaggctttatgtataataacccaggaattctgggaaagtctcagtctttatctcttcaaatatattctgcttcattctctttttcctatttctttgagactccaatttaaacctatgttacacttccttctatatttgttaatattatctttatttttctgtctcttttaaacatcatttggatcatttcttcttatcagcatttagttcaccaatatagcttgatttatatctaaaaagctattaaacccatccacttaattttgtttccttatactcttcagtcctagaatttcaacttagtactttttcccaattgttagatcccttattatgaggacctgaataattcaaattctctgtaagaaacttttggcttgactttgatttcct

SEQ ID NO: 12524 - DNA, 12576 bp, Homo sapiens
tctcatagtgcgattgtgagtgacgctcacaaagttccctctaaggcctcaagacacgacatctacaattcttggccctgccatatctctgtacagcaaggtagactcgtaggcaaagggaataatatttactgagtagaaactaatttggggtagagacttagcacgcaggccctagaagaagactgcctgggttcaagtatcatcagctctaaacttactgtctcactttgggcaagtaactgacctgctttaggcctcagtttccccatctatatagtaaggataataacagcacccacttcattgagtggttaaaaggtttaagtgaggtgatgcatataaaaggtgcctggcacatagcatgtgcccaaaaagcatcaaaaatgggggagaggagaattcctctcttcttgtattgcttgctgccgtccacctggattaatgccttatactttggctttcagatgggagaaatccagatcacatccacctacagaagaaatgattggctgctatggattgtagctaaaccataggaagagtagagttgtagctggccccagggatggccagaaccaagaactcagatgctacaaaggccctctctcggtgccccatctctgttgtgctctgcctgctggcatcattctctctactgcaaatggcggctgcttgaggctggagccatgaccacccttagtagctctgtgattcactctctcaccttcaccactagagagatgacaatctctctccgtgactctaattagaaaaagcccatcagaggcctctgattagtttagctggggaatgtacccattcctggggccaaggaggtagcctccactagaaccccatgactagtttggggacaattctccaaaagaaggaatgtgctcaaaagaagtgaggagtcctaggcagacaaaacaaaagatgtctactgtggatgaaagagaagtaggtggactgaataatcagggccactctcccatgctataaaggagtaggtttttaaagacctgtgaggagtatccatagatcactgtgtgagttatcaacccagagttggtcttgttctagatctgtcctgtatcctttcataggtagccaggcatcccccaaccaggctgatcccattctgtgtctaatcatctgaccactgcctgcccacctgcccactagtccattgggctgggtgctgacacttcgcctggctttggcaagcctctgcccttgggagtagatgcaggctccgtgcttatcttcagatgctggtgaagttctatgggtcatccaagtcagttgacctcctggacttagaacatcccatgacctagagataagttgactagatctatccagaatgaggatcaacccagattagaaaagactcacctgaatcttttaaacgttgaaatttagataactttttctccttccttcttccctcctcctgcaatacttggccttgttccttcccagttgcttccttaccctagccccagccaagggagttcctagactaccagtagaggctaaacatatgagccaaggggtcaaacaagcttgagttcgaagcctggctctgccacttattgctgtgtggccttggataaattaatctctcttttcacgcttccaggcttccagagatgatgtacccaaagtatgatcatcatttttattaaaatattgtgctcacatctgattgattaacagttcctggcacgaggtcagtgccaaagagccttggactgactgcttatggcctggcctccctatctggtttcttactatgtagcgatccaagtgaattcagatgattccctggactaccaccctccttcctgggacacatccatccctcaaacactgttcatcactggccatcaaagcagcagccacactgctccagcaactcaacagctatttattgagatgggtgtgtgagtacatgagtgagtgaatgaactgaaagaacgtaagagtgaattaactgctaagtgaattagtgaattagtgacttaatgagtcagcgagtgaagaagagtgtgcaggattgaatatatcatgttcttttccctcaacaaattgaatatgccgtggtataaaactttcaccctcaaatgtgtcttcttcattaacacaagcaggggttaagaatggcagaagaaaagttacagaccagcagccagaggagaaagatactgtgctagtttcctattgctgccttaacaaataactgtacatttaagggcttaaagaacacaaatttattgtgttataattctggaggttagaatccaaaatgggtttcagcaggccaagatcaaggtgtggggaggactgagcccctctggtggcactaggggacaatccttttgcttgccttttccagctgctagtagccacctgcatttcttggcttgtggcctctttcccttgtcttcaatatcagcagtgtagcatcttcaaatctctctccacctctgatcctctgcttctctcatcacatctcctctgactgtgacactcctgccttcctcttacaaaggccatgtgattctatcaggcccacctgataatccaggatcatctccctagctctaaatccttagagtaatcttatctacaaagtcccttttaccaagtaaggaacaaattcacaggtttcagggcttaggacgccagcatctttggagaggcattcttctgccacttgcagatgccttgttcagagggtaaatgcaaccagtgagtcccactccacagaggaaggggcaggagggggatgaaggaagtttcaaagcatttgacatacacatgcttatgccaggtatgtttgctgttgttgctgtggcctgagcactgagggttttggaaagcttaggtgattccatcatgctgcaaaatctgagagatactttgacagagatatgctaagagcatatgctgctgtaattgagggtaaaatctggccctgtgattcctggagatgatggatcaagagcagggtgtctttaccctggctgcacattgctatcaactggaaagatttttctttaaaaaaatgttattttgaaataagagtgcaaagatcatacagaaatgtcctgtatacccttcaccccgattccctaatgttggcatcttacataaccctgggtcatgcataaaaactaagaaatcagcaatggtacagtactattaactaaatgaaacattttattcagatttccccagatttccaccagtggcccactttttgtctgtcacaggattcagtctagcatctctcattgcatttgtcctgtcttcttggtttcttccaatctgcatcagtttcttagccttgccctggttttttaaaatcttgacattattgaagggtactgatcaggtatttggtagaatgttctttatttcagtttgtctaatgttttttcatagaccttggctatggatttttgggaagaatatcatggcggtgagatgctgttattatggcaacacagaaaggggttctgtgatctcaacatgacctgttattgatgatgcttactttgatcacttggttaaagtggtgtctgccagatttccccgctgtaaagttactatttgtccctttccatgttctattcattagtagtgggtggctaagtccagcccacactggagagggggagtgccatctgtttttattcctatcatttcaatttgtttaatcctcatggctttattatcacctcactactttttagagatatggttgtaatgagctagacttgcccaaagttactcagctagtaaatggcaaagctagaatttgaacttatatgtgtctggcttaaaaggccatgttctttccacttcatgttactgccaccaagtaaagaggatctcacagtctccgaggcggaagctccctctcagcttgtctggacagtgtttttcaaatccattcttggagtgtgacccatcagtgggtcatgaggtcagtctgtgggtggcattttaaataacaacataaagtaaaggtgactacaacagagtagaaaataagagtatgtcacacaagtagaaattttttatctctatatcttctctgtgctttgctaccttcatctgaattcacttatccttgtatggagataaaaatagccctcccataggcttgttatgaggactgaatggaatgaggtacataaagtgcttagaagagagactggctcatattaagcattatataaatattaagtatgtatgtatgtaaacgagtcatgatgtaaaatgtatttcttattgcagactgcaatcaagatgtttgaaaatactgaactcacatctgtagacgaggagttggcagatttacgacccccagcttgcagcctattttttaaaaataaggttttattggaacatagccacactcattggtttaggtattttctatggttactttcgaggtatagtggcagagctgggtacctgcaacagaaaccctgtggttcaccaagcctatcatatttactacctggccctctagaccaatgctcctgcctggaggtcatctcataatctagggaatattggacacctcttcccgggcatgtggtctggtcatgctactgtccttgcaggcatgcttgctctaggctgtgtgactgccaggcacttggatctccagaagctcattactcttctctattaaactgatgcctacatggtgaaaggctaaaaccatggtactttggtcagggtccccgcaggaaacagatggccactcaaattaaaatgattggtgagggcagagtgtgggaaagtagcagagacctcagaggctcataaaagtagagttttaccaccctaggcaggaggagataaagaaagggggcaatgcctgtactggaaggagagagtcatttagagaggacaccttatgaggaccagtgaccttcagtccagggacacagaaccagctccaagtgaccctggggtggggatccaggagaataaatgccttgacttaactttcctccatctctgatctcctgtggagggccccattgaccaaagtgagatggaaatcagagggtatgggatcctctgatgtggctcatacagaccagcttcccaggccagagaaggttgaagagaggttggagaaggctggaaaggggatctggaagggcaactcttagatacccagcacacagcattgatttaggaagccagatttatttacctttcctaagctcccctaaacaaggacttcccctgcttcatcctccaagttggaactttgacaacaccaaaaggttgacatagcttttcccttttactgccttttcttcttaaatctgctagcttcccgatagctattgtgggttaatcttcctggatcttatcatgagagggatggaaggttaagaggcacagataagctactctgtgtgtgtgtgtgtgtgtgtgtgtgtgtgtgtgtgtgtgtgtgtgtgtgtctgagcctgagcagagtctgatgaatatgtggactttcattaaagttcttcctcatgtcccatcttttgatctcagaaaggagctgtgtcccattcatctaggcagccctgctcatgtccaaaaaatgtgtgagtcaacctctggccccttgggagaaagagccagggggaaaaaggctacctaggctgagaagtgtccccagagtaatccgttcctttgcgagaccccctactagcccagacttccttgatggcacctgatatcttataggcccccaaatcctgccacacaactacagcttgtcccctggaggggcttccctggccagtccagaatgctcaatttatgagagatcattggctcacagggaggaaggggatggcttaggtaggccagccaccttgcagcagagctgggcaagaattcaggattggagactcttattagtttccatctttcttttacagaagatgaacactgaagtcttggaaccctgggaatgaacctggaaaaattcaaaatatggtctagtcttaggcaagtttccttgtccrgctcagctgctgagaccacatatctggaccctcagtgccctggcaacagctctgtgcaggcaggatgaagcacaggcttaggtcaagcaatcagcygtcaaaatccacactctcacctgtgagtggctgttcaaccttgaacatgttactttttatrttaatgaaactcagttttctagtcctataaatttggggctatcatcaaccattaagtgatattaaacccagtgccacacaggcaagtacctagcagtgtccaaaggcccccagaatgacactttttcatcttttctcttccctccaattgaaagactagtggaatatctgcaattactttgaccaaaagccagaagccggccagtttgagtgtagctgttacagctttgtgttctaaacctaagaaatggggacccctcacatgagagtggggaggcttctggatgtgctacaaattccatttcattttcatgaactccagtgttaattaataaaatctcaaggttctcccccctctttcgcctcacatttcttcagagaaatgaagagttccaactcatagcccaagtgctcaggttttaaattagacaactttgtcctgacaggaaccaagtcacagctgtcatacctgattacttttagagttactactaaaccctttgtatggcatgagctgccactgttcaaggcaaacagaaacacttcacattttatcatgacagccctggatctatccacctccccatgttcattatgctcagcctgtctttggaagggatgatgaggcatcctgaaaatcgtatagtgaggaaggcagaccccatggcctgtcactacagcctagggattttaagcccctaaagtgcagcaaaacccactgcctccaggaagccaaggagaattatttctgggggacatagctgcctcatagcctactatgaatgaaccatcatctttcatgagaggcaaacattgaccctcaagtaaccaaccaatacgagcacctgtacacaaatgcccacaggtgttggctgggattggctggcttgtggatgatgtcacagtttccctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggcacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaaccgtatttcctgttcctggtctcatgtgtggcattagagtagctgtgactgatgctttgtggaggagggagtggcttggtagaggagagactgatcctgaggaggggaacggagaggacgggaagggaaagaaggggaagggaggagaggagggaggggaagggaagagaggggaagggaagggaaaggaggggaatggaggggagggaaagggagggaagggctggctttgagagaagtgtcagcagtaaacaaaaggtgtgacttgggccactgggtgggagcctccaggtgtaaagtagcagcagtcatggaggtagaagcaccgtggttctgagtggtgatccaggtgagaggaccctactcagtgtcaggttcaggaacatgacgtctgactctgctaagcagtggcaggactgggaagactgccagggctagaaggcctagagttcaagctcacacttgaggccccaggagaaacatatggcatctgagttgagacaggcctgagggaacccaggatttccagcaacacttagatacgctcagtggggccagggtgaactcccaggggtgttccctaatcaggaggaggcaaggggcagattttaccaaaaaaaaaaaaaaaaagcagggggctggggaaccagatcaatcgtttttcagtggatagatgtataatatgtggcctccactcctcttcctcttgttcatagcactctgactccctttcgtgaccaaggctggataagagggcaggatcgccttggccacagtcattggctcagtggtgggcatgtgacccaagttggtcctatcagggtggacctctggacctgtgtaaggagtcctgggggacaccgcagtccagggaatgtggacagccatttgccatctcatagggcccaagaaggaggccgagatgctagaatccctgtggcatcagaacagtctcctaaacttttcattgaagatgaacaacacatttcattttttccctgagatggtttgacttaggttttttcctacttgactataatttgacacaaatgggattgtgctgtaagtgtctgtctggtaactagatttttcaggcaagaatatactgtaggcaacattccataccaatcaataaagattgaaatggaatattttgaaatggttcttctgacttcttgacatcaaaaatactgggccaaaatgcaaagctgcttttttgtcaccagtttatacatgcaacagatctccctaactccacctctaaggacccctattccatgatagagggacctacactttctactctactgcgctgaacagtaaaaatacatatttttgaacagtcttttagaactgcatgagcctttaggggatgagaggtaatacagtgatttagaaattcagggtctggaatcaaacaggtcatttgtggaggattttcatgtgccaggccatttgctgggtacagggaggcacattacgcactactgctaagttcccgccctataaaaaatttccttctgacaggagagatggacttgggcataaattgcagcactgcaaagcaagatgatgaaagtgaatgcagaaagtaatgggggagggactggggaccacccagcaagcctgtgctgcagtcttcatgaaggaagcagccttattccacttgacaactttgtaggcatgctggcaaaattcccgttccgcattccccacagctgctattccaacttggctctgcttctcttccctctcaggagacgcccgcattttctgcttcattgagaaaatagagatcctcagatataagtgctctcagtttccttcattcttgaaatgtaatccataccaatcctttcctcctggtctcacccctcacggagagctatccccctcctgctcttcctgccccctccctgcctccctggggcccttgctccttactataagggtgctggccctccagcctgtacactcatacaagttcacttgatgccatgatatggtggtccccaccttaatgttggcagaacttagggcaagttctcattcctctgagcctcatgttcttatctgtgcaaggaggataatgcctgccttacaggttgttttagcaattaactgaggtaatacatgtaaaagtatttggcacagtcctaaatctaataggtaatatagcggatatactctagggtggctgttccataatcctttcctcctttcttggtgttcacacccttgtataatcccctcctattaagtgtgggctggacaggtgactttcttctaacccatagaatgtggcaaaggagatgggatgtcacttctgtgattatgtgatgataaataatactatatattgctagccactttgctctagggattctccttgctgcttgatgaagtaagtggtcaagtttgagaagcccatgtggcaaggaatgacaaggaactgtgggaaatgtctagaagctgagggtggcctcagaccattagccagtgagaaacagaagttctcagtccaccaaccacaaggaacttaatactgcagcagccacacaagtgggtaggtgaatccttccccagtcaagccagcagatgagaacttggccctggctgaccaaggcctgaagcaatgcacacagctaagctgttactggactcctgaccccacagaaactgtataaatgtaagtttaaaactataaatgtttaaaccatatgagtgtattttgttttaagccactaagtctgtggtaatttgttacacagcaatagagaatacattactcaataaatgccctcttccttataattctagaagagactgtctttaatcttgtttctatctccagcctctaccttccccatttaatttcctttcctttgttaccaatctcttgttaccaacatcttgaaggtggagggccacctcccaccgtccagtgctaattagatcctgatttgtattacccagtagtagttccagttgggttgtcttgtttccagcctgaaatgtgggctcttggtgggcagcagctgtgtgatgtaccacactcctctctgggaagagggcccccacacagctaggccccagctctcatgccacccctttctggtttcctgtgtgattaattatgtgaatgtgggtggccaagtcagagttttgacaagagtttgcagttcccctgctgaaaactaactccattaacagtcctttatgaaaaagacaataggagggtctgaatctgctggcttctaatgactgtaatgtaatgacaatggagagagagggagggaaggaggaggagaagttgggggagcctggacctaagataatgggtgagagaaaaagtagatggacaatctggtgtggtgccagcattccaggcccactcagctggcctcaggtgctcctgtccttgagaagaggaaggcaggcccatcaccatcttgatgactgaatcactcaactctgatccttctctcctcaaccgtttttctgtgttcatgtagtcattaatttacttactcattcattcaacagatatttacataaatcttatgcctgcaatataacagcaactattctggtgctgggaatacaacaaggttcctcatctctcacgttccggtgaggagagacagacaattaaaaaaacaacaaataggccaggcgcggtggctcatacctgtaatcccagcactttgggaggccgaggtgggtgtttcatgaggtcaggaatttgagaccagcctgatcaacatggtgaaaccccatgtctactaaaaatacaaaaattagccaggtgtggtggcacgtgcctgtaatctcagctactcaggaggctgaggcaggagaattgcttgaacccaggaggtggaggttgcagcgagcccagattgcaccattgcactccagcctgggtgacagagtgagactccatcttaacaaacaaacaaacaaacaacacaaatacatatatcgaatcagtttttgatagggtaaagtactcactagaaaataaacgtgggtaatgagataaatgatgatagataggatagagggcacttgaaatggatggtcagaagttttctgcggagctggcatttgggtttggatttaaagggcaagaaggagccagacaagccaaggtgtaagagaagagtcctccaagcagcagggaagcaagtgcaaaggtccttgcagaagcgagcttggcatattagagggacagagggaggccggagcaactggaggtgtgaacaaatgggcgagatgtgtttggaagggtgaaggccttggcaaggggtttatgtggaaatctaagtgcaactgagagccacagagagatttcagtagtggagaaccacgtgcttccatctctgactttgtgttactcatcattctagggtcttcagagactatcaagtgccaacaaggggattacccctctgcccctctaaaggattgcaagaaagaagacaccaaatccatggcattttttcccttaggaaagaagggagataatgagaagcctccacttggtattccttggagcagctggaagctaaaaaccaaatgtgggaactgtgaatcctatctctgggatatgttttctcaggaaatggaggaaatgggtgggcacgggtggcaaaatattccaggggaatacttct

SEQ ID NO: 12525 - DNA, 12899 bp, Homo sapiens
tgagggaagagggactgggggcccagactcccagatctgagggaagagggactgggggtccggacccctgggtctgagggaggaggggctgggggctgggacccctgggtgtgagggaggaggggctgggacccctgggtgtgagtgaggaggggctgggggctggacccctgggtgtgagggaggaggggctgggggctggacccctgggtgtgagggaggaggggctgggcctctggggtcctgggggaggaggggttcggatgtcctgtgccaccattccctccctccatttccagacgatgtacctgtcccagctccagccggtgaccagaaggaggtggacacttcagaaaagaaacttctcgagcggctccctgaggttgaggtgccccagcatctgtgatcctccgggaccccagccctcaggattcctgatgctccaaggcgactgatgggcgctggatgaagtggcacagtcagcttccctgggggccggtgtcatgttgggctcctggggcgggggcacggcctggcatttcacgcattgctgccaccccagatccacctgtctccactttcacagcctccaagtctgtggctcttcccttctgtcctccgaggggcttgccttctctcgtgtccagtgaggtgctcagtgatcggcttaacttagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgccaggggcaggggatcctcagtatagccggtgaaccctgataccaggagcctgggcctccctgaacccctggcttccagccatctcatcgccagcctcctcctggacctcttggcccccagccccttccccacacagccccagaagggtcccagagctgaccccactccaggacctaggcccagcccctcagcctcatctggagcccctgaagaccagtcccacccacctttctggcctcatctgacactgctccgcatcctgctgtgtgtcctgttccatgttccggttccatccaaatacactttctggaacaaatgcatggctccatgcctgtgtatctggactggtccctccaaaacgctattgccacgtcacctgccggagtcctcatctttgaagactggattcaagcatcacttctgagaggctcaatcctggtatttttccatctgcccctgatgagtctgcagccttcactcagggtcccttcagccacaaggacagaaaacccaaacctgggattaagcaattttttttttttttttttttgagatggagtcttactctgtcacccaggctggagggcagtggtgtaatctcagctcactgcaacctctgccttttgggatcaagcgattctcctgcctccgcctcccgagtagctgggattacagctgcctgccaccacgcccggccttctaatttttgcattgttttagtagtgatgggggtttcaccatattggccaggctggtcttgaactcctgacatcatgatctgcccaccttagcctcccaaagtgctgggattacaggagtgagccactgcacctggccgggattaagcaacttttaaaagatgaatttggccaggtgctgtggctcacgcctgtaatcccaacacttcgaaaggccaagataggggggatcacttgaggccaggagttcaagaccagcctggtcaacatggcaaaaccccatctctactaaaaatacaaagatgagccgggtgtggtggtgggcacttgtaatcccagctactcgggaggctgaggcaagagaattgcttgatcctgggaggcggaggttgcagcgagccaagattgcaccactgcactccaaccggagtaccagagcaagattccatctcaaaaaaaaaaaaaagaatgtaccaggtatggtggctccacctgtagtcccagcactttagaaggcagaggcggatagatcacgaggtcaggagatggagaccatcccggctaacacggtgaaaccctttctctactaaaaatactaaaaaaattagctgggcgtggtggcaggcacctgtagtcccagctactcaggaggctgaggcaggagaattgcttgaacccaggaggcagaggttgcagtgagccgagatcatgccactgcactccagcctgggtgacagagcgagactctgtctgaaaaaaagaaggctgaggcaagaggatcacttgagcttaggagtttgagaccagcctgggcaacatagcgagaccccgtctcagaaaaagaaaaaaaattagctgggcatggtagtgtgtgcctgtagtctcagctgcttaggaggctggtgtgggaggatcccttgagccctggagtttgaggctgcagtgagccatgatctatcactccactgcactccaggctgggtgacagaatgaggccctgtctctaatagaaaaaagaataaataaaaatgaattatgataaaaaccaagatgtcccaaggcaggatgacttcagggaaccaggttctcgcatcccctagctgtgccaaggataggtttgggggctggaccccccctcatggtcccaaggtagctgcagctgctccagatgtcaccaacagccagtgaaggaagaggccgcattctgttctgggcattgttaagtgggagaaaatctgtccccggagttccctctcctttcagccctctcctcatgttcccttatatcccactggctgtgaggcacaggtcagtgacagctgcagacagatccaccaagctggcatccaccagtggtgatttcatcctcacctgggatggggatgctttccttggaccaagttggggtctggtaaaaagcaagcggggaatatttgtttttgttttgttttgtttttggagacagagtcttgctctgtctcccaggctggagtacgatgacgcgatctcggtttactgcaacctctgcctcctgggttcaagcgattctcctgcctcagtctcctgagtagctgggattacaggtgcccagcacacacccggctaatttttctgtatttttagtagagatggggctttcaccatgttggtcaggctggtcttgagaactcctgacctcaggtgatccccccgcctcggcctcccacagtgttgggattacaggcctgagccaccacgcccggccaggagtatttgtttaaatgaaattctggccaggcacagtggttcatgcctataagctcagcactttggaggccagggatgggcagggtggggggtttcaggagaggatgacaggaggatgactcaagctcagagctcaagaccagcctgagcaacatagcaagacctcatctctaaaaaaaaaaaaaaaaaaaaaaaaaaaattagccgggtgttgtggcatgcacctgtggtcccagctactcaggaggcttaaggacagaagaatcgcttggccacagaaggttaaggctacagtgagccatgaccacgccactgcactccagcctgggagacagggcaagaccctttctcgagaaaaataaataggccgggcacagtggctgatgcctataatcccaacgcttcaggaggccaaggaggaaggatcctttgagcccaggagtttgaggccaacctgggcaatatagggagaccccatctctatgtaaaaaaataaataaatagggccaggcgcagtcactcacaactataatcccagcactttgggaggctgatgtgggcggatcacttgagggcaggaattcaagcccagcctgggcaacgtgaaaccccgtctctacaaaaaaataccaaaattagccgggcgtggtggtgtacacctgtaatcccagctactcagggaggctgaggcacaagaatcacttgaacctgggaggcagaggttgcagtgagccaagatcacactactgtactccagcctgggtgacagagcaagactccatctcaagaaaaaaaaaaaaattagctgggtgtggtggcacatgcctgtagtcccagctacttgggaggctgaggtgaaaggatcgcttgggcctgggaagcggtgattgcaacgctgcacatcagcctgggtgaccaagcgggactctgtctcagaacaaaacaaaacaaaaatacatattcccagatcctggaatgtcctgggaagctatatgtgtgtcatgccctcccagctgcacctgaacaatgagcatagcaaacatcagctgcagcctctctttgcctctctcagaaaatgaggggagttgagcttcagtgacccaatctggaaaacgggcctaaatggtgttctttgaaaggttcatataggcaaagcggtccccaaatgccgaaggagccaagaaaccaaagaatgaggccgacccatctagtttgtcaatacagggtggtttattagggggaaacttagagtgtggtcttcgccaggcatggtggcttatgcctggaatcccagcactttgggaggccgaggcaggtggctcacttggggtcaggagttcgagaccagcctgactgacatggtgaaacttgtctctactaaaaatacaaaaattagccaggtgtggtggtgggcgcctgtaatcccagctactggagaggttgaggcaggagaatcacttgaacccgggaggtggagactgcagtgagccgagctcacgccactgcactccagcctgggctacaaagcaagaccctgtctggaaaaaaaaaaaaaagaagtgtggtcttgggcagcagcaagacagatagatcacaccctgcaacccccagacacagggcttctatctcgaggaaagcatatctgtgctctggaagaaacgcgtaggtggctatgggcgatacatcttgtgatggatgtgacaacatcaaggcttgttctggaggaaaggctggtaagtacgtgtttctacataaagagtaacacatccgttagacatgttggaggcattcccagtttcgggttagtcagaagtcacacggcaggctgggtgcagtggctcatgcctataatgccagcattttgggaggctgaggcaggaagaccgttcgagcccaagagtttgaaaccagcctgagcaacatagtgaaaccccgtctctttttttttttttttgagacagagtctcactcttgttgccggtggctcgatctcggctcactgcaacctccgcctcccgggttcaagtgattctcctgcctcagcctcctgagtaactgggattacaggcgcccaccacgcccagctaatttttgtatttttagtagagacagggtttcgccatgttggccaggccggtctcaaactcctgtcctcaggtgatctgccctcctctgcctcccaaagtgctgggattataggcatgagccaccgcgcccagccaaccctgtttctttctttttttttttttttttttttgatacggagtcttgctgtgtcccccaggctggagtgcaatggcacagtctcggctcactgcaacctccacctcccgggttcaagcaattctcctgcctcagcctcccaagtagctgagattacaaaccccgtctcttaaaaaaggaaaaaatcacatggcagagtagcattttaaaataaagtcacgaggctgggcgcggtggctcacgcctgtaatctcagcactttgggatgctgaggcaggcgaatcacccgaggtcaggagtctgagaccagcctgacctacgttgagaaaccccgtctctactgaaaatacaaaattacccgggcctggtggcgcatgcctgtaatcccagctgctcaggaggctgaggcaggagaatcgcttgaacccaggaggtggaggttgcggtgagcygagatcacgccattgcactccagcctggacaacaaaagcaaaactccgtcttaaaaaataaataaataaataacattaaactacgtcactcagcctgtgaacaatggctcacgcttataacccagcaatttgggaggccgcagcaggtggatcacttgaggtcacgagttcgagaccagcccggccaacatggtaaaaccgcatttctactaaaaatacaaaattagctgggtgtggtgatgggcgcctgtaatcccagctactcatgaggcaggagaatcgcttgaacccaggaggcggaagttgcagtgagctgaaattgtgtcactgcactccagcctgggtgacagagcaagactccgtccaaaaaaaaaaaaaaaaaaaaagggaccatgttctagtgtaggggtaagtggaytgttttggccccaaccccaagaggatcaagggagaccactgcagctgcccgagaaattcttgccctctgacaagaaacaccctatccrgtctggggaatttgccagtccaacccctccccttggctcaagattctgggaaatcctaaatagtgtttaccattggccttttatcagctccagtataaatgcrtctggccagacttgctttacaactatgcataatggatagttgggccaggcttggtggctcatgcctagtgctttgggaggccgaggtgggaggatcacttcagcccaagagttggaggccagcctaggcaacatggtgagacaccatctctacaaaaaaaaattttattttctgttttttttttgagacggagtgtggcgctgtcacccaggctggagcaacagagccagactttgtctcaaataaataaataaataaataaaacctgcaaaaaaaattttttaaatgccatttttctttctttctttctttctttttttttttgaggcagagtcttgctgtgtcacccaggctggagtgcagtggcgtgatctcggctcactgcaagctctgcctcccgggttcacgccatcctcctgcctcagcctcctgagtagctgggactacaggcgcccgccaccatgcccggctaattttttgtatttttagtagagatggggtttcactgtgttagccaggatggtcttgatctcctgtcctcgtgatccgaccacctcggcctcccaaagtgctgggattacaagcgtaagccaccgcgcccggccatttttctttttaatcaatcctgccacttgaagattatatggtaagggaaatctgcagtctatacacaatactgagttgctccaagcccttgaggattgtgagggacccagtgttctaattcttgctagagtgtctacctccatgttaccagaggcgagtctgaccgggtactgacatgtgatataccattaagtgtgcagtgggttcttttagcctttcccaaatgtctttccacatggcagcgccccacagcattttctttttcttcttttttctttttcttttttttttttttcttttttttcctgggcaacagagtctcactctgttgcccgggctagagtgcagtggcgtgatctcggctcactgcaagctctgcctcctgggttcaagcgattccagtgcctcagcctcccaagtagctgggattacaggtgcacaccaccacgcccagctaatttttgtatttttagtagagatggggtttcaccctgttggccaggctggtctcaaactcttgacctcaggtgatccgcccgcctcggcctcccaaagtgctgggattacaggcgtgagccactacgcccgccctcttttttcttttttgagacagagtctcactctgttgcccaggctggagtacagaggtgccatcatagcttactgcagcctcaaccttcccagctcaagcgatcctcccgcttcagcctccctagtagctgggaatacagatgcacaccaccacacctggctaattttttgcaggttggtctcgaactcttgggctcaagagatctgcccgccacagtctcccaaagtgctgggattacaggcatgtgccaccgtgcccggcatattttcttttcagtgtttacctttttgcctcctctgaggtgctggagtgcagcaataagaaagtaataattttaggccgggcgccagtggctcacgcctgtaatcccagcactttgggaggccgaggagggcggatcacgaggtcaggagatcaagaccatcctggctaacacagtgaaaccctgtctctactaaaaatacaaaaaattagccaggcgtggtggtgggcgcctgtagtcccagttacttgggaggctgaggcaggagaatggcgtgaacccgggaggcagagcttgcagtgagctgagatcgaaccactgcactccagcctgggtgacagagcaaaccttcatctcaaaaaaaaaatatatatatatattatatatatatatttttttttttagaccgggtcttcctctgttgcccaggctggggtgcagtggtgtgatctcggctcactgtaacctctgcctcccaggctcacgccactctcctgcctcagcctccagactacaggtgcccgccaccacgcctggctaattttttgtatttttagtagagatggggtttcaccgtgttagccaggatggtcttgatctcctgacctggtgatccacccatcttggcctcccaaagtgctgggattacaggtgtgagccactgtgcctggccgctgagtagtattttgttgaatccactggcagcttaaaggacatttgggcttgagctatgtacagctgctaacacctgtgcactggtttgtgtgcaaacatgttattttttctttctaggacaaatacctgggagtatcaaaattattttttgatatttattattaaatgattttttctttttcttcatagtaatgatattgtgtcctatgtggatttccctccccctaaacctttttttttttttttttttttttttgagacagagtctctctctgtcacccgggctggagagcagtggtgcgatcttggctcactgcaacctcctcctcccaggttcaagcaatttacctgcctcagcctcccaagaagctgggattgcaggcgtccgccaccatgcttggctaattattttgtatttttagtagagatgggggtttcaccatgtttgccaggctggtttcgaactcctgaccttaagtgatccgcccaccacggcctcccaaagtgctaggattacaggcatgagccactatgccctgccccctccccccactttttttttttggtagagatggggtcttgctttgttgcccaggctggtctcaaagtcctggcttcaagcattcctcccatttgggcctcccacagtactgggattacaggcgtgaaccaccgtgcctggtcccatttgtgtttctattcagcagtttgtgtaaacttgaagtctgtgaatccatgtgtgacactcaggtcttaattattgtctaccaagtaagagaaagtgacaatatcctgccctgtgtgaagctggccagccagttaggaattatcatgtcccaaccagcctgggaaacttggcaagaccctgccttgataaaaagtttaaaaatcgactggacacagtgtctcatacctataatcccagcactttgggaggctgaggcaggaggattgcttgagcccaggaattggagaccagcctggacaacaaagtgagaccttttctgtacaaaaaattgctgggcatggtggctcatgcaggtaatctcagcactttgggaggccaaggcaggcggatcacctgaggtcaggaattcgaggccagcctggccaacacagtgaaaccccatctctagtaaaaatacaaaaattagtcgggcgtggtagtgggcgcctgtcatcccagctactcgggaggctgaggtaggagaattgcttgaaactgggaggtggaggttgcagtgagccaagattatgccactgcatgatcaccccagcctggatgacagagcgagacttcgtctcaaaaacaaaaaacaaacaacaacagcaacaaaaattagcaggctgggtgcagtggctcatgcttgtaatcccagcactttgggaggccaaggcaggcaaatcgcaaggtcaggagatcgagaccatcctggccaacatggtgaaaccctgtctccactaaaaataaaaaaaattagctgggcatggtggagggcgcctgtggtcccagctactcaggaggctgaggcaggagaatcacttgaaccagggaggcggaggttgcagtgagctgagatcacaccactgcactccagcctggggatagagtgagactccgtctcaaacaaacaaacagacaaatagcggtaagtggggcacatgcctatactcccagctactcaggaggctgaggcgggaagatagcttgagcccaggagtacaaggctgctgtgagctattatcacgccactgcagtccagctaggtaacagagtgagaccctatctctaaaataattaataaataaaacaaaataattagccaggtgtagtagccagtagctactttgggtcccagctactgtagtcccaggtactagggtggctaaggcaggagctaattccttgagctaaggaatttgaggctgcagtgagctatgattgtgccactgcactccttcctgggcgacagagcgagaccctatatcaataataattataataatacagtatattttacataatagaccatagagctcaatgaatcctcctcacaaccctatgtaggtagatgttatcatgatctctgctttccagaatagaaaagtgaggaccagagagggcgacctcttgtccaaaagcaatacagccaagaaggggcaaggagggttttgaaaccagtcggccaggctctggggctcctaacaagcaaagcagcctggtttctaaaactatagcttctggaagcagccaattcacaggtctttacctcctgactgtgagacctccaaaaaatgaccagggatcttggagtctgtttccccctttgtgaactggggacaatagaagctacttcccaggtctgcggggagaaattaggaacgaagaaggtaaagcgcagagctgaggagctggtctacaggtgctctatacatattagtaataattattaagtttgctgttacaatcctctctctctctgtgaacaacccctaatgatgcgtggctttgagagcaaaaaagtcagggcaaagttttgccacaaagtccagagggcaagacattaaatctaactctcaaggattggtgttggcaagaaagcaaacctctcctccccacgctgtccttaccccgcgtatccgacgagcctaaagtcataggtaagagatctgtagaagcgacgtcaaggtgtggttccctctgtaaggcggagctaaacggtgcattcgcccagcggggaagctagaactaaatgaccgctctgccgactggagccaacgagaatcggcgtaggcgcaatacgggcggaggatggggacccgcccccggggtgggcggggcgtcaggtacttaattcgcgcctggagggaccgaaggtgccgagggctccgcatcgcaaccatggcgctgcgctggggcatcgtgtctgtcggcctcatctccagcgacttcacagccgtgctgcagacgctgcctcgctctgagcaccaggtctgcccgccctccggattctggggaagaggaggcggggggcgggactccagagtctaaaggaggagggagtttagggttcaggactagtgagtgggtcgtcattgcagtgaaacgtctgtttccttgctacctccttctccatctctgttctgcaaacctgtggggaaaagaaagatcagattgttactgtgtctacgtagaaaatgaagacataagaaactccattttgaactgtactaagaaaaattgtttctgctttgagatgctattaacctgtaactttagccccaaccgtgtgctcacagaaacatgtcctgtattgaatcaaagtttaatggatttagggctttgcaggatgtgccttgttaacaatatgtttgcaggcagtatgcttggtaaaagtcatcgccattctccattctctattaaccaggggcacattgcactgcggaaagccgcagggacctctgcccaagaaagcctgggtattgtccagggtttccccccactgagaaagcctgagatatggcctcgtgggaaaggaagaccttacatcccctagcccgacaccagtaaagggtctgtgctgaggaggagtagtgaaagagggaggcctctctgcagttgagataagaggaaggcttctgtctcctgctctccctgggaatggactgtctcagtgtaaagcggaccattcccattccttctattctgagataggagaaaacctacctgtggctggaggcgagatatgctggcagtgatactgctctgttactctttgctacactgagatgtttgtgtaaagtgaaacataaatctagcctacgtgcacatccggtcacagcacctttccttgaacttattcatgatacagattccttttctacatagacacagtaacaatctgatctctctttcttttccccacacaaacctgagtgtcttgaggtttggaaaggccttgatgtaagctactatgaagataatttcaatattgggggatttaataacggctttcccccagatctctctttcccagggcccaaatgtccagcccccgtcatctcttcccccaggaccacgtctccccttcccctggcc

SEQ ID NO: 12526 - DNA, 12704 bp, Homo sapiens
attgatggcattcttctcacaacctgtgatatcgtgatatattaggaaatacatatttggtctttgacaccagttcctgacacggagctcctaactcccttgacatttctagatgataggcacatcttttgttctaatgaggtggctcttggtggtggctggataggctcaggatgggggctgtcatcagaatgaccagaccatgatacaaagcttggaactttcaccccacatcctccaggaagggaagaggggctggagattgaatttattatccatcatgcctatatgatgaagtctccatcaaaatccctaaaagacaggattgggagagcttccgagttggtgaacgcagggaggtgctgagctggtggtgcccccagagacagcaccgaagctccaggcccctgccccacgtgtgggtctgtgcctctcttccacctggctgtggctgagtggtgtcttttattataagtcagtaatgtaagtaaatgtttccctgatgctgtgagccatcctagcaaattactgaacccgtggagggggttgtgggaaccctgccttacagctggttggtcagaagtgcaggccacttgagacttgcgatgggttctgaagtggcggcagtcttgtgggactgagctcttatcctgtgctgcctccgggcagataatgtcagaactgaacggaattgtaagacaatttctgaggaaataaacccacacatttaatcacagtggcatcgaaaggattgagtgggaaactgttttccctacacagagccctcaacccctatgacccactcaatcgtccttaatccttcctctctctcctctccagtgaccttggccccttctttctagagtcaggctttctgtctgtcccaatgtcctttgtccttacccagcctcttccttgctgctctaaacaccaggacgctctggttccccacaagcccccttgcaccaaccactcaagcacctctagcaaatcttcctcctccaggaagcctttccagacagctgactctccccggcaacccctcccaaataaactcagaactctgtcctccgggtgtctactcaaccacactggttccaaggtcccagtgtaaatactgtgaatgtctgttgacgtctcctgagtcctcgcataccctacttgagcgaggggctaggactgtgcccacattggtggtctacagccagcagggctccagacaggacacccaccatgaatagcatcaggacaatgctgatgacgacaacgaagctgatgagcttgcaccagcatttacagagcatttccctgtttacattgcattcattcaacaaatttatgagtgcttagtctgggccagcaaccagggaataataatagcttcagtttttggaggcttactatgaatgccaagcaatgttctaagcactttccatgaaataattcatgtaatccacacctattttagatgcaggcactggtactatcccaattttataaaaattggaggaatagagcagtgaggtgacttgtccagagtcacacagaggtggcttgtccagagtcacacagctggtgatgggtggagttgggatttgaaccccggcacctcactgcattatctctctttatagggggatatagtggtgaaggacagatggtgcctgccctcaggggtctcccaggtggtgggaagtgtgcccaagatggggacaggaggtgtgggaggcttcgtgggggagatgatgacctgaggccatggctgtgtccacgcactccaggtagcctcagttgcatccctctcatatacgctctcaagtatagatctcatcttggcttttgagccaggatgcctggacatggtcaaaggtggggggcagttggcaaaatctggaagcaggaagcgagggggctgaggcaccagaccagaggcacaacggaggcctcagccaggtctggggagatggaggaaaagggatggattccagagagggccttaaagggggtggggagggaggggcagaggaggtggccctcggagtctcatgttggtacctccagatctgcaggatctcagccaatgaccccaactccttagaaaacggacaaaaagaccttgatgatctcatttgttcccaagcctccacttctcccaaagtaaagatctgtcagcttccttgtatttttgctttttgtaattgatttaaaacacttcagggtctatgtgtcatggtgtggataagctcgtgcctaggaaacctcctccagctcctcctgagctgcttgagggacaaactcatgcctctttcacctttgagacccctggcataatgtagagtcctgatagacactttttaaaataaatacccccggcatttcctctgacttgcccaggaccacacaactctcaggggaggggtgggggctgggacctggtacttgggctcctgttgctctgccctatgcccttggggacttctggacaagggtgcgcttccctgggctgacagaggagacagaggtagtggggtgctggtaaatggttaacaacgggctttctggaaaaaaatgccctaaccgtagcatttgcaaatttctatggtataaatactctcgcagtgaccagtttcaagtccaatgtcacaatggctcactgcaattggctctagggttggtcggccagaaaggtccctggaccacctccctctcctgctccacaaagggcaggagctcttccaactccttccaactcctactcatccttcagaacctgcttgatgtcaccttctctaggagaccctcccaggcaccgtagagacaccccagccccagtgctcctatatggctgtcagcacactttatggaaacagcacacttaactttctgtcttccctccactgtgtccccacctcttagcactgggcctggcctacgacaggggctcaggaaatatttgttgaaaggacaagtaatgatgctgatgctgatagtgacagcaaatgcctatatcatctgcaatgtgccagttctagtctcttttttttttttgctacagttagggcatttttttccagagagccagttgttaaccatttaccagcacaccattgcctctgtctcctctgtcagcccagagaagcccacccttgtccagaagtccccaagggcatagggcagagcagcaggagccaagtgccaggtcccggtccccacccctcccctgtgagctgtgcagccctgggcaagtcagaggaaacaccggggatatttatttttctcataagagaaaaccccatttctcttaaggggtttttggttcttgttttttgaggcagagtctcgctctgtcacctaggctggagtgcaatggcgcaatcttggctcactgcatcttccgcctcctgggttcaagcgattctcctgcctcagccttctgagtagctgggattacagcagcatgctaccacgccctgctaatttttgtatttttagtagagacagggtcttgccatgttggtcaggctggtcttgaactcctaggctcaagtgatccctgccttggcctcccaaagcgctgtgattataggcgtgagccaccgtgcccggccgtgccagctctgttcaaagcacttcacagatattaactcatttaatccccacaacactctagatgggtttttatttgttttggttcgtttgtttgttttttttgaaatggggtctcgctctgtcacccagactggagtgcagtggcgtgatcttggctcactgcaacctccgtcccctgggttcaagcaattatcctgcctcagccttcctagtagctgggattacaggcatgagctaccacacctggctaatattttgtatttttagtagagatggggtttcaccatgttggccaggctggtctcgaactcttgacctcaagtgatctgcctgccctggactcccaaagtgctgggattacaggcatgagccaccatgcccagctctagatgggtttttatgtccttattttgcagatggggaaacccagcctcagcgagtcagtggcagagcagggcctgggatgcagctcagaaagctctcatgtccttgggcttcccttgtcctgtaagatgggtggggccagtagcattgccctcactttaaaaaagcaaaacaggctcaaattccagcgaggggcttatggaagtttaggtgaagagccttggctaaggtcatcccactatgaagtggatggggatgtggtagaattagcacttaggggtctcaagtgcaaaagcgctttgtaaaccatcaaggaccacagacatgctagagccaaagaagttggaaaaatctcaccatttagatatttttagtccaagcttaacaagtaaggaaactaaacctctgagagggaggtgacctgtccaaagtcatgcacgagcatctcaaccctgcccctctgcactttccacaatcccagagtggcactcattccttagtggcagcgggcactgcactcgacagctcatgccatggtgggtttgcacgacagtcctttccctgagcctcacgattgtcctggaggaacttgttatgcccatttacaggtgaaggaactgaggctcagcaaagggaagtgatttatcccatctcacaggctcgtaagtggggacctgggtgactctgcatacaaaaccaccagagagatgaaaagaaccgagaaagagccgggttgattgtggtcaaaagcgtaaggcagacctggttggaggagcctggagcctggggctcagaagggacttagggatcgctgcctgatttttggtcatccagcagttatagggccgcctccttagagcctgggggcttcctggatgcatagcctgtccctgcctcggggctcccaagacaggtgctctggctggcgctactgggagagtgaggaggtgacaacaaggtctgggatagacccccagccccccacttcacctctctgaacttgggcttcctcatctgcaagatgggggacccagttgttatggcagtgaaatgaggtagtgccaccagacgcctagcccaggggctggcatggagccagcgtccatctgggacagctgccctcagtgttgctattgctatggttatttttattattagactcaacaatatgcctttgagcaggtggctttcactctttgggcctcagtttccccatctctagggcaaaggaggatgataagatagattattttgtaaaatccttccagctgtgaccgtctgcggtgactagctttcttaaatctgttcattctggtgccaggtgggcctcaccattgtagtgacttcctctgaatacatactgcagtgtcagtgtttgcacatgcatgcacagagacacacatatgctgtcctttttcttcacactatctcgattgtcacacaccatcagtcccttgagcacagaacagggtgtttgcttatctgaatctctggtcctggggaagcgcagctatcactgaatgtttgctgagctgagttagttgcctttggtagtagttagttccctgtcactaaaggtattcaagtaaagtctaggcaatgtttctggtgaatttggaccaggattacttaaattctatagatttaagccctagggctatgtatagctaccccactcaatgccacagcccctcactccttgggctttctggttcaagacacacattttacatttgtaggatgtgccgattgtatatcagatgtgtgggcctaattttcccataatcctccaaacagtgctgtaggatctcctcctcctcctcctccttcttcttctcctacttcctcctcctcctcctcctcctccttcctcctcctcctcctccttcctcctcctcctccttcctcctcctccttcctcttcctcctccttcctcctccttcctcctcctcctccttcttcttcctcttctcctccttctttcttcctcttctctcttctttttcttttgttgaaacaggatcttgctctgttgcccaggctggagtgcagtggtacaattataactcaccatagcctctacccaccgggttcaagcgatcctcccacctcatcctcccaagcagctgggaccacagctcctgccaccacagctcactaatttttaaatttttttttaaagatgggatcttgcccaggcttgtctcgaactcctggcctcaagtgaccctcctaccttggtctaccaaaatgcttcatttacaggcatgagctaccatgcctggcctacttcttgcggggargtgsgaggtacagaagagttctgttccctgttatataaaggcccaccctccaggaactgtgatttgtagctcagttggtaggaggggtcttgcaacctggcccgaggcagtgactaaggyacaggctatatgtggggccctggggtttgtcatctctgctgctaacaaaggtggaaaattcctacttcctgagctgagattgaggattctgacatgcatgagcttgcctactttccttggtatttcatttttggagccagaaacaaaatcctcccagatgctctgcttggcycctgtgagtctgacctgcaggcctrtgtctggcagagggcacgcaacagtggctcacctcccactcrcactgcgcaggggctgacacagggagaacgggagtcatagctctgtgtctgcgcttactgcagtgcccttaacctctctgagtctcagtttccttatctgtaagatgggatagattattgctactcagtttccttatctgtaagaagggattgattattagtagatgccgaatcaatgttagggatgactattaataagaaattgcatctgatgagatgccagctcctctgtctccaaggacctgccttttcttcctgtttctgattcctgcagaaactcctgtagccaagacaacataaaaataatctagtttgcaagtatttaatgagccacttacagactgtgagaggaaagcagatggcagcttccaatgtcttctctgaatagggtcagacaggaggagagggtttagtggctcccaaacctgtctctagatcatttaatatttggataattcagtgaagaaaacccagaaccttcaaccccctccctttttttttttgtttggcatttttgaaaataatcaaaaggacaggaaaagctttatgcacagagatgttcctcatcatgcagaagaagggtcacaggaaacaacctaaatgtttaggaccaggcagttggttaaatacatgatcttatatccattcaacaaatgtcaagcagacatgaaaaaaggatgcttctaagagttcaccaaaaatgagagaatgtttctgataacatgttaggggaacaaaaagctgggtaaccaaattgtacatacaacaaagttcaaaagttgagaaggcaaaataccaaattattactggcgctggttgtctttgagcatgggatcataggttgcttttgggttttctttactgtttgtcatggtatccaagttttctgtgaagaacatatattcctttggcaataaaaatatttaaataagccaagtgtttggaatgaattatgggtttatttacgtaaaaaagataatcagccaatttgtgcttaaaggaactctcttaggtctacagctgcccccctggcagctctgatgcattcgctgctgcagaaaagcctgaacccagcctgatttttcttgctttatggattgcctgtccccgcccccaccaactccccaacctccagtcaatctggatgcttatagtattttctttttctcttttccattcaaaagtgctgtcagatgtatttaggggacactgtctcgtctcaccccttttcataacctgtgagccgggcaaggcaccattgcataggtgagggcttggaggctggagagatgagggactgggactcaaaccacatttcgggatttggggacatctcctggctgtgccctgaggccaccccgactctggcatgtgaggcaaacctgctgtacaacgaaggggtctggacaagggagtctcaccaggggtgttcaaatcccagctctgccggtcactaagggagggactgtaagtgtgtggcctcctgtcagagcccaggtccccgcttgtgggataaggagcattgtccccggcaggagggctgttgtgaggatccagtgtggtcatccctggcactcaggaatccttcctgttggttcccgtcctctctcaggaatgacagtcgcctcctctttcccccaaatccacagattgttctgtcaagtgatgggcctgggtgccctcacctccaccccctcagccacagacaccacagtccaaacagactcccggaagatacggcccagaccacttgcagggaaagtccctgcggctgtactcatcctcatggaaaacatgaggactggcggggactggagggcagggagtgaggggacatgcagggtgcccccgtcacagggcagagggctctgactggggcttttggatcaccgcccaccatggggaggcccaggcaagggactcatgctcctacccatctctccagccccagctcctccttcccctcctgtcccctccctgccccactggtctcccctggccctgcctgagcatctttgggagttcccacctctcgacctttgcttatgtagggaggcaggatgcgatgggaagacccaggccaggctccagggccagcccagtctctagctagctctgtctcccctctagggaccatttcctcaactgtcaagtggagacacaatgcctacttggcaggtttgtcgggggggatacttgtgattgttttggggggccaagggtgccctggggctcaggcatatgtcaatggcactgggcagtctcccctaccctttctctccactgtgcaccctcccttacttagggagaccctctactttacctaggtctaggtcctccaacttgaaacctgcccacaatgacacatcaaacattgtaggtgtgtcataagctggtgtgaggacatgcaggcagcaaagaagcaacttgtgtgtgtacacatgtgtgtgtgtgtgtgtgtgtgtgtgtttgggtcggtccagacagaggcccaggaagaagaagagtggagatcctgccacatggctcctgatgctggaggcttagggacaaaccatcagtgtgactgtcccagtgtcctctggggatgggacttggggttacagattcagagagctgtgttagaaccacttgggtctctgcctgtctctcccaccaggctctcagctccttgtggggaaagatctctgagctgaggggagccctgagcagtctctcagtaagtggttaggggaggaaggaataaaccagcttcctgagtctaggcacagtctgggtactttcatacacagtcctattgtgttggcacagcagtagtctttatcacacaggtgagaaaggagaggttcggagaggtcagtgacctgtcctgggttactcagcaagtaattggcctagtaacctaacccaggactgttgaacaatcgggccagttggtgccaatttctaaatattgactattaaaaaaatactggtggcgaaatagctagcacatctgtgagcctgtttgggttgtgggctcagaccgaactcctataaagcatatgaagcagagatggtagaatcccaggcaggggccatggaatgggggagggggcattaactcctgctatcctacctttctataggtgaggcgcctgctgttcagagacacaggagcatcagcaaaacccatcaaagaactgggggccagggtagaaaggagacctttctgggggtgctgatggaaactcctacccaggcaaatcttgcttcccaggcattcccccagtgaagactgcactgctgtgcccaactttggctgcaggctactctttaccacccaagcgagccgccacccactgatctctgccatcaacttattctaattctctgcatagcacatagcacttcctgggattgcccttctcctgtctgctcttcaaagagccatccttagatggcctactgacattaatgctttttacctttctaacttgtcattttgtttttgtaattcttttctttcttctacttttttggatcattattatctagtttattgaattgaacagttttttttgcaatctttttggtttaataatttaaaaatttaaaggcatgactcatcccctgactatggctttggctgcatcccataagtttggtaagcagtgttcttatagttagttgtttctcaaatatctataatttcagttttgatgatctgtctctttgatgtaacagtgttttctaaaattttcaagtagtttatttctattcaagtttgttttgctttttatatttaaatttttgcaaagagatatgcatcctcatggtaacatttcagagtgggaaaaagaatacagtgaggggtaggtctccctccagattctgtccctgcctgttgcctcaagagacagccaggctcactggtgtctcctgttgctttccagacatcttctgagctttcaggagcagatgtgcacatatccatgtataaggacgcctgcagaagcaccctaaatgcaccgccggctgtgtcctcacctctttgcatttaacaatctgtcgacccaccttgcttttcaatagcctcacagtatttcagagtaggactgccctgtaatgcaccggccttcgcagggagttcccagttttcgtaggtagtttgcaattctactactatttatagctgaaggaaccgaaggatcccagagaccacatcccttgccctaggtcacacagcaggggaggaatggggtgggattcaatccctgtgcctggcttccgaaaaaggaggagcgggaggaggagggagaagggaagtgggtggagagaggaatcatcttcacagagtccatctccccaatgtgctacagttcatttgaggagtccccccaggttttcactacttttggctatcacaaatgatcagcacagatccctcatctgcaggccctggcccacgtgtgagcacacctgtagcaggtgtgcagaccctctcctgcctcccctgacctgttcttgtgttctagccattgctttctggatctttctgttcaaagaagaccaagaggtccttctctcacctctcactttgctaaccggccagtgggctccagagtgggggtgatgtaccccaggtgcagcagcgcatgcacaaggtgcaatctccgaggctccgggagaaccccagagagcctccctctgtggtcagggagtgacccctgcactcttagagcacagcaggtgccaagcatgagtgggtgctaggggctgagggaaaggcccagtcttttccctcgagaggattcctgtttggtagggatggcggggcacagcctgatgcttcccgaaatgtttgggcccaaatctaccttgaaaggagctggctgtgagctgtgtgcatttaacaatctgtccatttaaatttttgtggagatgggcagtttgctaataacttggatcggggagggtttctgtcctttcctgaggcagcaggcacatgagcacaggtgccagagagtgaagaacaggtttggggtccccaagttttttggctggtgggactaggaggaagggcctgaggagagtggcttttgggtccaggacagaccatttgctaaggtagcttgtttcaaagtgtggctgaaatcccctgagatattagcaagtccttgagtactgtaaaggaaaacagaaatcttgggacccccaaactctttatgccaaagggaaagttaagcctggagactgagtcagccaacattgtcatccttattcctaatgacagctgttactccacaaccttagacattagccagacccccacagaaaggaaaaggcctcggatatctccccatgactgcccccacaaattgttctttgctgggtgaaacctttcaagatgtggatcttaccacaaaacaaggacacatcaattgtaacttgaggtctgcaatccaagcctagctcctcacactcaagtctgttagagtcacgctgatggtgctgatctccccaggtacagcacaaaagcaagacaaaggcaagatgagatcaggcctccttctgcctaacctcctcttcctacatgctttctccacttcaaggacatgtgtaaatactgtgaaagaaaaataaaattaaaatccccagaccccaaacgcactaagccaaagggaaaagtctagctgggagctgggtcatgcaacccgcctcccgttttgtgtctaaatggataactatttacttccctcacattttgctcacagtgaaattccttgtgggccccaggatctttgccttcaagcagctctgttgtatttcaccctcatgatataaattaacagcttagcttcacaggtatggaacaaaggatagaacccaaagtcatccctctgctcacctgagacgagtgcatagctgacagcttcctatatgctatgatgatgatgatgattattattattattattattattattattttgagatagagtcttgctctgtcacccagcctggagtgcagtggtgtgatctcagctccctgcaacctctgcctcc

SEQ ID NO: 12527 - DNA, 18243 bp, Homo sapiens
tgcatttatgagcaatagcccattctcattttgaaatgcacccatgcatagcagtcaaagcagagactggagcccacccaggtacatgagatgaagcaaatgcctttcacacagatggtccgtcatccatagactagggataacagtaactgcctcagagggtttcgtgaggattgaatgagttgcaacatggagaaggcacagaacagtgcttggcacatagtaagtgctatatgaatatctctctctattagtattattcctaactcatgaacctggttatttaccagcaacacaacaaggaatatctagtttgcgcctttttttgtgctaggcactataccggatgccaaaaggggatagaaaaagcattttttaaagacaagcccctagggatctgttagagcagagggcgagagagtatggcactgggacgtgggggccacagctcgacccctcacactgagcagagctgcctgtgtctcagatccttcgagagatatcggcgtttgatgtcacctacaccgccattgtcatctcacattctggacgcatgatgtttgtgggcacctcggtgggaaccattcgtgccatgaagtaccctctgcctctgcagaaggaattcaatgagtaccaggcccatgccggtcctatcaccaaggtgagcagggccctctccccaggaacccagtcccacacctgcctgctacgtgccttgttcatcccttcaacctcccaatgtcttttctctctccttcttctctcttatttattcatccatcattcattgaatcaccatctattgactatgaatatactctttgtttaaactacttccaggaatttagcctaggaaatcatcagagatacacctaaaaatgtatgtacaacgttttcaccataatattatgcataataaggggccgtttggtggatgccgtagctgccgtgagtgtgggctgcacttgaccacagctgcctcctcctccagagaatgccccagactgaaaggagccatagccctgaagattggcccctacctctccctgagggtacaaaaggccaccccaggggcaataccatgagtacacatttgtaaattgtccttccattcacccttctcataaagtagtatctatgttcaacagtcaaaatgtggaagcaaccaagcatccatcgacagacgaatgcataagcaaaagatggtatatctatacaatggaacaataccctgcctaaaaaggaagggaattctgcaatgtgctaccacatggatgaaccttgaggatgttatgctaaattaaataaggccaaccacaaaaagataagtacagtgtgattccacttttaggagatacttagagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgcacgcgaaatggttgccaagaaatcatagccaatagtaaattaaaagttattcatagtgcaaaaaaaaaaaaaagtaatgtctatacctacactggaccccccaaaaaacaggcactgggaaggtatgtgtctcttcttccttactctctctttctgcagattgaatgacacagcacctgaggttttgagttatatcccaaactccttagtggcttacctgcaacactagctgtattaagaaaaggtttctcattataaaacagaacatttctgtaccaagcctgggccttgggtccaaagtaaattactacaacatattccacctcttcccttcagatctgctaagttttgtggataacatatttatttttctgattatagaagcaatgcatatttattttaaaaataaaaatccttgccaggcgcagtggctcacgcctgtaatcctagcactttggaagcccaaggcgggcagatcatgaggtcaggagatagagaccatcctggctaacacggtgaaaccctgtctctactaaaaatacaaaaaattagccgggcgtggtggcacgtacctgtagtcccagctactcgggagactgaggcaggagaatcgcttgaacctgggaggcggaggtttcagtgagccgagatcgcaccactacactccagcctgggcaacagagcaagattctgtctccaaaaaaaaaaaaaaaaatcctcataatggtatcatcatttctttgatgcatttccttctacatttccatgtgtgtgtgttttaaataaaattaagatcatactgtgaggccagtctcgtggcctgctagtttttaacttcacactactgtaagcgtttgtccatacaattaaatattcctcagaagcatgattttagtagctacacaaatatcctatcctatgatggactgtaacttactattctcttgcaattaggcatttaaattatcttatgatctatagtgaacagcccagtttacaaatttatatgtgcatctctgattctctcctaagactaaattcctagagagagaattcctgaattcaagagtattgctattctcaagattcttgacacatactgctgattgtgagaagacatttttcacagttaatccttttgttttaactttttatcttgaaatacttataggtttagaggaaattttaaagatggcacagagttcccgtgtatccctcaatcagtttcccccagtaattacatcttctagaactgtagcaaaatatcaaaccagaaaattgacatggtccacagtgtatgtagttctgaattatttctcacatgtacagtctgtgtaaccaccactacaatcacactatagaaccgttccatccccacaaagatctccatctgcccttcagagtcctaccactcctcccgactatcatcccgaatccctgcctaccactaatttgttcttatttccataacttttgtcattttgagaactgtatatggaattatactgtatgtggccttctgaaaatggcttttttattgatacgtagtatttgtacatattatgaagtacctgtgatattttgttacagtcatagagcatgtaatgatcaggtcaggatatttagggtttccatccatctcgcgtatttatgatttctgtgtgttgggagcatttcaagtcctgtcttctagcaatttaaaaatatacaatatattgttgttaactatagtcaccttactctgctatcaaacattagaacttatttcttctttgacctggcacgtgggtcatgcctgtgatcccaacactttgggaggctgaggcagccagatcacttgaggtcaggagtttgagaccagcctggccaacatgatgaaacccccgtctctactaaaaatacaaaaattagccaggcatggtggtgcacgcctgtaatcccagctactcgagaggctgaggcaggagaattgcttgaacctgagaagcagagatttcagtgagctgggagatcgtgccactgcactcttagcctgggcaacatagcagactctatctcaaaaaaaaaaaaaaagaaagaaagaaagaaaagaaaactgatttcttctatctaatgtttgtatctgttagccaatctctctttagcaccccaccaacccatacactcttccctagtatctatcatgccactctctacttccatgaggtcaacttttttttcttttttttgagatagagtgtcactctgtcgcccaggcttgagtgcaatggcatgatctccgctcactgcaaccaccgcctcctgggttcaagcgattcttccacctcagcctcccaagtagctgggattacaggcacatgccatcatgcccgactagggtcaacattttttagctctcacatatgaatgagaacacacaatatttgtttttctgtacctgacatatttcacttaacttcacgacctccagttccatccatgttgctgcaaaaacatgatttcattcattttttacggccaaatagtattccagtgggtatatataccacattttctttattcattcatccactgatggacacttaggttgattccatatctttactattggtggtacaataaatatgggggggtggggtggagcgcaggtatcctttcaatctgctgatttcctttcctttagaaaagtatccagtaatgagattgcaggattgtatggtagttctgtttttagttttttttagaagtctacatactgttttccatagtggttgtactaatttaccttcccaccaacagtgtataagagttctctcttctccacattcttgccagaatctgttatttgttgtctttttgataatacctactctaattggggtaagatggtatctcatggtggttttgatttgcatttccctgatgattagtgatgttgagcattttttcatatacctgttggccatttgtatgtcttcttttgagaaatgtctattcatgtccttagcccactttttttttttttttgagatagagttttgctcttgtcacccaggatggagtgcaatggttcaatctcggctcactgcaacctccccctcctgggttcaagagattctcctgcctcagcctcccgagtagctgggattaccgtgcctgccaccacgcccagctaatttttgtatttttagtacggatgaggtttcaccatgttgtccaggccggtctcaaactcctgacctcaggtgatccaccctcctcagcctcccaatgtgctgggattacaggtgtaagccaccacgcccgccccttagcccactttttaatgagatttttagatttttttgtttgtttaatgttgaattgtttgagttctttggtattctggatattggtcttttgtcagagcaatagtttgcaaatattttctcccattcgacaggtcgtctcttcagtctgttgattgtttcctttgctgtgcagaagctttttagcttaatgtcctgattgtggctttttccactcagctaaatcttcaaatccatccaagttgtgttgtgtatcaatcatagtttattcccttttatttctgagtagtattccatgaaaaacaaatcacagtttgtatagccattcacctattgtaggatatttttaattttttccagttttcagctattataaataaagctgctgtgaccaatcatatacaggcttttgtgtggaaataagttttcatttctctgggataaatgcccaggagtataattgctgaatcatatggtaagtgtatattcaggtttgtttttttttaaactgccaagctattttccagagtggctgtaccattttacattcttaccaagaatgtatgagacccagtttctctgcatcattgccagcacttggtgttgtcactgttttttattttagctgttctaatgggtgtgtagtgatatctcatcatggtcctaattttgcattttcctaaatggctaataatgcggagtatctcttcatgtgcttacttgccatctgtgtattttccctggtgaaatgtctccttatcttttgtctactttctgattggattgtttggcttttttactgttgagttttgagagtttcttgttcgttctagataatagctgactcttcagattccaaatccacagagaatgtagacgtaaccttacttcttctattcattaacagatgcctgtgagggctcctctctcattcttacctgggatcaagtttacctccctgtgaggctgtgcccaggattgcatggggggaagccttgcacaacagctggctcagccctggtcatctgtggccttgaaagcttcctggccatgaccctttttctcttcagatgttgcttacctttgatgatcagttcctgctgactgctgctgaggatggctgcctgttcacctggaaggtctttgataaggatggccggggaatcaagcgagagagggaggtgggctttgccgaagaggtgcttgtgactaaaacaracatggaagaaaaggtaagaactggatctaatgaagagggatatggaattacttaccagactgcattcagatgcaggtccagcactggggccctctacagcctggctacaycctatgcccagtgcagacccccacggctccctgcacatctgctgtccccacaaccaagctctcctcctcattgccactgtccacccgactctgcctgtctttctgccatgtgatcatcttgacttacactgtgctttgcttttattctgtgatctggttttctcttcctactctttgaaaccaagaataatgaaacatacagttctcttatgaccaacagttcctagcacatgctgggcacatggaagacaatcaataaatatttacaaaagtaaagtatgttctcatttaaatctcacaacatctctatgaagaagatactgtcattctccccatgtttcaaaaaacaagttaggagagcttgagggatgtgttcaaagtcagtgtgctaataattaataggactagagttctaatccagatttaatccagagccccctcccttaatcactataccaaagggacatcccttccttcctgttgatgcagtaaacattccataaaggtgtgttttgcagagatatgagtgcatagctctgtgttacgcttcctaagggagaagctgaatggatgataaacacacaaggctcatggaggatcgcaaagctacacagtcattgcygtttgtccagaatcttaagtgtgtttattgaacacctaccatttgctaggcactggggatgcacaygtgaaaagacagttgtgggccctgtgacatgaccaggaagcttacagtcaagtgagggatagaaacaagtaaagccatcagagcagcaatacaacactgccacaaagcacggtgacaagcccctggcattcgctggagatccctyccagagctccctagaattttctgcaggaaaagcaaagagggagaagaggatgagggaggggcccgtgagagtgggggcctgacctgctgcagaagggacatttccttttctctgttatcttttctgttcttcccagagggtaggggaagaggccaaataggagacagcaggctgaaccaaaggcctgaaggtgcccaagctggcttctgaccacagcccccagatgggcctgacagtaccgctgccaggctggaaatgacttgtgcatataccgctccttcttgaaactcccttctgtcttaccatccttgtgaccacactctgttccctgwaaacctttctgactcctcctccccgcttctgtcctgkctcttcctcckcctgtcccttaaaaagcatgttcccagaattcccaactctctttatattccattatagtctaartaactctcaggccatgatttaccttctctgcctaggatttacagaggggtctgctgtgtacctgacactatactaaggtctgggattacagagataaaagacataaagcatcctttagctgatagcctgggaagagggcagagtatcacaaagaagggaattaaacgtgcagtggaatgaagtgtcatgaaagaacgatgctgtgggagcacaggggaaggaacttggctcaggccaggtggtgccagaggacatgagccttgctcagatccttccaggacaaatggacaagggccagtgagcaatgagcagtgagtgtgtgcagagggatgagggagtggtggtctgcaaagctgctcctagttaggttgtgccagagagaagggctgaagatgaagctggagagaaacaggtcaggggggccttttacaccctgcattaggctggacattgttcataaggaccattcataaatttaagctggggaatgacttaacatgattcgcatctcggagagawtaatctgcagcaatgtgaagaatagatggaggaaggacactgaacaaggacctcaaacacagcatgtcaaaggccgggtcattcccatggataaatatatcccactagccagggcagacccctgggatcattgataagtattcattcagtgctgaccatgctgctagttttatgctaggttctggggataaagcagagaagcaagacaggccaagccccaccctcaggtaccggtccttctacctaggagacagccttcatccatgatccttacctctccaccccacacccagtcaggcactatcctctctaaactcactctctccaacctctccattcctctctggtccccttccctacctcagtccaaaccctgtctgtctctygcctggtctatgcagttgccgcccacccaccccagcaactcatcatcctgcctttggtccttccttaatctagtccgtgctgcgtaccgccattggagagatctttataacaccaaagtcagcctgatcgggttcgatgaggacctttggaagccctctaagataaaatccaaacttcctagcatggtctaccgggcccctgatggtctgacgcagtcttggctgccccttcctatacatccaacctgtgccatatcacatgcagtgagtgccctggccaggcattcctgctccatcctctctgactttgcacgtgcaatttgtgcttatccttcttctcagtacttcctgtgcaccagatcctcrctagtctgctggccaggaatgcagaaatgtgcgtaatccattccttgatgtcaagtcgttcacaggtggtagaggagacagaccagaaatgatgagatagggatgcacggggtgtccccataggtaagcaagaagaaaacactgcattctgacccactctgtcatcaacattaactttttaaggaaatgaagggtgtgtgtattatagtatttttagaaaactttggcatcattgagtacgatgggagaagacactaggccgggtgcggtggctcagtctgtaatcccagtactttgggaggctgaggcaggaggactgcttgagcccaagagttcgagaccagcctgggcaacatagtgagatccccatctctacaaaaaatrtaaaatataaaaattagccaggtgtggtggggcatgcctgtagtcccagctacttggcaggctgaggtgggaggatcacttgagcccaggaggtcaaggctacagtgagccatgatcacaccaccgcactccagcctgggtgacagagtgaaaccatgtctcaaaaaaaaaagagaaaaaaaggaagaataagaagatactaggcataaaaaccagcaagacagaagagttaggacctatattaaagtaytaaaagtgagcctaagaagacatcaagagggacagattggcagtactgagaaccacccagctttgggcacttaccacaatttgtaataatgtgtttgtctggctgcctcagtagactctaagttacatggggacagccatcatgcttcaataaatatcttctgagatcttactctgtgttagacattgttcccgtacttgggatatatcagcaaacaaaccctacaaagattctggtctatgtggagcttaagttctgatggggaaagaagaataaaaacaataaacaaaataataagtaaattgtagaaagtgcaagatctaaggaaataagaagtagagcagagtaagagaggtgatgggtcctgggaatgggaaggggttgcagaattaaacagtgtggtgcaagtcagcctcgtcaagcaggagatgcttaagcygacttgaatgagatgagcgcatgactagcacaatgtagtaaagattttttgaggatagaggaggaagctcatatgtctcctcatttttagctgatgtgccttctggggaaaagatgacaagttctagttgagacacattgagtttgaagctaggcagagctgcaggtctcaggtcaaggccgcaggtttaaatattctgagtcacccttactgtcagtgttcttgatccttctgtccttctcccaaaggctcaggttatgttggagctaaagactcgtgtggaggaattaaaaatggagaatgagtatcaactccgactaaaggacatgaactattctgagaagattaaggagctaacagacaagttcatccaggaaatggagtccttgaaaacaaaaaaccaggtctgtttaagagactgaccaacaagcacaaataacaagaaatttccactttcaagacaggactggcatatactgcccaagctatgctcaaacagtaagatatgtgaaaatgtccaattttaaagcatagtcgttgatatcagaaatgcttacaactggccaggcacagtggctcatgcctgtaatcccagcactttgggaggccaaggcgggcagaccacttgaggtcaggagttcaagaccagcctggccaacatagtgaaatcccatctctagccaggcatggtggcacgtgcccatagtcccagctactcgggaggttgaggcatgagaatcatctgaacctgggaagtggaggttgtagtgagctgagatcgctccacagcactccaacctgggcaacatagactctgtctaaaaataaataaataaataaataaaaataaatgcttacaatcaattgctaagtgaaaaaaagcagaatataaaccactttatggtgaatggtattaatcggtattagtggtattaacagattaattaatctgatctatagtagtaaaatacatatagaaaatagataacagtataattatctctggaagttgagattacagataatttaaattttgttttacatactttttgtaatttccaaattctctacaatgagaattatgattaggagaaacttattttaaaacaaaatgaaamgataagaaaaagcaaaaagataagaaaatcaaagcatagatggagaataactagcagaatactgattcctggattgtcaggaagttaaataaaattagtctacatggcctttacatagttagatttggtctgggactctcccagattcttttctttgttctacacaaatctggactcctatctaaaatccccactgggcaaggtggctcacccctataatcctaacactttggaaggcctaggcaggaggatcgcttgtatccgagagcttgagaccagcatgggcaacatagtgagaccctgtctctatgtaaaataaaaaatgagtctgccatggtggcatctgcctgtagttctagctacttgggaggctgggatgggaggactgctcgagcctgggaggtggggactgtagtgagtcatgatctctgcactgcactccagcttggatgacagagcgaggccctgtccctcaccccctaaagaaatccccaattatgtccttgagggatatttgtttctttaatgtctatgggtcataaagttcggctaaaaaaaaaaagaaagaaaaaccttggctattaattgtattaattaattcactttataattttattcatttagccaacaaacatttatttggtgctctatataagccaggcgcaaagttaggtcctgaagatggcacaccacctccaactcgccccccaagcctgaaagctttcctgctcagttaaagaaaacacttcctcagaagcttacccatgagcacagccaaggattttgttgacagcaatgtgctggcaacagaggattcaaatgaatccctactttttcacccagaagtccttttgacacgtgtccaaaactgaactcatcattgacaaacccatttagtagcaagaatagaaataggaacagtatagagcttttagagcagaatataacataaatgaaaagtgacaatgtggttgctgcttcatagaacagtgcttggtgcaaaatgagggcttgagaaatgtttgtgagtgaaggagggtgttacttgtaaaatcagttcttgccctagtagtgctttcagcagatgtgtgtaaatgaggaaatgtgactctgttttaggtcttaagaacagaaaaagagaagcaggatgtttatcaccatgagcacatagragacctcctagacaagcaaagccgggaactgcaggacatgggtgagcccacaagtagaggcctcgttggttagggttggaagagctaggttatggggaaacactcaagagtcccccagacacagtagaagtctcagggaatatggctctgtctaaaaacaggctacatgtatcccctggaactcactgtggttttcacttctgtgtttttactcattcactaagcacattaaacacctattgcatgaaagtaggaggcacggaaaaggtcaagtttggaacctgatagtcttgccttgggtcccaggctcaccacgtacttgccaggtgctctggggagtcacctaaccttaccgagcctcactttgccataaagcaggagtcctaatacttatttttcacactcaggatattcttcttggccctgagtccccaaataccactctgtgctttcctggaaacttttcttcccagagcaggcaggcagggagtttggctacctgatgagatgatgggatgaggggttggcagcaaggaagctaggcaggcatttgaatcttggctctggaggcagctgctccagctggtgctggaagggatgggagagcgcccaaggctcctgggtgtccctgaagcaagtgctgctctcccaccttaaataccatccttgcttctctccagaatgttgcaacaaccaaaagttgcttctagaatatgagaagtaccaggagctgcagctcaagtcccagaggatgcaggaagagtatgaaaaacagctccgggataacgatgagaccaagagccaggccctggaggagctgactgagttttacgaggcaaaactgcaggagaaaaccacccttctggaagaggtactcacaggaagccatgctgtgcctccctttcacagagaaaagccacccattcactcagatctccatggcatagccactgtatgccaggatgtgttatacactgggtcagacatggtttctacccccaaggaacttatatcaaatgggagagacagccaaataacatcgcaaataaatataacattatgactgtcacaagttctgtgagagaaaaatataggaaggctgggtgtccagtgaacaagaccaaaggagaacagggatggggtgttggtaagattggggttgaagtggtggagcatgaggcctgatttggtaggaaaagaggggaggcaggaagacaggacagacgggaagaaggtggacaggtcaagggccctgtggccatggtctccgtttctggaatgacactcgcctttgactccctgggacaggtccccatgctcatctcacctcaagccctgttggcacaaagatgtgtgagtcccttctcccctgaccacacgcccactctctctgagccaggcacaggaagacgtcaggcagcagctgcgggagtttgaagagaccaagaagcagattgaggaagatgaagaccgagaaatccaagatatcaaaaccaagtatgagaaaaagcttcgggatgaaaaggaatcaaacctgcggctcaagggagaaacaggcatcatgaggaagaaggtagcaggctgttctccaagagacctagggtgggcgagggtgttgcagagaaagctggggtgggtggactgaccggcctgggggtgctggccagggtcctgcctgtccccatcttcagcgagcaggctgggagaagagcaccagccagtgcaccctcacgcagatggaccctccccacctcgtccttggaaaggcagctgcacgggcttccctgctctccttttcacaggatattggggttccctgtgtgcagacagaggctttctagttttcacttactggcaagtaggattcagttaatgttttctgagataaccctccgatggaaatggaaatggaaataaggtcttctggggatgagatagatgaagtcttggccgggaggcatcctcgggctcttggtccagggagtcatgggcggctcctgttcagcaccacaggtgggagagggaatgggggtgtaggatgcttagtttacaaagtggggaagatgtttttagttcactcaccatcaggggtgagggaggattcaactcagtttccccaaaacatttagccctggaaaagctaagttcaaagcaagctgaagtttcttcctattagaaagcacactagtaaatccagggaacaatcagtcttcccttcttggtcatggctaagatggctcatcagttagggcccactttctgtgaccttgatgcagtgtggatcccagcttttcaagatcagtgtggtcatagaagtctctggtccacttggtgtaccggtctctggaacctcttgtgaagacagtcagtcctctcatatggagaatgggcctggatgttatgggacagaatactacatcatccatttggcctgggaaattcctgaaccgtcccaaatgctccagatattcactcctaaaatcccagaaatgttgaatgctaagtgttttcagtccacagaaggtggccagtggtggggagccccttacactgagacagtgggagggatggagatgagttctgactttagtggtctttgttgttgctgttcgcttttctagttcagcagcctacagaaggagattgaagaacgaaccaatgacatcgagaccctaaaaggagagcagatgaagctgcaaggagtcattaagtctctggagaaggacatccaaggcctcaagcgagagatccaggaaagagacgagactattcaagacaaggtgcagctctccttctgtcctccctcagctacggccagatgggccaaggcgaggaaggcaaagctcaggggagagagggtccctagcttctcaggacgcatttctttaacttgatgggggaaccagccgtcagtgaagtgcctgttgtgtgcttggcactgggctaatcgctgtcaacacatcactttcagctctgccaacaacccagggggcctgagaacccagtgttatggttcgggaagctgaactccaagaggctgggtatcttgcccagggtcacacacttcaataggtgacaggctgcaataagaaccgagtcagctgactccactgctccaggcatccttggaggtgcttccccatgggctggggacagctcacttgccgcactgaccacatggtccccctgtcgcagagggactctcctgggattgaccctgtccaggaggctgcctccacttttgggatgcctttcttacaaaacactcagacgtcagagacatcacattctgtggggcagatacctcaatacccagtatgtagtatcatcctcctgagcacatccagattccgtgccctcctctccatctcccctgccactacggcccaaggcaggtggaattctccaagggccaaggacgtgggcttcagtgttagggaactaggtctggcacaggttccatttattgaccattgcacctcgagcaacttctctaagccttcattttctcacctataaaatggggatgataaccacctcaaggggtcttgtaaggatcacataggatcatgggatcatgcctggatgtcatttctgcatgtgagtgtcggtgtacatatccagggttttgtttgtttgtttgtttgtttgtttttagggaagatccaaagctctgttcagattctcaaagggggctttgacaagaaagagacaaaggcctcctcacctagaaagtggcaacagcctcctaagcagtctaatggcctcacttcccatctcccaccaccatggactggcagggtacaggtgcaatgctgccactctcctgctcaaagccctcacagctccccattgctacagcaggggtcagcacgctctttctgtaaagacctaggtagtaaatatttttggctttggaggccatgtggtctgtctcaacgaatcaacaccgctgctgtagtgtgaaaccacccataaacaaaacattagtcaattaacttggctgtgttccaataaagttttacagaaatagacagcaggcccaatgtggcccacaggctggagtttgccaacccctggcctaggagataaattctgaactctttcccccaacatgaagaccctcacctccctcctctatttccccagcctcacctctcacttcccccatgaaccaccgcttggctctcaagccagtcattctcagcaccctcaatatatactttgccttctgtgctttacaacatttatcacattttaggcttagatttgcttctgtgtcttctttcccaactagtgttttcttttaagggcaagggactgtgttgtatttatatttggaaacccaatacttgacaaaagatcttcattcagtaaatgtttgatggatggatatacttatgttctgattactatcaccgtgcaacaaattaaccttaaaacttactgattgaggccaggtgtggtggctcacgcctgtaatcccagcactttgggaggcagaggcaggtggatcacttgaggtcaggagttcgagaccagcctggccaacatggtgaaaccccatctctaccaaaaatataaaaattagccaggagtggtggcacatgcctgtaatccaagctactctggaggctgaggcaggagaatcgcttgaacttgagaagcagaggttgcagtgagccaagatcgtgccactgcgctctagcctgggtgacaaagtgagacccatctcaaaaagaaaaactaagtgattgaaagcaactattttattctgcttacaggtgctacagatctggaatctggacagggtacaaaaggatggcttatctctgtccccgatgtctggggcctcagctgggaatactgggggtgactcaaaacagctggaggctggaagatcaacatccaatgtggcttcttcagtcacatgtctggcaccttggcaggggtgtctgggaggctaggctcagctgggtcttttgatcagagcccctaatgtgcccaccagcctggatgtctcagtgtagttggacttcttacatagcagatgccctcccccaatgcaggtgtcccaagagagccagataaaagctgcttggccttttttggcctagccttggaagccacacagtctcccttctgctgcattatttgggttacgaacaagtcacaagtcaaggcaaatgcaagggaaggggattcgcttccacctcctgatggagaagcagcaaggtcacgctgtagaacagctggagtgtggggcgggagatgctgtgggggccatcgttggaaaataccgctgttcacaacctaatatgaatgagtgagtgaatgcatgagagtccttgtacagaggctgaggggtctgtgctgtagccccatggggggagtgccagcctctgtactgacgaagggaggagaggagtctcctggttgacctcttcaaccaggagagtcacaggcttcgtgctcttttgccctaaagggctgcagtataccagggccttacaatatctctcacttctctctcatctcacccccaggagaagcgaatttatgatctgaaaaagaaaaatcaagaactagggaaattcaagtttgtgcttgactacaaaataaaggagctgaagaagcaaatagaacctcgagagaatgagatcagggtgatgaaggaacagattcaggaggtaagaagccatttgcaacactctggcctctcagaccctctgtctcttcttccacaattggctagctggcctcagggactgaggagaagctcttctcacagtcctctctgctcccaaggtgtgtgcagcctccagtccacaggggtgcaacagggaaggccgtggccccgctgcaggctcagctgtccgaaagcaaatcgcttgggagttaacttgccacgggacctggagatgggctttggccctacccgtgcctcagtgtgcggtgtactgtgccctcctaagggagatgcagctattgggcatttggccaccagagggcagtgtgtactcagccaacaggctatccttctagttcagcatttttttctcaaactggaaa

SEQ ID NO: 12528 - DNA, 15489 bp, Homo sapiens
cccctgcacccccatgcttatgtctcagagatactcacatgaaataggatgccagaagaccctgtgttggtcttaaagggcaaggaatcgtactaagctacgtaaacaggtattactgagtctatgtagtgtcccgtctcaaaacataactgcatcttaaccagggcctttggaaactcaaatccaaaggattaaagacatctgggcaaaaatactccccgtcgtggctaaaaggagcaaaacttagggactcctccctaccctgctatttttaccttaaagaaagtttatttcatgcagatagttgcaagacgaaggaaaagaagaataagtaagtggttatgtattgagcattagaatagcccaggactattgtaaacacttggcatcaatcagctcatccaatgtgctagggcctttcacacccaatcctgcatttaaccttcaaatgaccctgcaaagcaggcagcacaatcaccatcccacaggtgaggaaacagatcttttaagacattctgggcacaaatatgagatctgggggagagtaaaaggggcagcctgggctatgcagggggaggggcgggaccagagggctccactgaggcccggcatctgggatggattagaactgatctcaacacaccaggggccaccccagcagagcaagggctctgggcacaccaggcttacaagtcttgaaagaaactccctctgagaggtcagctggccacagctgaccctgtctcttcccccaggccaccctctgagctgtgggcacacagaccgatttgcctactccaccccccttcagcttaactttggaaaaactcattcacattgaggtgaattaggtgacagagtgcacttcaaaagagatgttataagaacaaggcttaactcagagcataagcagctcacaggaatttctggcagcctgggggagtgggtcctcccccacactcaggcctcctccaaccctgctctggccatgctctgtgtctgaggcctttggagcttcagggtcaggcatgtgaactcagcgcattgtccctgtgctacaatcccagggcaacacctcctgaaaccactaatgccattcctcccaggcctgcacataaacaaggtcacaggggcctctctccacatccccgctccttcctccctccttccctccggtggggctgctgggagtccccagcccttcctgcttcaaataaaatgatacacgaaaacatgcaatgctctctggctgtaagagaaacactacataattttagagaatgctaagagttcatgtcttcactgacattttttccatatgaaacagcccatttcttaattgttcgaaataaagttggctctgctctctcctactcaggtagtgggaagtaccacctcaaacaggatagggggaccactcctcatctcttggggttctgtagtccagaacattcagggaagactgccaggactcagttcttttcaggactgcagagtgaagagaagccaacaactctgaaggcggcaggagccggctcccactgcaactccaagcctgcccaccagtccagtcctctctggcacccacactctcctcgcctgcaatgcctattccctcaaggcctgtgggggcttgggacttcccatgaagtcatggtccactcggctctcccctccctgagcccctccatgcttcctcctctcctccacctccatgctacattcaatgtatcccctccccttcaccagcctcccgcttcgtctgtactggcctttggagctcagaggcatgttgtgatacggttcagcaggtcccaggccctagatccacagccgcccctgggggctgatcctggggccctccatggctccaggatgaccagtttgcttcgcccttctcaaagagaaaacaaaaaccctcttgaatttttacatcttgctaattattattttttttcatggtactgggagaatgcagaatatcagaaaattacaattatccaaaaacgtccttcagttatccagctgcaagaatgccagcatttcaatgctgaaaaatgtcaaggatcatctctagggtagtttcctcactttgcagaagctaaaacagaaccagagacagagaggtacagggagcaggccaaggtcacaaacagttccaggtggaatgagaactagaactcagatctttctcctctgcaaaattgctcaacaagaaaaaacagacaaaaaattggcggggcgcggtggctcacgcctttaatcccagcactttggaaggctgaggcaggcagatcacttgaggtcaggagtttgagaccagcctagccaacatggcgaaaccctgtctctactgaaaacacagatattagccgggggtgatggcacacacctgtagttccagctactcaggagtctgaggcaggggaatcgcttgaacctgggaggaggggttgcagtgagccaagatgatgccactgcactccagcctgctgaagagagcgagactctgactcaaaaaaaaaaaaaaaaaaaaattagcccagcatgatagtgagcctgtagtcccagctacttgggaggtggaggcaggagaatctcttgaacccaggaagcagagattgcagtgagccaagatcacaccaccgcactccagcctgggtgacaaagtgagactccatctcaaaaaaaaagagtccagacatggtggctcacgcctgtaatcccagcactttgggaagccaaggtgggtggatcacctgaggtcaggagttccagaccagcctggctaacatggtgaaaccccgtctctactgaaaatacaaaaattagcctggcatggtggctgaggcaggagaattgcttgaacccaggaggcagaggttgcagtgagctgagattgcaccactgcactccagcctgggtgacagatcgagactccatctcaaaaaaacaaacaacaacaaaaaatctacctctggctcaaagtaacacatgctcatgtagccagaaatgttgaaccaataactaggtgtatctcatgctagtttccacaataaggcatttatgaaaccaccagccctacctgttctaaataaatgaataaaaatgtggatgctaattgaagattagcatcatctcccatccatgttaatgtgctttttggttatttgcaattctcttttgtaaatctgaggtaaacatcattgtccaaattagctcttttcactcagtaaaggccatattagcattctgaggtttgcgtttgcctactgcttatttagtaaggtcagatgagaagctagtcaaatgacttccatttcacttaagaggcgtaccgagtggggagaactcaagcctccaaagcccgaactccctggcagtggctccccaggtccctcccctctctcagtactgagccacagcactgctgggagcagcaactaccaccacagtggtctcccgggaagggctggcccagatgggtgacactgagtcaggtggttgcaaggtcctctgcctggatctcggtccccgtcccctcagcgctgccgccgttatcatcaatgacagctccaatgtcaccttctctcttgccccactgaagtggccatcatcccccaggcactttctatgccacactttcacagcacacgtctcggcatccagagggctctttcatgtctgcctggctcccctgctggaaccgagctccatgaccatagcaaccctgcccactcacgcatccctgaagcccgggtgctgacaccacagatgttcaatatttgttgaaggaatggaagtaggaaggaaagtctgagctggtcagggcttctggagtaactctaacaaggaaagcggaggctgcacttgtggtctcaaatcttttccaaactccactgcgtaaaaaaaaaaaaaagtctttgaaaccagactcgcatccaaatcccaactactttaaccagtggcaggatcactggagcagatggtttaacctcccagagcctgtttgctaaactgcaaaatgggggaaatgataccatttaggttaagcgcctggctctttctaaatgttggctcaaacggtggtgacccttcccagacttccaccactactggaagtttgcgtcccaaagcagacaccctcatcgccttggctccgaatgcagagagctagttccgagaagccgaggggaagctgaaggcgcgccctggccaaccctccccacgatcccccgccgcaacccctgtcggccccttccagcccacagtgggtggccccaggcctcgctagggtcacgtctctcgggtccccgcgcagggaagggtccaaccagcgactcgcaaccttttcggggtcccgagtccaacacccgtgggaatcccatgggcaccatggcccctcgctccaaaaatgctttcgcgtcgcgcagacactgctcggtagtttcggggatcagcgtttgagtaagagcccgcgtctgaaccctccgcgcctccccggccccagtggaaagacgcgcaggcaaaacgcaccacgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtgctcgcttcggcagcacatatactaaaattggaacgatacagagaagattagcatggcccctgcgcaaggatgacacgcaaattcgtgaagcgttccatatttttacatcaggttgtttttctgtttttacatcaggttgtttttctgtttggttttttttttacaccacgtttatacgccggtgcacggtttaccactgaaaacacctttcatctacaggtgatatcttttaacacaaataaaatgtagtagtcctaggagacggaatagaaggaggtggggcctaggcagattcatctctgcggtgcattttgcctctggccctcgggccctagtttgcgatctttcccatcttgcctctgcttccctctgcacaatcctgagtattgcagtaccttacacttaaggaaatttcgtcttgccaaagttgatccatttcagctccgaaacataacaggaactagtgcaacgataaacgtatgaggaacttgcaataagagtgacagaatcctttgaatcaaaaaaaaaaaaaaagccaccacttaatgagtatctaccatatgtcaagggcttcaccaatatttcattgaaatattccagaccaaataaataaataataaaagaaaaaaagaaaagggggagggggcagaaaaataaaataatgtttaaaaaattcctgacagccccaccctgtgggttttactgttttactgtcatcattttacaccaatcactgagaggtaaagcctgataagacttacagaggcacagaccctgaaaagatcgggacccaggtctcaggtaattgagttacaaaaacacagtcccgagtggtaagacaaagaggaaacaaagtccaaccacgttcagatttcctgcgatgacttaggcaatgttttctgaaatatctttccaacagaaaaatggtgcaactgctttgctagtgcttcagcatgcacgtgggccctgcggccactgggacctcagtcgatctgccgggagcggccgcacagctcccagcctccaggcgcgccgcaggaggactgttaggctcgaagccccggagccacccagggacagcggcgggtactctaccagcgggcgctgggagctgccgggcagcattccattcaggactcattccttttctcttcagtggaagtgaaatgatcctttccaggtaacagccgagmataggggactgcgggacatctccgcctcttccttggctctgggccttcgatgtaaggcgttagaggacaatctttgttggctggatttctgttcttcccctagagatatctggttctttggaggccacttgggcaattgggtgagtagttttaaatgtctcccttgggatgccaaataagaaaacgaccaatgtcgatgtggctccctctctttcagcacagacaacccatcagactggaatattattagtctacgtatgtggaagggggtgttatggggagtaaaatagaatccaagagtgaaggacttggcccaaaaaggactgttgagattgttctaaagaaactggtcgggcgcagtggctcacgcctgtaatcctagtactttgggaggctgagctgggaggataccgaggtcaggggttcgagaccagtctggccaacaaggtgaagccctgtcgctacttaaaagaaaagaaaagattagaacagaaattaggaaaragacaggcagttcctagccccagaaaatccagagacctggctgacttcctttcctctgcactaacctgctgagggaacttgggcaagtcttcgcctctttggacacatagagtcaatgcattggcgttgcaggatgcccttccaacctctgtgcttctagattcttatgaatgtgtctccagaaactcaatagtccatgcattggcgttgcaggatgcccttccaacctctgtgcttgtagattcttatgaatgtgtcttcagaaagctcaatagtccaggcttgaaaaagcaccggtttgtcctcctttctgggccccctttctgggcccctggaggagaggagggtgatggactggggtacattttgggactctaaaagcattcctggcttgagtctcaggaaagtgaattcagagggagttgtaatctttgcaaacaccaatacaatagcacttcttgtatgccaggagctgttctcagtgctttacatatattaacagaaaacagttctatgaagtaggtactgttaatctccctatgttatagatgaggaagctaaggcacagagagattcaacaacttgcccaatgtcactcatcaatgacagggcagcattgagacctcagtaaatctggctccagagtttgtgctcttagccaagcatctgaggatggagagaggagatgaggctgtttagaattcatgggaagagcatgcagatccagttctgcttttgttggtgttctgaattcaaggcaggagtcacatgtttgyaacggatcaaggctttagagcagggtagctacgaatgggtggacctgtgtgccagtgacctggaaaagtatgacggagtgaaggaataccccctttaggacacagttggaacaggaacaaagttttccttttctaggttaacaatcacttayctgatacctgctcccaaaacgaatcctattgatgaaggatcttctttctgagcagtaaacctgtgtttaattaaccttatgcaaatgagcttaattgcttatcagtggctgttgtccagaagcacctagggattccttccctcagacattttcagcacctagatgaaccgcaaagttggaagcctttcatctacacatgtgttgtgtgcctgtggagccctgggccctgtgttgaagattgcaaggaaaagcaaggtgtgacccctgctgtggacttactttcagtcttagggcaacagacacttacaaccaagaataacaaagggaggtgagtgccctgctagcctcatgaaccgagtgccactagaacacagagtcacctgtgctccaggagttaaggggtcttctaagtggtgcttttgcacacagkttaccctgatttgcagaggaaatggagatsggaagggacttactgctttctcccgtgggggtgaaaaataaacccacttgatgctgtctccaacggcggctccaactttgctcagtctctcactctggatttgccagaacaggtggggatagagatcatcttcccactgcggatcccaagaggggccccggcttccgtkcactcttgtcccttaccccagacctgggactccagagccagacctcctgtaggcaccgctggggaccaggccaaaccaaacactccaggagaacagcccacaggatattctgtgttcaactgcctcctccaacttccaggccccactttttctccctgggaccccaggcaccctggtctgggccttcgggcgttggctgtaatgcttaaaatctgtcgcaaggtggcaacattgtggcgagaaatagactttttttaaatcctgggttttttttttcaaagcatattttccctattaatgtttcatttaacttaattagaatctggtaaactaattaaagtagctacgagccccgcaatcagcaataattagtataattattgataattacatccataccaatcgtttggttattaacatttttggggggaacaaaccacttctgaagggacgcgaagcccgggagggtttttgcgactgagctttctgggtcggatccgcctacgactccagtccgcagagattcctgcccagatggggcgtcccttccggagggccccagctgcctaggagcttttccactttggggggagttgggaaggaagggtgggaaggagcatttgcctggctcctctgtcgagcygcagccacggaacttcctgcctgggtggtaatggtkatgcccattttacagagaagaaaagtgcagcttccaaaggtgcaatccgcggtggggaaaggggccggcaaactcccacacccgcgctgtcccgccccgtcgcagttccgcgggccctggcgcggcctggagactccagtctcttcctctctggacctcagtttcgccacmggtccagcggaaagcggatctggtgggtcccatgcatatgaaacgttcccgctccctagaggggccctgcccggagatggcctgtccggaggcgatgcttcgccatttgccggcgccctcttcattgttatctcctttgtgtccgctctggtcttagccstcggaacatcctgggactccaaggctccgacccccagcgcaaaggactctagggactggcttcctggctgtaccgcgcagcgggactcctcgtctgcacagcttcggggaggcccagagcacgcccctactagccggctccgtccaaggcccaccaagacaacccgccacgaaacttcccggccccctcagcccagggctcccggtcccgagctgctggccggtggcgcggggcctgccgcccgccttctacgagccgcatggacggaggcctgcgtgttatttcatagaggccgaaacggagacccaggaaagataaaagaagggctcaacccgggacccccrctagccagccgagggcgagaaatgaaagccaaggctgaatgattccctgtgccgtgagctctctcccactccatccacactctcctccctgcaaagagtgttctgcaatttgcagcgtcgtctgtagcccaagcaggaggtgcgctgtggaaactgaggccgctgggaggccttgccaaccgtgacccggacgtcggacgccccagccgaggcccggcgagtccttagcccctctcgaactaaaatggaccgaacagaaaatgcggacggggctccctcctttcgggtagcggcggggcagacgggaggccgtctgtgaccgagctctccaagtcccgccttcctttccaagcctgcccggcggagaccaccttactccctgagacctccgccctgccgcagcgctcccaggccaggccaggccggcggtgcccgcgccatctaaagggacaattctggttgaacctgggattcccggcagggcgccctgtctgtgagcgccccggaggtaacttccccggtgtggcaggcgtggaaatgggcatggatgaaccctcggcgccttcgagctcttgaggaaagagcccgggaccgctgcgctaaggaccgtgacgtaatgcccctcctccatcccgggcccaagggagggtcctaaacgcggagagggagtgccctgtgggggaaaactgagtgtgtctggagggcacagtggagaggttgagtgctcgctgctgcccacttgagcaggcccgattctgaccctgggagccccagaacccgcggggcggctcccacccccacctgttgcacggtgttccgccgccccgctccgccggtgcactcccacctccgtagccccagaagtgacatcttttattattattattattattattaaaaacgaaagtcacgggtacagggtggtctccccaaacaggctccaggtggttgccatctcgtgagtcagttgtcgcccttttaaagtgctgttacatcaagaggttacaacaaaaaatagccaaagcaaaatccaaaggggaatgcaaaacgggactggaagtgggtccaggagaaggaagcaaaaataacttacagcataaataaattaaagtgaacctaatactgaaccgagagactcacagtacatttatatccattgcacatagccactttgtcattaggaacaggagtttcagaagtggacgggacggggagtgcggggcaggcgccagcgaagttgctacattgtattcacaatcgggttcaaggctatacaatgggagggggcgctctcccctcccgccccccgtctgtccagttaaccccttgaggtccgatgccctagagttcacacggggtagggggatttgaggcgcgaggcggtatttacacttggaaaccaagccggggccctggacagggacgcccgggagggggcgggcaaggccggggagcccgggaggaaggcgggcggacgggcggctgtatttacatcggtcgggtccgaatggcttgttcctcgctcagggccaccgcagcagcgggtatttacaaggagcagcatggcttgagggcgcaggggtgcggccaggccggccctagggcaacagcggtggcttgaaggagcagttgccagtgcagtggcggggcgtcagcatcttgcaggagaaatggtgcagggcgtcgtgggcttctggggagacagtcgcgagggtcactctgggcgcctctccaggctcacctcaccgcgcagtccaccctttcccctccccggccttaccaaccctttggggtcagggaatctcaaccgagcggatcaggaggaggcaggagggtaggacaaaagctggtgattcagaaccactgctctggttcagtagccccattttacagaaaaggaaactgaggcacagtaagagaggagtcaacctgctcaaagccagaattggtaatagaaggcagatttttctgacgtccaaagcccaaggggctctttctttttacccccaccatcctagaataatcttcccgttaaaatcagttcccacttttctccctcacagatcctgatccacgtggatcgtggccttcctcactagtcccactattcattcattcagtcgacagcacggccggcacccagcacccctcctatctttgtttcccggcttccgcacctttcaatttctgctggatggcatagcgcgccttccgctcctggtcgagttcgttacacagggtatctggaagacaaggggaggggccagtgaggaaacgcagaccaccctccgaaaggccggggtcacagcccgggcttcctcctctccccagggctaagctccgcgcagaaacaactccagggatgggggagggggtaccggagctcctaactgcagactggcggaggaaggaaatggcctgggatggcgcttaaaggcagatggatctaaccaaaattaaagcaaacttaggcattacttcccaggtaattttacgcctcgatttttaatttagaaaccatggaaattgccgcgataagaagttcaatcactccatgtaatgatgcctgcaagccgtttgctgggctcgcttgccattctgaggctaatcagagtatacaaagcatattaaataaaaaaataattgttaaattaccttcaatttaaatccaaatgactgagccaacattgcggctcctgccagacgagaggcagttacggcccgtgcacgagctcacctgactcccgtcttacctctgacaatttgcagctgttgcaccatttcttctcgataagccaattccctcttcatttgatcctgaaaattatctgtgcaaattgattaagtgagagctgttacgcacagccccctctcccggctccactttctcactcctggccccccctttcacccctacccgcaactcccacccagccattcgcctgcagccctggaaaaggacagtttcttgtctcctgcagggcacctagtaccagttgcctggcacccggctttcggagtaggtcggggcaccctggtggaaggctcggtgatgaggtggggtgaggcaggatggcagtgggtacctttgagactctgaaattcccgttccagcttcttgcggagctccatttgttccaggagcagtttttgcaattcctctgtgaaaggggaaaagtgggaggtaaagtgggaggtaaagcagggttatttggagctcaggttctgccttggccaacaaccctgaaaggagagttgagaaggatgaccagtaggtggaggccctccgctctctggctttaccaactgcattcaaaggatttgggtgaagaaactgggctgtgggtaggatgcccaggagaataaattcaggacggtggaatctaggccctggctccaggaactatgcagctgggcaactgctttaagttgttcctcactccctaacctaagaggctggcccacggaaacttgatttcccacttcaagtgacagaccccgcccccgccccggccccgacctcccccccccgcaccgccgccctttcaatataaatcagggaggctttggtcagagccttggacacctttcccagaaaaatacacatacaacagtttgcctacaatttcaggaggtctgaagactgccaaatccatgctaagaaccctcactataaagcaccagtgattttgaaggtaatggcattttctgtaaatctgtaactaggaagaatggaagaccaccaatgcttgtcttcctcctgccacaaattcccaagaccatctatgggctagttgaggggcagggagctaggtgtagaggcctctgttagtgccctcagaaccaactccagagggatagatgtggcaactgccctgaccatgaggtcattggtatctgggccctcctccaggagaggctcctctgaaatgcaagaatggaaggtagaagggcaaagtggggctagggactcccctactctgcaccccaagccatagtctcctccttacaggctgagcagtaacacagggatccccattctgcaaacaagctccatccacactccatttagggtaaggtggaggtggttatacctcaatgccaggagaaaggaaaacacctctcacattcctaaaataaatgctttcctgcaatcctgcattgaaatcctgttttccattgaattcagcggacccagactgtcctgtctgattgtccacaggcatcaaaaattctgatcatcgttactcatttctctttctggcaaggctattcagacagacccgggccttgggaacccaaacttccaataaacttctgggggtttgttttactcccatgctctacccacacatacatacctctgtgccagggtaatgtgtccagaggatcttactttccacccaaagaaaggaaaactcatgcccccaaggccttggtgagtgtcttttccacactcaccccctacagggataacacccctctacaggaatgacccatcactctcaagcacagcgtacacctttttcacaaatttatcctcacctctggccaggttctcgatatctttctccaccaaatgagttcctgtgacatccaaggtaagcccatcttcgcctgggatacaggggcaggtaagaggggttctgtcctaggaaagcccttgagaggggaggggtgagcttcccaggaaccacatcgaatcagggacctaccctagaccttctgcctttagaggagacagttacaggaatccagtactatccaccttctaggacattacagtagagagtaggagagtgacccctggaggagacggcccagggaagatgggccatctaagggcaggaaatgccctttgacctattttatgtgggtgaggacgtccctccatttccttttagtacatcctctgcccttacctgaaagaacctcaaacccaccaaggaggcagcaattcagaaaacctggcctgcaccctgctcgcgttaaatatttatctgctcgccgaggaagaagactggcagccgcttacacttgattaaaagcctttctcgcaagcctctgggaacctgggcgacctgggtcccagctcctgggtgcggtggagagcgatgggttcaagggctggctcacctctgtctgtatttgcaggacttggctgggagatactcctttggtctggataggatttcctcgtttccaaatcatcggcgggcgagtgattgtcttccttatctggctcttgaaggcaacaaaccgaatttcaagagaggcaaagaaaccgtgacccggatactgccggagctgccgcggtcggggcgccccagccctaattaaaagcgtcgtggccgcctctggttcccggctgtgcgcccaggagcgcgccctgaggctttgggccgggcaccccccacccccgcgcctggtctgctcatctccgggcttcaggcccccgccccagccccttggaaaagagctaggcgagcagccgagcccaccagggacgagcgacctacatcgcgcgcagatactggggcaccgcgagcgcgcgtggccgccgggtctgtccgcccgactcctgctgagaacgcggcccaggctgcgaccttcggggtgggtggggggacatcgtccggggttcggctgcctcgacctgcccgattttccgctgcccccaacccctcctctgtgaggaacctggtaaggcgcgcaagtgcagggcggcccccaccaccccgcgatgggcctcagctaccctggcgcttctggggtacccaagcgcgcggccatgtgcccccatcctccgccccgatccggcctagccaaaggggaccccgcggccaaacacacttgctgaataaatgagaggatttgaaggccgtgtcgggcgtgattttgttaagggtttaacgccgtgtctgggtgtactgcagcatgtgtgtgcgtgtggtggagagggcgttgtcactgttgtttttaagtaactaaagattggaagttgttgggagtactagcttagcttccttgttttcattatt

SEQ ID NO: 12529 - DNA, 12429 bp, Homo sapiens
aaaaggcagcattactgcctgctgatcaggtgatgaggaacctgcaacccttcccaaatttataaagaaaacagaggaattcagtaaattctctttctgctcttggagtaggacagaccagtggtcagttctggggacagtgctcctggtgtggagacagtgttggctggacacacccagcttgggtgcactggggtcaggtggtcaggtctaactgcatccccctcctgtcactccatctcaacaattccccaacccagtcctaccccatctcaacccttcctcaacccaacctctctccatctcaagtcctccccatttcagccactatccgtctcaagcccttcctatgtcaacccttatcaattaaactcctcctcatctgaacccttccctaactcaacccagctcatctcaaccccttcccatctcaaccgcttcccatctcagccacttcacaactcaaccccttcacaactcaaccccattcccatcatggccccatcacaactcaaccccttcccatctcattcccttcaaaactcaaccccttcctgtctcaaccccttcacaactcaaccccttaacaacagaaccccttcccatctcaaccacttcacaacttaaccccttcacaactcaatcccttcccatctcaaccccttcccaactcaaccccttcccatctcaaccccttcccatctctacccctttacaattcaaccccttcacaactcaaccccttcccatctcaaccccttcccatctcaaccccttcacaactcagccccttcccgtctcaacccctgtcaatctcaaccccttcacaactcaaccccttcctatttcaaccccttcccatctcaactccttcccatctaaaccccttcacatgtcaaccccttcacaactcaaccccttcacatctcaaccccttcacaactcaaccccttcccatctcaacccttcacagctcaaccgctgcccatctcaaccccttcacaactcaaccccttcccatctcaaccctttcccatctcagccccttcccacctcagcttcttcacatctctaccccttcccatctcaaccccttcacaactcaaccccttccttactcaatcccttcctatctcaaccccttcacaactcaacccctctccatctcagtgtctccccaacttgacccttcaacatctcaaccacactcatctcaacgcctccctatttcaccctctccccatctcaagcctacctcatctgaactctacccatctcaccacacccatctcaaccctcacccatctcaacctctgccccatctcaacctcactcatctcaactccttccctatctctacccctgcccgtcccaacccctcccatctcaattccaccgccatctcaactcctcccccatcttaacccctcctcacctcattccttctccatctcaaccccctccacctcaacttctccctcatctcagcctcttcctcatcctaacccctcccacctcaacccttccccatctcaagacttccccatctcaactgctctctacctcaactcctcctccatctcaacccctccccaacttcaacccctcccccacctcaactcctctccaacttcaacccttcccccacctcaactcctctaccattgcaactcctcccccatctcaactcctcctccatctcaacccctcccccacctcaacctctccccatctcaactcctctctcatctcagcccctcccccagctgccatctgttatggttgcttctttcccctgtgtttatacttaagctgggaaaaattccccctccctccctccctcctccccttccctctttctgtgatgaacatgaaattatattacacatataggtctttgttttgctcttattcttttagtttttaaaaattacaggatatggtgtgcatctttctttggccatttctggaaagatgtccataacatctctttcacgctgcagagtattcctcagcatgactgaaccacagtttattccagcaaccctatcaatggatgttcccagttgctttgcagttaccagctgtgctgtagtaagcctcccctacatgcctttaggatgtgcactttcatttctgtagggtcaagtcctagaagtgggactgtggacaagtctttcccacgctatgccctcactctccggaggactggcacttctctcaacacccctcctcagcatctcagcctcaaattgaaatgtgaactttcacagtctgtgttatctctctggccccactggagaggcccgatgaattaataatatgccagcaggaaacagagagatggagttattaattgtcagtccatgagcccaccctctcaaggtcctaattagcatgctgacagcttcggttttatccagagctagggcaaggctctggggacactgtggctcagctaggggcatccggcacagagtggagagccctggtgcctttctgggtggggtggaggggcgcttgcaagaggcttgtgaattcagaagttccttcagggatccctttgtgcctgctgtggggtaggggagagaaacaggctgggagtgggggcaggaatgggagttttagtgtccaggtggtggtgatggttggtgtgtgctgctcttgggccccagtggtgggtttgtgattctggttctgctgcaggacagtgacactcaccaagctgtgttgggtgtagttgtctcagggaggtgcctgctttcaaaccaaagttcctttgatggggaggactgaccccaggaagactgattgcgtatcaatattactctaacccatggccctctttcataacatgcacactcctggaaaggatatcattaaatctggcattggtgcatggccaggctcacatagggttgctcaagaaatgttgctgtaaaggaggccgggtgcggtggctcatgcctgtaatcccagcactttgggaggttgaagtgggtggatcatttgaggtcaggagttcaagaccagcctggccaatatggtgaaaccccatctctactaaaaatataaaaattagctgggcatggtggcacacgcctgtaatcccagctatttgggaggctgaggcaagagaatcgcttgaacctgggaagcagaggttacagtcaaccgagatcacaacactgcactccaacctgggcaacagagtgagattccatcttaaaaaaaacaaaaaagaattgtttctgtaaaggaaactacctataggaagctgcgtgaccttggccaggcctcttcacctctctgggccctttttaatgtggattagaggtggtccttattttggtttgctccatactgggcagccagaaccatctagaacaccagccaggacttgctccccaagggtgctcctctgttgcggtgcctgcctctctgcccaatctctctccacacagtggaggctctgagtctttcctactttgagccctcatctccaccagcatctatgcgtagctctgctgtctcaggcgcctctcaagaagtttcaggcagcagagttggtggaagctgaaaagtcatttgaattagtttgcctgggtctattgctcaggagcctgggcacatctcttaacctttctggggctgaggacaccagcattcagggttgtgtgtgaggtgcttagtatgattattactcatgtttgttattaggctctgtcctgcttcccccaggctgtggccgggaagacagaacagccatttacacagtaagctgcccaatgaccctgcctttcccattcccagtctgcttttaaaaaatatgggtgtctagaccccaaccctcaaagattcagatcagttcatcttaggtgaagttttaacaggaagatgtatatagatgtatatattttacaagctcttcaggtgattgattagtttaagaaccattgattgagacccatggcaactgggcgggcaggtaccttgtgctcatggggcctgcccagccagacacagcctttttcaggagcaaatccccctatctcccttttgggacacagcagactgtctgagatcatctgatgacctctacatactcttttctgggactaagctgcctttctggatcagttagaaggcaactggaacatctctgaaaggttctggatctctgtgcacatacagtaaggggacagagctcattctgtgacagtcttaccaatgcaccacaatgtagcagtctctcgttgtaaggcatcacccggagttcttcgtttcatgaccaaaaaaattaaggagtgtggacaaagggtgaggttagaacgaaagtttaataagcaaaagaagaaagtcctctgccacagaggggacccgaaagagggttgcctttttacagttgaattcaaaagcttttataagaaactcccctcatctctgtagctgtttgtgtaattccccttatctgtgcagctgcgggcatgtccttaggcaagcacaaagcacagcttctcttgttcgggttactgtggttatgttttgggtaggtcccccacctccctgtgcaagttcccatggagcccactgtgtacatgcccgaaaagaggaggaaacctttctgtgggagcccactgattacaccaagaacaaaggctgctatgttgggccttacttgcttgtctgtgcagctgcagcctgagttttccccaggctgctctatttgtgcctgtagcttgatttttcaggctgtctttcattttgaaagaattttaccaaagacaagctttagctgtctgcccaactagtttttccttttctcctccctcaactggatcataacttatgactctgaggctgagtcctgggatagttggatgtagagggggcattatctggatttgaacccagtaattcttagctgtctgatattacataagttacttagccttcctgaacctcactttcaccatctataggacaatatgtgctttgcaataataacattagatttctagaaacacacacacatgcataacaccaggaacaaattttcctataacttattttattgatttcttttacatatatgaaatagaaaaatgatattccaaagaattatacctctcaattttttttaggaaaaatgtttaaaaaataaaaaaaaaagaattcaaattgtgcaagtaaaacaaaaggtaaattggagctctgctttaaagtaaatttcaatagaagattgttgttgttttctttaagtaagaagctgaaattgcggagtgagttttgatgtggcagtgtgtatgctgtcttggttatccagctgttttgactcggttttgatggcaacatatactgaccatgaaactcagaggtaagtaatttcaccattttgaagacacccacagctcttgacattttcaaagggtggttcccaaaataggagttcttttgagatggcattggtatattccagggtgatggatgccagagattggctgggtggcttgatctgggttgcagacagttaaaagttaaagaaaagtagggtagcttctacttccttcatgacctggtccaggatattaacagacatgccagtggacctgggtgcttgatgttacttaacacaggtatcatttccactttttccctctgctccaagccacagggaaactcagccatttccagggcccttggtttcaggaaggtctctgcagttgcatggagcctgctttgcctggcattctgcaggattctttagtacaaggattttgactgggtcaaatcagagatttgggcaaattcctgcattttaaaatagtcttctcctaaaaccctttcattctatgtgatggacagataagagatacagggctcctgtatcagaaattttatttgacttttggagtagagtgacctgaagaacaaattgcagttttatttttctcattacagcaagtcaggaggaggcagcctgggcctggtggggcacttctctgatgtcaacagggtctgcccaccctgccatctttagtgtggcttcctgcatcgccgatygaccaagtggcagacctgagggcaaaaggaagcctgatattggagtcagccccctttggaagaactttccctacagcccacctagtaacttctgatgatacctccttggcctgatttaattcagtgcaccaaaaatattatcatttcaacacaaaaccaatgcaaacaaagaatatgcccctaaatgaaatggtgggatctagtttaatttttatcaagagaccttcctgaagccaagggccctggaaatggctgagtttccctgtggcttggagcagagggaraaagtggaaatgatacctgtgttaagtaacatcaagcacccaggtccactggcatgyctgttaataaaaaaattttttaatgttttcattcatgtatcgtttcaactgaatcacatgtaccctaaaacttaaagtataataaaaataaataaataaaataaaataacaaaaaaatgttttcacaaagacagttttcaaagtaacaaaggacattgagaaaaaaaatcctttggttgttccaagtgtacagaacatcagataaaaataacatcaattttccacagagaaaccaaatatgtcatttaaatgcttccagaattaaacatttgatgtgtatgttgggtgaggaggcaacaggattggatagggtggtgggaagtctgagttttggtctcccctctctcactaactagctgtgtggctttcactaaacaactccagccccttaacctcactagctcagttttatcatctgtaaaatgaaaggattggtctcgatcagtgctgtccaataaaaataatatttgagccacctgtataattttaagatttttagtagccatgttaaaaaagcaaaaggaaacaagtaaaatcaatatattttatttaatccaatgcaccaaaaatattatcatttcaacacaaaacaaaattattgagaaagtattttacatttttttgcactaagtctttgaatgctgtgtataatttacccttccagcacatctcagtttggactggcacagtgtcaggcgctcagcagctgcacacctctcctggctactgttttgaatggtgctgccctccagagctccaaggtttctttcagtcctgacccttgaggattgtcacctttttttcttgactcagctttgagtgtcttggcctctctttccatcccccaacctggggcttctcttcaggcatggggtgaagggatcaaaaccctgagggccacccccactccatgatttctttctgcactgtctgctctctgtcctgtgctttcctgatttggaatcacttccctcgctttttctcaggctgagatccctcccagcttgccttatctctgcctggtccctgaggtaacccatttgcagcctcccattcctgctctgtctaggccatttcatgttctcttaattttgcattccattgcctttaaaatcttcaaccacttaaaaatgtaacaatatacatttttttctttcattacaaaagacgtgctcattgtgaaacaattgggaaatataggagcttataaagaataatataaaaatcactcataatccactcactccaacccaaccactgctaatgttttgatgtgcttatctttggtctttttctaagcattacgtatacatgtaaatgtgttttaaatttctttttctggagattttacagaatatatagttttctattctatttctttcacttttcattatactgtgagcgttataacaatatcattaagtatcgtttgaaaacatcatttgtaattgctaatggctgaggttcagggagagattttgataatattatgtcaccattaagctagggacttagataaacttagtatctgccctgcttctcattcctccttgttgaagagctcttgaccaatgtaaaaagcaatagccaaatgtgaaataaagaactaccttattaacagctcagcaagcactggagaccggcatgtttgcatttccacgctcattggtctaggtgaggcttcctggtccccatccctggaatctaagatgagctgggcttgtggagcaaccttgggcttgactttcctacttggctcagactggctttggcaaattgcttaaccgctctgggtatgtccttatctgtaaagtggtgattataatagtgctcacctcataggtctgttgtgcaaattaaatgagagagacatataaagtgcttatcatagttcctggcagatagtaaatgatccataaatgttagttttaccatttccctatttttggacacttaagtggcttaattttttttactattataaattaatcagtttatcagtaacaaatatttattgagtacttactactggccaattttttttttttttaaatactagaaattacaggggtaaccaagaccagacaagtgtctgatctcatggaatttaaattttaatgggagacatgatcaataagcagggtaagtttggatatggaaaaggctatcaatcacatacaacaagatgatgccctgagcttcaggtagggtgggcagcgaggagctttctgagttaggtgatgtgtgagcagacatctgaatgacaagggggagatctggggaagagcaagttaaagaccttgaagtggaagtgaacttgaggagttcaatcaaaattcagaagcagggagcgcagggggtttggtgtggtgggaggagctacgggaggtgggcaggagccacctggtcagggaacacttcggagctcagggtgaggactgtggacttcattgcaaggtgtgagacatgcactggaggcttccgtgcagcggagggatgcctactcagtggtgtgctggagcgggctcatgggagcttctgagagcctcttggcacgtctcttcccagctccttattcagtgaaatcatgttgataagtggcttgatctgggttgcagacagttacagattctcctcgatttatcaggacacaatctgatcaacccattgtaagtgaaaaatatcatcagtcaaaactgcatttaacaccatctaaacccttcctaaagtcaaaagatcataagtcaaaccatcataagcccaggactgtctatatttataacacaggagtttatagcagatgctactcttcccctagagagctagttgttaaatgtttaccagcacaccactggaacaaactaatctaggttttaaaaaattctctttgcctatgctctgtgaagaatgaattacagggaggcaatatgcagttttgactgtagttttgagaatttccttaggataaattactggaagtgaaattactacagaaaattatctaattgctccccctactgaaaatgttcatcatttatacctccactagcagcaaggtaccatttccttgtactcttactcacacttagctttagccacccccatagaatgttccttctatctagaactttgcattctgttctctatgtgtagctgattatttatttatttatttattaatccttcaggtctggtctcacatctctcttctcagaggactttcctgaccactctatttcattgtaattacttatttgccagaaccatggccatttatttatgtctaggacagggtctgccacatagtaggctcccaatatatattattgaatgaatgaatgcatccgcctacctttctgaattctcaaattgatactaatacagtcaaaggagttcctttccttggaatgtctaggattggcttttttcagcttaatgatatttctggagttgaggtatattaagtccaaagagttcaataattgataacaaaatactgtgcaataacctaacattataacaagatattttgcaataaaatgcagctttaaaacatctgttatccaagtgaagtgatgactcacagagaaaatatttccaaaccatacatctgataaggagttaatattaaaaagatatgaggaactcaaacgacttaagagcaagaaaacaaataaccctattaaaaaatgggcaggggacctgaacagacatttctcaaaagaagacacacagatggccagcagatccatgaaaagatgctcaacatcactaatcatcagggaaatgcaaatttaaccacagtgagatatcagttcacacctgttagaatggctataataaaagagacaaacaatgaatgttggtgaaaatgtagagagaaggaaattcttatgtattgttggtagaatgtaaattgatacagccattatggaaaatagtatggcggttctttaaaagctaaaaacaggactaccatatgatccagtagtcccacttctgggtatatatccaaaggagatgaatcaatattttgaagagatatccacactcccatgttcattgtctcattattcacaatagctaagatatgcaagcaagctaagtgtctatcaatgggttaatggattaagaaaatatggtgtgtatacacaatgaaatactttcagccttagaaagaagaaaattgtcatttgtgacaacatgggtgaacctggagcatattatgctaagtgaaataaacaggcaccgaaatgccaatatcatatgagctcacttatatgtggaacccaagaaagttgaactcagacatacagagtacaatggtggttacagaggctggggacgaggggggtggatgagaaaggggtgaggttgttcaaagggtacaacattttagttagacaggaggaatgtgttttagagatctgttgcacagcatgttactatagttaataatagcagattgcgtatttcaaaattgcgaaaacagtagattttaaatgttctcaccacaaataggtatatgaggtgatggatatgttaattagcttgattttatcatgtaaaatctacaatttaaatatatatgaaaacatcacattaaaccccataaatatatacaattattatgtcaattaaaatgaattaaaataatagaaaacccccaaaaaagcatgttatccattaaaacacgaaaaaccaagagccgtcaataactgcatgtttctagtgagactacagcaatttctctgtgcacttgccagaggcttctctgacatgtggtcaccctggagcccatgcaacaccctcttattgccacagacttctgtgctcactgcatggccaatatgtgtagactaacttctgacagttttatattctcttttaaaattttccacatttgctcttgatctcattctttcttttttctgtgctataaatttctccagctctactagatcatcccaccagtgtaaaaacatgcaatagaatgtcacatataagaacaaaacacaagaatccttgctacctcatacgcctctttatcctcggtcccatttctctgctctcctgtatagcaaaacttctcagaaaagtggcgaatgttgtccccactttctcatctcctgcccctcctaaccactctaacaggtggtctgctcacaaaaactgctcttgttcaggtcattagtgatgcccacattcctgagtcccatggttctttctctgtctttatttgatttgacttctcagagtacttagactctcattcttgaagcatttgcttctctggcttttgtggtagcatgctgttctagttttcctatttcactggctgtcccattccagtctctgttgctggttcttgctcctctgctatacccctgatgtaggtgtgccccagggctggcttctgggccctcttctcttctctgtctatgctcactcccaggatctcacccatttttgtaggtttacataaatccacatgtaaatgactcccacatttatagattcagccttcatctctcctctgagctcctgaggctgaaatccagctgttcccttgacatcttaactcaggtgtctaatgagagtcttcaactgaacaggtccaaggaacttttgacttatgccatcctccagtctattcctcctcatgtcttcctttccccacaaatgacactaccatctatggtgtggctccaattccagattatactaaacagttaagggaggtgtgtggtgagaatggtggccatactcccttggggtgctgtcaccaggaccagtcttgagcccagttcagccctccttgtttagtagcatatgtctcagaacatgatatgcacggccacttccacccactgctttcacttccggccccttttcttaggagttttggtctcataatggctctagaagcagaggaactgaaggctagagtgggcaaaagtattctctctacttccaaaattatattcatgcaagagaagttgacttcctggttttctgggtagta

SEQ ID NO: 12530 - DNA, 12917 bp, Homo sapiens
atacaaaaattagccaggcatggtgggacgtgcacctgtagtcccagctactcgggaggctgaggcacgagaatggcttgaagccaggagacagagcttgcagtgagccaagatcgcgccactgcactccagcatgggcaagagagtaagactccatctcaaaaaaaaaaaaaaaaaaagaaaaaagaaaagaaaagaaaagaaaagaaagaagaaaggaaaagaaaaatccggctggaattggttggaaccaagatggccaaccagaatctgtgcagaatgaacttggtgacgttgtagcctgaatttccaccgcgtgtttcatactaatgccccttaaattttgcacatgcgatccatgaggaggcatgaagagataactgcacgtgctcaaggaattttcttttctttctttctttttttttttttttttttgagatggactcttgctctgtcacccaggctggagtgcagtggtgcaaactcggctcactgcaacctccgcctcccgggttcgattctcctgcctcagcctcctgagtagctgggattacaggctccggccaccacgactggctaattttttgtatttttagtagagacagggtattgccatgttggccaggctggtctcaaactcctgacctcgtgatccacccgcctcagcctcccaaagtgctgggattacaggtcaaggacttttccagacctccccttcccttcttcctgtcacctactaatctcagaatctaccacccgcacattttctaataaaaatactgccttgaagccagcacggggagacagatttgagctggactcctgtctccttggagttgacgagttgacttgcaataaaagctcttcctctttctttctttctttcttttttttttttttttgacaggttctcactctgtcacccaggctaaagtgcagtggtgtgatcttggctcactgcagcctcaaccttctgtgctcaagtgattctcccacttcagcctcctgagtagctgggacaacaggtacatgccaccatggcttgctaatttttttgttgttttttgtagagatggggttttcaccacgttgctcaggttggtctcgaactcctatactcaagcaatcagcccacctcggcctcccaaaatgttgggattacaagtgtgagccactgtgcccagctgcaatgaaagtttttctattctcaagagcccaattagtattggcttctagcacactgggcagtgagcccgttttgcttggtaacactagaaaattcaggtacctcaacaggatacaatcctaccacctagatcatcgttaactaacatcttagtattgtcatatccaggtggcttttgctagacatacacattaatataatgtagttttgtaacattctataacgtgcttctacagtactctctaggcagctctgtaggttgatacctcttttgcatttgtgatggcacagtagtctaggaatggaagtaggagaatttaaccagtcccacattgatagacatttgtgttcttcagtttctctgctaggtgacacctcattgccacagcctcctttcatttatttatttttttgaaatggagtctcgctccgttgcccaggctggggtgcaatggcgcaatctcagctcactgcaacctccacctcccgagtccaagtgattgtcctgccttagcctcccgagtaggtaggattacaggcatgcaccaccacgcccagctaattcttgtatttttagtagaggcagggtttcatcatgttggccaggctggtctcaaactcccgacctcaaatgatccacccacctcggcctcccgaagtgctgggattacaggcgtgagccgccgtgcccagcccagcctgcttttagcagctgaacacaggcctgccttgggaagttaatggccgtggaagaattttcctccttccaagcaggaaagggaggagagatagggctgacagcttactctcttcagagtttcctggggaaggggacacctatatggtggcccggccctgctgaaggtcaagatgctatagtgttatggtttaaaggtaggtgcagggtctagggggcctaggcactaacagaactaatctctcctccccccaactgctgtccaggttcatggatagtcatgcttggtcttgtcttactgttctttctggtctcagccatacccttgcttccccaggcactcctggcctttgttttcctacctctggactcaccctagctgtcctgtacaacctgccccgcacctctgggcagtcctggggtgctcttggacctctccttcccagcctcctgcaagatgctgaaggactttttgctggttgcactggccttcactggtgtcactctgttgctgctcctgtgaccctgaggaaggcactcgaggtcttccagccatcctgccctctctgcagcttaagaggctctgttttggtgccctgccagctgggaggcccacaagatggggctggtgacttgcgcaacagagagactctcttctgaggaggaaattgatatggaatctcagtctattttggaggaagacctggaggcagtggccccttcagaagacaacgaaaaaataacccttgtttctctctctatataatctataataatattattatatataatctataataatattattatatataatctataataatattatatataatctataataatattatatataatctataataatattattatatataatctataatattattagatataatctataatattattagatataatctataatattactatatataatctataatattattatataatctataatccataatatatattattatatataatctataatatataatatataataatattattatatataatatataatatataatatattattatatattatatattattgtatattatatattttatatattataatataatatataataatatataatatattatattattatataatacataatatattattatatattatataatagatatataatatattattatatattatataatagatatataatatattattatatatcatataatagatatataatatattattatatattatatattatataatagatgtataatatattatatataatatattatattatataatagatatacaatatattatatataatatataatatattaaatatttaatatataatatatttaatatttaatatttaatatatattatatttaatatttaatatatattatatttaatatttaatatattatatttaatatttaatatattatatttaatatttaatatataatataaattaatataaatattaaataatataatatataatatttaatatattatatataatatattatatatatttgagacggagtctctgtcgcccaggctggagtgcagtgatgtgacctcggctcactgcaacctccacttcccaggttcaagtgattgtcctgcctcagtctcctaggtagctgggattacaggcatgcaccaccacgcccagctaatttttatatttttgtagagatagggtttcaccatgttgccaggctggtcttgaactgacctcaagtggtccagctgcctcagcctcccaaagtgctggaattacaggcacgagccactgcacctggcctgtgttgccttaaccttgtgctttttggtactagttgttaggggaaaaacctgatgtcttaactttgtgacatgcatttgtggtctctgaaggggccagtgtggtggtgggttcttggggaaggagtaagaggcagggctggggcctcattagcaccagcatagtgttgcccaccggtgtccctggcctgaggtctacacggttgggagcctcgccttttggcctcagcagaaatttgactcctctatgggaaatggcctgtggccaccaactctagcttcccaagaacagtgagacttttccttccctggctctgccttggcatttctgggctgttggaacaggaacttctaagttaactttccttctcacacaatggggggcctgcaggccttggttttcctgccctatgctgctagcttatcacttctggaatgagggggctgtgttagtccattttgtgttactataaaggaatattgggccaggtaaggtggctcacgcttgtaatcccagcacttcgggaggccaaggtgtgtggatcacctgaagccacgagttcaagaccaacatggtgaaactccatctctactaaaaatacaaaaattagccaggcatggtggcaggcacatgtgttccctgctacttgggaggttgaggtgggagaattgctttaacccaggaggtggaggttgcagtgagcctagattgcaccactgcattcctgcctgggcgacagagtgagaccctgtctccaaaaaaaaaaaaaaaaaaacaaacaccaaacacgaaaaaaggaatattggaagctgggtaatttacaaagaaaagaggtttacttggctcattgttctgcaggatgtacagaaagcatggtgccggcatctgctcagcttctggtgagggcttcaggaagcgtttactcatagcagaagaggaaggggagccagcgtgtcacatggtgagaggaagggagcaagaagaggggaggggtgccagcctcttttaagcaattgtagaataagaactcactcattatggcgggcaggcaccaagccattcatgaaggatctaccgccatgacccaaacacctcccactaggccccacctccaacatcgggggccacatttcctcctgagatttggaggggacaaatatccaaactctattagtgaccattggccaaagctacaaagtgggtctctttccttccccaatgctgcctcctggagattcaggactggagctgagcatctagaccctgagtaagactggaggctagaagctggagcttgggaagcctgcctcttactggctgtgtgcacacagtgggagctggcttgccaggggtgggcatcagcggatgctgatgggcactttgcagatctcagctctggccctggccttaggttctttgcactgctccacctcctggtgcaagtcccctccactcagctgccacagaggagctctggcaacagcactgctcatcttagtcccaaaggcacaaagggtccacactctctacctcagaccctgcttcaacatcgaggcctttcctttggtggtcaagggtgagaccaccctgtcccccgaccctgcatcacccacactaagccatcctctcccaaggattccatgacatcattggcccaaattgtgggtgctgccaccgtcttccaagaaggtgaacccatccccctctttccatcctcctccctttcctctctcttccctccatcttccctcattggtaggattgtcagataaaatataagatgcataggtcaattttaattttagataaacaatggatacattttaagtatgtcttttttttttttttttttttttttagatggagtcttgctctgttgctcaggctggagtgcagtggtgtgatctcagcccactgcaatctccacctcctggattcaagagattctcatgcctcagccttctgaggagctgagattacaggtatgtgctacctccccaggctaaattttgtatttttagtagagacggggtttcaccacattggccaagctggtctcgaactcctgacgtcaagtgatccgcctgccttggcctcctaaagtgttgggattataggcatgagccactgcacctggccatgcttttttttttttttcctttctaaatctgacaaccctcattttctcttctcttccttcctttttcctttctccttcctcctccctcctccttccctgccagctcaggaagaaggcagtcttgtcccattctgacaaattgttatagaagagtggtgggggtgaagaggtgacggggtaaggggcagccttagctccaggactatttctgycacctgtaggctgaagatacaaggccagtgcctttgggagctcagtttcccatctataaagcagatatcagattttgcacccataagtgcatgtgggaaagtgcttgctgctgctgaatatttgcttgactagcctgagtcagacctcatagcctgcccacggatgagctcagccctccgtttgtttgtttccaaggagcctctcatggcaccagcctttggttcccattcatccccattcccgggtgtgatccggctcccctggcaagagttgtgtcagggactggggctcaagccagcctcttcacgtccccgaatcacagcagaaagttggraaggaaactctggagtcctggcctttgccctagtcacccagggtcatggtgagcgtcagggggttgtgcttcacagatgccatgtgagcagcggacaggatgctgagctgaggaacacaagccctgccccactctgctgtgartttccttggacaagctgcttcagtattgtgggtctctatggcctatcacctcctctacccacaaacagggactggagagggtgacatgcaggacacttctactggaaggtctagaacaaataaatcatgccttctcactgcctttgtaaaagtggaatcttaggaggtcatattcttactatattamatttttttgatagagatgtggtcttactatgttgcccaggctggtctaaaactcctgggctcaagcgatccgcccatctcagcctcsccaagggctgggattataggcaggaggcrgtattacaaggcaactgagagcaatgtcattggagtaaacaaagcaaaaacaggccaggcatggtggctgaggcctgttatcccagcactttgggaggctgatggggggtaaatcacttgaggccaggagcttgagacaacatggggaaaccccatctctacaaaaaaatacaaaaaaattagccaagtgtggtgatgcccacctgtagtcccagctactcaggaggctgaggtgggagaatggcttgagcccaagaggtcaagactgcagtgagccatgattgtaccactgcactccagcctgggtgggcgacagagcgagaccctgtctcaaaaaacaaacaaacaaacaaataaacaaacaaacgaacaccccctgccccaggtcctggatctgccacccaagctgtaagatgttgagtgagtagcttcacccctctgagcctccatttccttatccataaagggccttggggatggcatgagaataaaacatgctaaactcacaaagctcttggcacagtttctggtacacagagagcactcgccaaatgatagttgttttctttattatgattatgccagatgtgactgcctttgcttccaggaaagtccctaaaacataagctatgtgcaacaagggaagtgggttagggtgggaagctgagcgtgcaagtcagacaaagcctgatgtaggcagctcctatcagaggcatgtggcctttgtggctggggccctcaaaagacagccactgccagaaatctggagactgaattgtctgggtctccagaagagagtccaaccccaccacacatctgctcctgtccaaggtgctgaaatccaccccacataggctcctcctaatcatgtacagctgttgagtcacctgcaccctaccttctggtcctccattcaatgccacaaatatacactgagcatctactatatatagggagtggaagtaaaaaggatttagatatgtctccaacccaagttgctcacagccatacggaaggaattcaagcatacacacctgccttagggtaggtgaggacaaaggctaggggattcattttgctatttattgagtttcatgacacccacttcttgcctttacccttgctttttcctcttctgcaaccttggtaccctccaaggttgtgcctctcatacctttcttgatctgaccacagtagatgagttttccccagggcatctctttctgtactcactaacgtcacagagtcaggaggactaacaatcaatttcagggagggagggagtgtaggatataaacagagaaatcaaagggttaggaggtctctgagaaatgagggagccacctagacaggggtgagctccttatcatatttctgcatgccctcgtcagggagcaggacctccactgtgaagctgaccttcttggcgtggacaaagctataggtgttgtcgaagcgtaggacatctgggggacagatggaaagaggggcattgggcttggctttacacactcttttttccacccctggccatggaggaggacaggcttgtgttcccactggctttgtttgccaagctgggccaagctcccaccacgcctcttcccttccccatgggaactgccaacccaagcaggtcctgtaaacagacaccaacctcctcttggcatgtgcccaggcatggctttactggcatcgagaacaatggtcattacatcccattgtctcacacctggagacgcacatgacggggctgtgaaggcacatggttgggttcatcagagacctcccagcccccttggatgaagtggggttctggggcaggcctgctggacactgtttgcctcctcacaaccaccccaaaaagcaggtgttggccgggcacagtggctcacacctataatcccagcattttgggaggccaaggtgggtggatcacttgaggtcaggagttcgagagcagcctgaccaacatggagaaaccccatctctactaaaattacaaaattaagtgtggtggcacatgcctgtaatccaagcgactcagaaggctgaggcagcagaatcgcttgaacccgggagggggaggttgcggtgagcagagattgcaccattgcactccagcctggacaacaagagtgaaactctgtctcaaaaaaaaaaaaaaaaaaaaaaagagaaaaaacaggcattgtaactcctggctcacaggtgagcaaaccaagggtccttcccagattggtcagacttttgcccaggactatgtagctaccctgaggctcgggtgggaccctggaaccacactcagctttgtggctctgcacaagttgatttatttttcagagcctcggtttcctcatgtggaaaactacacctgccctatcacttgttgtctgtgttctgtggtccaggtgtccccaattccttcagggcctgtatgtctctggctcctggtgcacagtaggtgctcatgaatatggactgagtgagtgactgtatgaatgaatggtgctaacctaggctgtgtgtccctgaatgggggaggtgtgtcactgcccctctgtttccttctctaaagcatgggacaggtggctctagcctttcagagccaggtcccagctggggcagacttacagacgccggcctctgagcaggtgaggttcccatcctcgggcaccatgtgggcgttatagcgctggctgggtagaacatctgtcatctcccctgcccgctgtcgctcccccatcttggtcttcaggaaaactccgaagccgatgtccgcaccatcagatgagaactgccacctgtcagggggagggggaggagacaggttgctgctcagcctgatgggtctctgaggggttagggcctgcccctacctgagaacgcagcctggaaataggatctcgtattccacttggtgtgatgagccgcggttgatctgcaccgagtgctcgtactgagtcttcacctggtcccgcacgtacatggacttggggatctccccgccatagttaatctgcggacatgggatgagatgggcttgcttccgtctcctggccattgttcatgtttcttctgcctgagacactttcaccacctcctggaagtatcctcttcatcctagccccactctcccacctcctcaagccttctatgaccctccaaactgggccagtgcgtctgctgggagcttcccctcccagctcatccctctgggttaaaattcgcctatttcttgtttgcctttacagctgctgagagctctgtaagggcgagggttgtattgactagcttaacacccagttcttggcatctctctataggtaattgtggatgaatgactgagtggaaagggaatccagcttaattcttgaacctctcttgtcccagggaagggctctttgtaccttggttaaacatttggggttcccatctgggtcagtcagggtgcccccaaactgggcaggcagttcctcaggactgatgagtttcagcaaaccttccttccagttatctgggagcagtgggattcaagggtggttagcaagcatggggggcaccaattagcctcccacacccaccaggatgacctgaactgggggagaagccctataggaggtaggctgccaggaccaattccccagtgtcctaggcctggggctacagtaagtgtctttctcagcattgtgttgctgtggaaatgtgtttcccgccttgatagatgaatcagcactttttttttctttgagacagtgtctcactctgttgtccagtctggagtgcagtggaatgatcatggctcactgcagcctcgacttcctgggctcaagtgatcctcccacctcagcctcctgcgtagctgggactacaagcatgtaccaccatgcctggctaatttttatttggttttgtttggtttttttttgtagagatagggtttcactatgttgcccaggctagtctcaaactcctgggctcaaatgattgtcttacctgggcctcccaaagtgttgggattacaggtgtaagccaccatcaccatgcccagcctatggcacattctttttttttttttttgagacggagtcttgctctgtcacccaggctggagtgcagtggtgtggtctcagctcactgcaacttccacctcatggtttcaagcagttctctacctcagcttcttgagtatctgggattacaggtgcccaccaccatgactggctaatttttatatttttagtagagacggggtttcaccaccttggccaggatggtcttgaactcctgaccttgtgatccacccgcctcggcctcccaaagtgctgggattacaggcatgagccaccacgcccagccaacagcacattcttgaagatcttccagtcatgagcagtgaaactaagagttatctaattgcctcaaggagagtttagagctcaatgacgtcaacggccttgttgggatcactctgtaagtaagtggcatgcccaagtcagacctcctagtgggggatggacagccctgggcttttggagggaccctccccacttccctctgcctaatcaccatgaccataatgttcttcatgccctatgtaaagctctaagagttctgggtcctggctgttaccatgccccagccttatggctaatccaggctacccggtcccccaaccccctcactttggccatgggaggttccttctctacagtggtattaaggggaagaccacaatgtgccacataccagagccaaatgagcagagtcacatggggcagaggctgtggacttaaggcctggactgtgctggtaacccacactgctctaggctttggaaggcgtagaaggcatgagcctggacccttcaaaccaggccctcataatctatcaagttccccatcccagtggaattgggtagaggcagaggctcaggtaccaggaagaaagagaaagtaaggatttataagctccccctcacccctggatcctcagttctcctaattctgtgatctgactatcctgcttgggagaagttttcctccaagccagggtcattggtttgggtttaagaactatttcccttctctctctttctctcagcctgtcacttgtaaacacaactattctcctatttgtaaaattaatacatattattatacagtttagaaatcatagacaatacaggtaataaaattaaaaaccacacgatctctcactatcaacaaaaaatattttgttgtttttccttgtagaaatatgtatttattgtacatatgttttcataaaataagattatacttttagtttaatcttattttagtttatgcttatgaagataagtttataatctacttttaaaaacttaaagacatttccatggcattaaatattcacatatagccttatttctcatggcggctccagaattcatcaaatgcatgcaccattatttatttatccagtcctttcttgttgggtctcctttctctgaattgtgactactctttctgctcgtctgcctcatcctcttctgccaaggttgcctttggaagcactaagcttatgagtgttgaaaagaaaccgaggcctatataccagaaattgactgcaaccaaactgaaaccagtgaggtggtaggtgtggaggccttgtccaccaaaggggtatggcagggaaaagagcaaaggtaacactctttagggtaaaacccacttcactgttgggaagaaggagcctctgactaggtgatgtgtagagttctgttgtttttgagataggttctcactctgttgcccaggctggagtgcagtggtgtgaacacgactcactgcagcttcatactcctgggctcaagtgatcctcccacctcagcctcctaagtatctggaattacaggtgtgcaccaccacaaccagctaatttttaaattttttgtagagatggggtcttgctatgttgctgtggctggtctcaacctcctgatatcaagcaatcctcctgcctcagcctcccaaagtgctgggattacattcgtgagccactgcaccc

SEQ ID NO: 12531 - DNA, 13649 bp, Homo sapiens
cttgcccttggcctggtgtggtggttcatggctgcaatcccagcacattgcggggcggaggcgggaggattgcttgagcccaggagttcaagaccagcctggacaacaaagtaagaatcagtctctaaattaaaaaataaaagtaatttttttttgtttttttgttttgagacagagtcttgcactatcacccaggctggagtgcagtggcaccgatctcggcttactgcaacgtccggctcccgggttcagacgattctcctgcctcagcttcccgagtagctgggattacgggtgcctgccaccatgcccagctaatttttgtatttttagtagagatagggtttcaccatgttggccaggctggtctcgaactcctgacctcatgatctgcccacctcagcctcccaaagtgccgggattacaggcatgagccactgtgcctggccataaaaataaatttttaaaaatagaagcaggtcttccctgactaccctgtctcacttttagtactgtcatttgacactattttaattctctccaattgcataagttttatttttgtctgttgattttctatttttctcatcagcgttattactggagaacagcagagtccacccatcttgtttactcttacatgctcagcagagaggcaatgccagaattactaacagtgctaaagttactaagataagtaaggtgctggatataagaggaatatatgaaaattatttttttctgcactaacaactactagttagatacagaaatgaaaaagtaggccaggtgcagtggctcatgcctgtaatctcagtactttgggaggccgaggcgggcagatcacgaggtcaggagatcaagaccatcctggctaacacggtgaaaccccatctctactaaaaatacaaaaaattagccgggcgtggtggcgagcgcctgtagtcccagctactcaggaggctgaggcaggagaatggcgggaatccggcaggcagagcttgcagtgagccgagattgcgccactgcactccagcctgggcaacagagcgagactctgtctcaaaaaaccaaaaaaaaaaagaaaagtaatccctaaaatgaaaagatacctaggtacaaaatttaaatggtaacataaaaataaaagataatttgaagtaaattaaatctgaataaatggtggataacctattttctggttggaagacttaatattataaaaacaatatcacaaaggagtatcgcaaatgagtttataaatgtcatgttattcccatcagaacctcagtgggtcattgtttttgttttttggaactggaaaataatgtggcaaaaatcttagaagttcaataacacattgtgttgatgagaccgaagaaaaatgaatcctacacatattgctggtaggactaaaaattgattgaacccctagggaagacaatttggcaatatctgtaaaaattaaggcatttactctttgactcagctatcataattctgggaatttatgttacagatacaattacacattgaaaggaaaataaatcttggggccccaaaatcactaagccaaagggaaaagtcaagctgggaactgcttagggcaaacctatctcccattctatacctgaaaaagccactaagataaaaaagctacctaccttcctcacagggaatgtccttgtggacaaaggacagagagaggcaggcggatcacctgaggtcaggaattcaagaccagcctggcctacacggtgaaaccccgtctctactaaaaatacaaaaattagccgggcatggtggtgcgcagctgtattcccagctactaaggaggctgaggtgggagaactgctagaacctgggaggcagaggttgcagtgagccaagatcgctccactgcactccagcctgggcaacaaagggagactccatctcaaaaaaaaaaagccatcatctgttttgggggtgtaataagatatatgtacttctgaaccatgtaagtatttcggccgggcgccttggctcacacatgtaatcccagcactttgtaaggccgaggcaggcagatcacctgaggtcaggagttcgaggccagcctggtcaacatggcaaaaccccgtctctacaaaaaataaaaaaataaaaaaatttagcctggcgtggtggcgggcacctgtaattccagctactctggaggctgaggcaggagaattgcttgaaccggggaggtggaggttgcagtaagccgagatcacgccattgcactccagcctgggcaacaagagtgaaactccgtctcaaaaaataaataaaaaataagtgtgtcaattctaaaattaaaaaaaatttaaaagtttgcatggaaaaactaagaatagtcaacagtatttctgaataaaaaatagaatcgcggctgggcgcggtggttcacacctgtaatcccagcactttgggaggccaaggcgggtggatcacgaggtcaggagatcaagactatcctggctaacatggtgaaacctcgtctctactaaaaaattagctgggcatggtggcgggcgcctgtagtcccagctactcaggaggctgaggcaggagaatggcgtgaacccgggaggcggagcttgcagtgagcccagattgtgccactgcactcctgggagacacagattccgtctcaaaaaaaaaaaaaaaaaaaccacacaattacatgtggttttgtgcctcttggatttcagttattggggaagagtagtgcttacatccttcttattttactgttattaagaatcctggctggcacggtggctcaagcctgtaatcccagcactttgggaggccaaggcaggagaatcctttgagcgcaggagtccaagaccagccctggcaacatagcgagacctcatctctacgcatggtagcctgcccccgtagtcccagctactcgagaggctgaggtgagaggattgcttgagcctgggaggtcaaggctgcagtgagccctgatcacaccactgcacttcagcctgggtgacagagcgagaccctgtcttgaaaaaaaaaaaaaaaaatcctattcctgccagtaaaattgggctctatattaccaatttgtttatattgcaaattaaaatctgcaagtctggacttaaaaaaatggaaatgtttgtaattaactaaagtttctggaagtgataagcagtatagaaaggaaagatgtgtggtaaaaattgctcaactgattttgtaaggatttattaagagtattcacaggattttcaacattgcttttctgtgcaatatgataatttgtgtgatttttaaaaactgggctggctacagtggctcacgcctgtaatcccagcactttgggaggccgaggtgggtgatttgcctgagctcaggagtttcacaccagcctggtcaacacagtgaaaccccgtctctactaaaaatacaaaaaattagccaggcgtgactgcgtgcgcctgtagtcccagctactcgggagggtgaggcaggagaatcacttgaatccagaaggcggaggttgcagtgagctcagatggcgccactgcactccagcctgggcgacacagcaagagtccggctcaaaataaaacaaacaaacaaaaaaaaaactgttatgaactgtatcatttctctattgtggcataacaaatcatcccaaaacttggtaccttagcacaaatattattttattattatctctcataggtctgagaattggtgtggttctcacacagggtctctcatgcagttgcagtcagattaggggctggggctggaatcattgtaaaggtttcctcactcagaagtcttgtggttgatgttggctgtaggcctgaacgcccacacctggcctctccattggcctggacttcctcaaagcatgggggctgggttttaagaacaagtatcccaagagaactaggtggaatctgtttcactttttatgacttagtctcagaattcacagtgtcactccctccatagtcacagattcaaggattagggatacagactctacttctagatagaaggagtgccaatgttacattgtaagactagcacatagaatggaagatcttccagcatctagaaaaattcaattagacacatcacttgttctgttctttgttaataaatatgtataaatataatttgaacagacttcttataagactccaattttttaaattgttgccatgtcctgttgaaaaagaatttgtgctacatattttctgtctgccctgttagaactactctccattggtctccatgttctgtgtccctgagtgctagcctgaatgaactgcatcagtaaactctcttgccctctaccttcttgggtcctgccaatgcacagtacctacataagatcagaggtttggaagaaatgaggtcaaggtatttattccctggctggattacggatttggtatatttccgtagtcaccgcttatgtctgaagactatcttctatccctcctgtctcagcctcccgagtagctgggactacaggcacctgccaacatgcccggctcatttttgtatttttagtagagacagtttcaccttgttgatcaggctggtctcaaacacctgacctcaggtgatccacccgcctcggtctcctaaagtgttgagattacaggcgtgagccaccgcgcccggcctaaccctatactttctggattcccattgctgctcccttcttttgcctcttttggggtagtagtagtgagggatccccctgttgatagcgctggtatgcttcactctggttggtttttcttacccagtctacaactttgtaaacagtccctttattaagctctccttaattacttagcatatgtaagcctagtaacataactttcaaaacctgtaattctgataagtgatcttactgaaaataattttataattgactttatttttaaaagacagggtctcattatgttatttaggctggttttgaaatcccagcctcaagtgatcctccatcctcagactcttcctctgagtagttgggattacaggcatgagccaccatgcctggtttataattgacatttttgtattcttaaagaatgtaaatacctgtaatattgctctatcaaatcatctataacatagagaaaattcctgttactctgctatatttgcttttttttttttttttttttttttttttgagacaaggtcttgctctgttggctaggctggagggcagtggcacaatcttggctcactgcaacctctgcctcctagaggatactcccatctcagcctcccgagtagctgcgactacaggcacctgcaactatgtccggctaatacttcaattttgaggggctggcagggtcagaggtaggggacggggtcttgctctgttgcccaggctggtcttgaactcctgggctcaggtaatcctcccacctcagcctcccaaagtgctgggattacaggagtaagccacagtgcctggccaaatatttgctattttaatagaggttaagaaatgtctcatttaaattaactacattaggccgggctcagtggcttatgcctgtaatcccagcactttgtaaggcctaggtgggcggatcacttgaggtcaggaattccaggccagcctgaccaacatggtgaaaccccgtctctactaaaaatacaaaatttagccgggcgtggtggcgggcgcctgtaattctagctgctcgggaggctgagacaggagaatcacttgaacccaagcggcagaggttgccgtgagctgagatcgcgccactgcactccaacctgggcgatagagcgagatccgttcaaaatttggggttcaaaaaaaccccaaattaactacattaaacaagcaactccacacttatgtaattacatgtatgtaagtgctgcaaagaagaaaatgtaaaaatgtatgaagagctgtaacagaggaaactgacttttaaagtggtgagctggcttccctaaagaaaggcatttaaggaaatctgaggaaggagagggatagtctgccttcagagttttgtttttgagataggtctcactgtcacccaggctgagaggctgagatcatagctcactkcgtcctcgcgtctccagcacaggtccgggtttctccacccaatgcgcctgcgcacaggcctagcccagtcggacgcagcccagsactgccaggggtggggattrcctgggtcccccaggaagggccgggttacgtccggaaaagtgaggcccggggttccagttaattgttaccggaagtggagggaagmgttgccaggggagggcggagactgtggctgacaagatgggtggcaggcccttccctgggggtatcgaggtagggacgtttgtggctacgtctgtcctagaggaggagacgatgccaggggagagggagacgcagacactgggactgggtcgccagcagagggcctcggaagccaagccaccccgtctgaagacgcttctccttacggagcccagaagcgcgaacggagactgcgcagatcccgtgcgctgcgccggaaacggatgcatagtctcggacaccagctcagacctgccgcctggccaggtccgtgcgcgtttgtagtttgtaaagaaatgttctaatgtgtatatttccacgtttatctgtatattattcacttgggttgtcttctgtttgtgtttaatgtgaagcctagagttgaccttgggagcttcagaggtagggtgctaatttttcttgcaagctatgtaggtagtgaaaggaaggtgacaatgactacaggaaattcaccctagtccctcttcttccccagaagtggtcacaattacaggtgctttcctgttccacgctctattgcatagcccaggtgcatttatgggaacaaaaccatggagatagacactgatctttaataacattctgtaaaatgccatccttcaaaaaccaaatatccttgtaagaaagttaaaacatttggtgaaactattattttaggccaggcacagtggctcacgcctgtaatgcctacactttgggggcgccgaagcaggaggactgcttgaagaccagcctagggtaacagaaatcccactcatctttacccccaaaaaattagccaggtgcgatggcataagcctgtatggtagaggctgtggcaggattccctgagccctggagttcaaggttgcagcaagctgtgactgtgcactacagcctgggtgatggagcaagaaaccccttctctaaaaaataaagtgtctataaaaatcagtcttacttagaccagctgtcaagattctccagttcataaagtgtaatacccacttaaaattttatgtgcytaacggtcaggcgcagtggctcacgcctgtaatcccagcactttcggaggccgaggctggtgaatcccctgaagtcaggagttccagaccagcctgaccaacatggacaaaccccatctctactaaaaatacaagcctgtaatcccagctacttgggaggctgaggcaggataatcgcttgaacccaggaggtggaggttgcgatgagccaggattgtgccattgcactgcagcctgggcaacaagagcaaaactccgtctcaaaaaaaaaaaaaaaaaaaaaaacgtgcttcatattcttcccagccgggtgcagtggctcacacctgtaatcccagcacttcgggaggctgagcagggtggatcacccgaggtcaggagttctagaccagccaggccaagatggcaaaaccccgtctctactaaaaatacaaaaactagctgggtatgggggcacatgcctgtagtcccagctactcaggaggctgaggcaggagaatcgcttgaacccgggaggtggaagttgcagtgagtggagactgtgccactgcactccagcctgggtgacagagagagactcggtctccaaaaaaaaatcattcccagttacagtagcaccaatacatttcaaattaagagtttatttagaatactttggccgggtgcagtggctcacacgtgtaatcccagctctttgggaggccaaggcgggtggatcacaaggtcaggagatcgagaccatcctaacacggtgaaaccccatctctactaaaaatacaaaaaaattagccaggcatggtggcaggcgcctgtagtcccagctactcgggaggctgaggcaggagaatggcgtgaacccaggaggtggagcttgcagtgagcccagatcgcaccactgcactccatctcaaaaaaaaagtttacttagaatgcttttttaaaagcataataattttaactatacctcagattttacagcttaatgaggcattctattcctcctctttctggcttagtttcttgccttgaagcccagtattccataaattttttagggcaatttttcaagttgaagtattgacctcagttgggaatattgttaaaattcagtttctaattcagcaggtctagggtagggacttgagattcagcatttctcaaaatctcaggtagggccagtcagccttggacttgggattaacagggctttaatcaacacacaccaccttatatctctacattaaataaagatccattaggttatatatatacaataaagactaagaatgaaaacaagaaatttattaaatatacaaaacaggaatacagttcaattactgtgtctaaaaaatttcatttttacataaccaagacaatatttacaactatatacaaaagactcccacctgtgcataacctttggtccatctgtgctatctctcatatctgcaagagaaacctaaaatgttaatatttgagtgttaagtatttacatctttttgtgttggtttttaaatgcacaagtacccctgaatggctcaaagggatgggataatgctagaaacactaacttgcaataaagtgcagttttcatgcaaacttagccatcagttttcttcttttagataggtatccacagtccatatggactttttttctgatctatttttggtgatcttgaagatgcctcttctgtggcagctttagctgatttttgtattggctttgctacagaattctgtaaaagaacaaattcagtcagcttcccaaacatacattgtacacttttttcacaaaaaaaagtacattaaataatcccatgtatgagccttagagatattatcaattgctgggcgcggtggctcacgcctgtaatcccagcactttggaaggctgacacgggcggatcacgaggtcagatgtagaccatcctggccaacatggtgaaaccctgtctcctaaaaatacaaaaattagccgggcgtggtggcatgcgccagtagtctcagctactcgggaggctgaggcaggagaatcgcttgaacccaggaggcaggcagaagctgcagtgagccaagattgcaccactacactccagcctgggcaacagagcaagactctgtctcaaaacaaaaaaaaaaggattatcaaccaaacacatagtgtgaaccttaattgtagcttgattcaaaaagtgaagtgaagatactggggcagcagggagacactggacatacacaagatacacaaggtataatgattttgaggcttcgtttttgaaactcttattttaaaacattgtgattaaggagtattctaaagatttccctttaaaatatttcaataaaaaaggggggacacttaaaagaatggcaaaatatcggaactaacgtgaatgttatatatattacaaacccattataatggccacttataaaagtggctcaaaaacaaatgattttaattctatttaaaaagtgtgtcagtaggcccccaactatcaccacaaagataaaaacacaaagatgcaaaaatacatcctaaatccaatttttgagtgttcaatgcctggatatacttacattagagctaaaagctatgcttctttgctgggtaggtttttcattgggatttcgagttccatcttctgttaccttttccgacagctagacaggttaagaaaaagtgtaattttaaaacacatacccttggtttctaaatcctatattaaaaaatagcctaattgtaaacaaaatttagctgtagacacaaaaatcaacttggatctaacagcctaagtaacagaactattgagttttccccttaacaaaactgatttaatattaggcttaagacactcttcccataattattttacttccctgctggcaaatttaaactaattttttaatcagttttctcaggttgaatcaagttcacttttgaaatgtaaagccacatcagaaaatacgttttaagaaactaaggcatttgccagttaggcacctaatcgtctgaacaaagaccttgtctactaatactgagcaaacccacatctgggcccaattacacagattcatttagatacagcatttttttttttttaagcccccgagacgggagtcttgctctgtcacccaggctggagtgaaaagtacagtgcaatttgctaatgcacatcctgcacatttctggagaattataataaacttatctgcaagtgaagcaggcctcctcttctgtaatctctcaaaacatctggaatatattgcatatattatgaaagggacatctttttcacagatgccccaccgttacaacgtgtacctttgcttagtttaaaaattgactttaatactttatgcaaatagtgcctgtcccaaattctagcatgcacatggatctaccaacaaaaaaactaagttttcagtgtgtgaacataaacttcaaattaaacctctgatgctttagcccatgtatcaattaccaacagattttcttcatcaatgtctgcagaccacattcatgatttctataagacagaaatagagcagataaactatactgtatatgctgagtacagaatttgtgggaacataatgctgcaaatgaaagctacaaacactctgtaaatagcttagaaaaactagtaatagaaatcaccaaagtaccagctaataacggtgttataagagtacactgttaactgaaaatgaaaaaaataaatgtattttttgagacagggtctcgctctgctgcccaggctagagtgcaatggtgccatcttggctcactgcaaccttagcatcctaggctcaaagatcctcctgcctcagcctcccaaacagctgggactacaggcatgcaccaccatgcctggctaatttttgtattttttgtaaacacgcggttttgccacattgcccaggctagtcttgaactcctggactcaagccatctgcctcattacaggcatgaggcaccatgcacggccaaataaagctcattaatctcccattttcatgggtttgacattgcctatcttcagatttgctactttgaatttagcacattatatacatctctagacttcccaaaaagtatagtctaagatataagtggctaatcagatttgacagttggctttctgaaagttttgttccgacaaacctagaatacttacttcaggctttgcaccattacttgatacacctattccacggcttgtttctttggctgaaggaacagttctgagactagctggcaagtcaatgttggttgttcctagagctttcgctgcattggtttttgctatttctaacagctccattcgatctaaaaaaaaaagagagagattttaaaatactcattaatctggtagttatttcccaagagaactcagaattacacaataaatatgttattttgtggtattaaatatattaagtcacttgttttataataggtaaactaaggttgcccttgaacactagtagctgcgctggtccactttatacttgttttttctcccccttactaaatgcagatagaaagtaccacagtgtttgagagactgtaaaccccaagtgtgcgcgagggttccatatgcatcctggcaccaatcccccgagtgaacagagggacaactgtgtaactttattcactgaaaattctattctccagctcatttcttgctgaaaagaataaaattcttaaattatctcaacaattagttttgttttcttgactaaaggcctgagcgtcctattattttgtctttttgttgtacttaattttctctagctaatagtgatattattttgctttctcttcaaagatgtatttctgaaaaccaggtttttctgctgtagattctttatataattatcacaaccactgaaccaatactgatacactactaaagtgtatttctaccaccacccccggctaatttttgtacttttactagatagtgagctatgttggccaggctggtatggaacgcctggcctcaagtgacccacccgcctccgcctccgcctccccaagtgctgggattacagaggtgagccgccgcgcccggcctcctaggtcacttaggatactcgacaatccaattttattcagtaataatgtcaactaaaagaaggcgtgttttgatattgttcttcccaatcacgttaacttagaacctttaacttaatcataacatttaaaaggctccacccactaagaacagtcagccaataggaaaaaaagttccctacatcctgagccatttaacatccagttgacctttaaccctaaagagaatgctgtccacttaaatacaggtaatgtcctccctctttcctccaaaaagatttcgggcactaaaggaactaatattgaaactacacagcaacgttggttccctagcctactcatatactgccaccatacattaccacaaatggaaaggtaaatgacccacccacctttttcacttaagcgaaagggggttctgctccgcgacctcgtcctggatctgtccctccatctgctgtgctcctccgggtacactgtgcgaccaaagccgtagtagcgctgtccccgcgcgatcgcgtacgcccttccgcagtacgaccttccccgagagcgcgacctgctacgggaccgggaccggtaccgcgaaggagaccggtagtatctcctggtgaacccgtagcgcctctctcggtaacggcggctgcgggatcgcgaccggctccgcgagtatgaccgcgagtagcgcctgtacttccgctggtggcgccttcgggaacgggacctggacttgctcctccgactcctggacgaaaaccggctcgagacgcgggaatgggaccgagagcttctggaaaaagagcggctcctagaccgcgacgacagccggctggacccgcccgaccgcgaggtcgagggcgaatccttctcctgcggcgagcccggccacatgtcgttcacgtagttggacatcttcacctgcggctttagcctgcgctttctccggaaaggatcccgcaagcctcaactcaggacttcctaaaaaaccaagagagaaaaaacaagtcgagtcgcggaagccggcgcctggccacccggaagccacagtcggggaacctccgggaggcggagccacggcgcgggcggcgaccgccgcgacaggaaccgagccctagaaaccccgctcggcgccctgaggccgcggccttgaagcgaaacgctgcgttccccaaacgcgg

SEQ ID NO: 12532 - DNA, 16653 bp, Homo sapiens
ggatcacgaggtcaggagatcgagaccatcctgggtaacactgtgaaaccccgtctctactaaaaatacaaaaaaaaattagccgggcttggtagcaggcgcctgtagtcccagctactcgggaggctgaggcaggagaatggcgtgaacctgggaggtggagcttgcagtgagccaaggtcgtgccactgcactcactccagcctgggtgacagagcgagactccgtctcaaaaaaaaaaaaagaaagaaaagaaaagaaactgccaggagtggtagctcacacctgtaatcaaactactttgggaggctgaggccggaggatcccttgagcccaagagtttgagaccagcctgagcaacatggcaaaacccatctttatgaaaaatacaataattacgggggcatggtggcaggcacctatagtcccagctacttggagggctgagggggaggatcacttgagcctgggagacaggggtcgcaatgagtcgagatggtgccactgcactccagcctgggcaacaaagtgagaccctgtctcaaaaaataatacatagaaaaagaaaagaaactatatgcatacattctggccaggaccaagaggaaacgcctcatcttgaactgtacaatgcagtgttttccaggtgttattttcacaccaccttcacaattgttgccgtatccatactattatttccttttttttttcttttgagacagagtctcgctctttcgcccaggctggactgcagtggcgcgatctcggctcactgcaagctctgcctcccgggttcatgccattctcctgcctcagcctcccaagtagctgggaccgcaggcaccaccaccgtgcccggctaattttttgcatttttagtagagacggggtttcaccgtgttagccaggatggtctcgatctcctgacctcatgatccacccacctcggcctcccaaagtgctgggattacaggcgtgagccaccgtgcccggccatatactattatttcctaaacactcctttaaattgacatttaagcagtcagtttttaaatgttcccagtaccacctgaagtcaatttacatgtctccagggtgtgcaaaccacactttgttttgttttgtttttatttccataggttttgggggaacaggtggtgtttggttacattagtaagttctttagtggtgagttgtgagattttggtgtatccatcacctgagcagtatacactgaatctaatttgtaatcttttatctctcattcccttgccaccctttcccccagagtccccaaagtccattgtatcatttctatgcctttgcatcctcatagcttagctcccaattatgagtgagaacatacgatgtttgattttccattcctgagttacttcacttagaatagtagtctctaatcccattgctgcaaatgccattaattcattccttctgaatgagtagtattccatcatattcatatatatatatatacacatacacatatacatgtatacacacatacacacagtatatacacatacaccacagtttctttatccactcattgattgatggagatttggactggttccatatttttgtaattgcgaattgtgccgccataaacatgcgtgtgcaagaatcttttccgttgaatgacttcttttcctctgggtagatacccagtagcaggattgctggatcaaatggtagttctactttcagttctttaaggaatctccacactgttttccatagtggttgtactagtttacattcccaacagcagtgcagaagtgttccctgttcactgcatccatgcaacatctattatttttttgattttttgattatggccattcttgcgggagtaaggtggtatcgcattgtgataccaccttgatttgcatttccctgatcattagtgatgttgagcattttttcatatgtctgttggccatttgtgtatcttcttttgagaattgtctgttcatgtccttagcccactttttgacgggattttattttattttttttgagacggagtcttgctctgtcacccaggctggagtgcagtggcgcgatctcggctcactgcaagctccgcctcctgggttcacaccattctcctgcctcagcctccagagtagctgggactacaggcgcccgccaccacgcccagctaattttttgtatttttagtagagacgggatttcaccgtgttagccaggatggtctcgatctcctgaccttgtgatctgcccaccttggcctcccaaagtgctgggattataggcgtgagccaccgcgcctggccgtttgtttttttattgctaatttgtttgagttccttgtagattctgtgtatttatcctttgttggatgtatagattgtgaagattttctccctgtgggttgtctgacaaaccacactttgttatcttgcattgggtttccacggagacagaacctgagacagaactcagcacaagcagtttgtttattagaagaacccagaaagctgcacaaattggggaatgaggaagcaagacaggaaagggaaggatgttgagaaagatgtgtttttaaacaggttgccactgaggctggccagggctcaaccccacgaaggacctctgggagatggtgtgggagcgacacttcagagatatctcacccaaggggcgagggagcaggggtatttattcttcaactctcacctctcattggccgagggctgctcctggggaaattaacactggcactcctgaccttccccatgaagttctgagagaaagcctccaggcctggtgctggaacatcaactgctcaaaggacacaaaccagcagcttctgttgaactttgggatacactgctggggtagaaagcgcaggctgtgagtccgagagatggaggtccacatctctgctccatcactttctcagttctacgaacttgggcaagggattcagcttctctgacgccctgtgcctagcgatgcccagcacgtagtgaggactgagtaccccattaggagccaggagttcctcctgcccacactccaggctgtgggatgacgtgtccttcaagaagcagagattgaggtgctcaggcacccatggcttcagggtctccccacgctcaggctgggccctgggtcactcatcaccttatattttaactgctgtgggccctgagtcctaattggagccggggttcaggcataggtcccagctccattcacaactagggccggtagccatggacctagaccctaaggatgacagtccagacccacagcacagggatttcttttgccctcagatgccttctcccggaggaagaacaaagatgagctgacatgccctcttgtattcactgagataaccctgccttctgttaaaggtaaattcagaaagctcaataacttgacacctgaggatgtattcttacctccaacatcagcgcccctgctcaggtgactgggacccaggatctttccaggggtggctctgccaccccctgtaagttctggatgtccttcctatctggccagcaccttgatggtgggaaccacgcctgctttttaaccacttaatcctggaagtgacatacatcacttccgcccttagtgcattggcaagaaccggtcctgtgatccttcctggatgcgaggaaagctaggaaatgccgtcttcgcttgggctaccgctgccaccaacaccaacacagcaggttctcatcctgggggcagaatcacccccacatcagttgaaaacctctgctctgtaggaaggaagaggcgtgggagactgggatggtcaacttggctcaggctggagacatcctccaactcacacactccccagccattgctgagcacgggtgccgtgttttaaaacactgagggccaggcacagtagctcagacctgtaatcccagcactttggaaggctcaggtgggtggatcgcttgagcctaggagttggagaccagcctggcaacatagtgagacctcctctctacccaaaaatgaacaattagctgggcatggtggcgcaagcctgtagtccctgcactcaggagactgaggtgggaggatcacttgagcccagaaggaggagggtgcagtgagccgagatcatgccactgtactccagcctgggtgacagtgtaaccctgtctcaaaaaaaaaaaaaaaaaaaaattgggaaattctctataagatctgggattctggcttaaaaaaaaaaagggaggctgagcgcagtggctcacgcctgtaatcccagcactttgggaggccgaggcgggtggatcacgaggtcaggagatcgagaccatcctggctaacacggtgaaaccctgtctttactaaaaatacaaaaaaaaaaaaaaaagggagatccagctagcagtggaccccacatttctgcagggcaacggtcagttggagctgagcgacaagctgtcagggaactacactattctggatgccacagcccccagcgtgtcctgtattctgacagacactgggccttcagatgtatgtcacctgtctggtcatggtagagacagcctgtggcccctgccttattgagtaccacgccccgtgccgcaatcttgcccggccatggacaagtccaaggctgtcctcaagttcatatctcatgacagagacttacagagaccatcccagtgtgtgtcgaagccaggagctgtggggacaggaagggaacatggtgggggcgggtgcacagggaacagagggcagtgagtaagctgaggcttaacaaagggaggaggaaccagggcgtgaggctactgaggggaattcagagggaaacgctgtggggagaggtgggcagaagggcctcaaatgccatttggagaagctggggttgaccgtgaagaccctggggaggcatggaaggctctggagctagggagtcagcattgtttttgaaagatcatcctggctgggcgtggtagctcacgcctgtaatcccagcactttgggaggctgaggcaggtggatcacctgaggtcaggagttcaagaccagcctggccaacatggtgaaacaccgtctctattaaaatacaaaaattagccaggtatgggaggctgaggcaggagaatttcttgaacctgggaggtggagctagcagtgagccgagatcacgccactgcactccagcctgggtgacagagagagactctgtctcaaataaataactatcatcctggccatcagtttcaagggcgcttcaagcagagaaactggaggccaggagacccgcccagacactgctataatagaccaggcaggagaaactggagctgtggaaatggagaggggagggacaagccccaaatttgaccctgtgaatcccagctcctgtttatcaagaaggaagccggcccagtaggtgaataaaaggattatgagcaaatctaacgctctggggtggagagcaggaggcagtaaggtgcctactgtgtgccacataccctactgagtgctgtgacctagcagtgaagttgtcaccttgggggtacatgttctatatctccccatcgtctgaagtgggcaccctccatttcacagatgggaaaatcgaggctcggcaggatatagtgacctgctcctgggcccatggcttgtaggtgacagccgaaagttgaacccaggtctccctggctcccagctcatgttcttctccttgtctctggggctctaatctctccaaggaaaacaaccccagccccatgagccacagaaccatgggctccctgggccccccagaagcccaaaagtgaccatggggggtgatgagacagcagcgtttgtaattagccccgtggctgaaccgaagacctcccaccaggatccagccagagcccgtctctggggaaggcgggtggggattaagttctcagaagaggatttgggctcccgagtgcctgtgtggcttcctctgagcctcgcagggactctgccttgatcacagcgccagggccttttctggcttctcagcagtctgtgtgaaccttcagatggggtgggcacacgtggcacccccagccaagcaggggacgggccggactcggtcctccagtgtcacctctccctcctgccactggaaccgaggcttagaatcactgaggcggtgggaacatagctgtgggcacaagagtggacatttctacggcgttccctgctgaccaggcgctgttctcacgtgcctcacagcacacattaactcatcttccccgcaaccagccctggagggcagggactgtgattttccccattttacagatgaagaaacagaagcagaaatgtttaaacttatgggaagatacaccactaacaagggctggagccaggactctagccatgcagtgtggctgcagagtacaggattttaatcacccrttgcatcctctggcgtcgggcagggctggacttcaggctgggttttccccgttcccagctgcacccacgtcgtgtctcctcctggagtctaagtttcctgtgctgtgactgcaggcggagaggagggcccaaygtctaggggtgagtcaccacgtgccgattctctgctcctagggtcggggcctggctggtcactgccacccactggctgcagtccagcgccctcatctgcggactccttgatcttgaagccgccgcctcccatgtgctgtggtgtgggcaggcagggtgcggggagggctcggaggccgtgggtggggaggagtaacgaggacgactcaggaatctaactgcaagggttgaggtgtgggggtggcggtggaggtgggggttcagtggctgggaattctgtcctcctggactgtaaacagggcacccatggctgtgcctttgacctgtggggagtgcccagcagcttccacccacccatgccagggggcagctccagggtttctggatccccaagtcagcccgggcttgaccacgctgcctgcaggtgtgtcatcggcctccagcccactcaggtcacctggttggggawaaatggcagtgaaggggcagagtgctgggtcagggtgagagaaggggcctggggcagggtctggaggccttgaggtgtgatcattgcccctcttggcctcccagagccctgggccaaggcctggctagctgctgcctcctctcaggttgtgacaggtgccgtcatgacaaccagcatcaggagagttttggtgccagatgggccctttgtgctctgagccctccactgtcgaagattctcctggggcaaaggcctctttccacaggttcccagacaaagctcagcctggaatggcctcgctatggtccagggaggaaggyggcccaggaagggtcagcaccaagttgcagccgcacagtaaaatgggcagaggagcccagcttccatctccagcaaagggttctcacagccttctgaccctgggtccggcctgtgagaaggagggactcacaggtacccagtgcctgtctgactctggcacttcagcccccagtcccaacggtctcttcccaccctcttaacaacaccggtgccggccccattttacagataggaaaaccaaaagccagagagtgactggggcactgctgtagctggtggtcagggaaggcctgtctgagggagtgacatttgcaaggacaatgccttgcaaagacctggaggaacaacggctccaggcaggcaatagatcaagtgcaaccacctggggcagaaatgaggaccagaaataaggtgatgtggctggaacccagagaaayggggatcagtgagtgggacagaggctgcattatgggatgtggcatgaaaagagctggcatyttcttctggtcgcagagaggaagccactggagggttagaagcaggggagacagctgggcgtggtggctcacgcctgtaatcccagcactttgggaggccgaggcaggtgaatcatgaggtcaggagttcgagaccagcctgaccaatatgatgaaaccccgtctctactaaaaatacaaaaattagccgggtgtggtggtgcgtgcctgtaatcccagctactcaggaggcwgaggcaggagaattgcytggagccgggagatggaggttgcagtgagctgagatcacgccattgcactccagcctgggcgacagagcgagagcgagactccgtctcaaaaaaaaaaaaaaaaaaaagaagcaggggagacaagtgactggcttgtgctttgattactcgagtggctggggagcagaggaggctggggagctccaggagctgagcccagagctcagtctggagctttccctgtctgggttggaggtggtggtggcttggaccaggctaagtgtggtggtggcgggaaggagttggatcccagacatgctgggagggagggccagcagagctccctggtggactgcacgtcgggaggggagggaacaggggaatcggggctgggcacctgggttgatggaggtgctgtttacgggtatggggaaccagaagtggggagaaaacagacagttgggtttggatcacattgggctggaggtgcccactggaccttggagtggagacgctggctgggtaggtaggaggaaaagagtctggagttcgagggaggaaatagaaagatgagggtcaggatggtatttatagttatgggctggagagagcaagtgacttgcccagggttacagacagccagtggtcaggatttgaactggggtctgctaggctctgaaacccacaggggctctttcccggacagctgggaacagagagggcttcatccaaggtacagggggtgccgcaggactcaggggtggggcaaggagaagcccctgaggaaaaaacaaaaccaaagaaagaagtaaagtgaatgtaatcctaatcaaaatcctattggtcaggccagatgtggtggttcatgcctgtaatcccagcaccttgggaggctaaggcaggaggatcacttgagcccagaagttcgagaccagcctcagcaacaaaatgaggccccaattctagtcccgggtgtggtggtgagatgggaagatagcttgagcccaggaattgaaggctacagtgagctatgatcgtgccactgtgctccggtcttggcgccagagtgggacactatctcaaaaacaaataataaatagaaagacaagtccctgagaatgaatgtgggaatgactgagatccttccagcctgggctgcccacctcccatccacagcctggtcagctggaagagcccatgtcaagcacgaggttgtgtcccctgcccattgtacagatggggaaactgaggtctgaaggaaggcagggctggggtctaggtcttctgtctgccaaccccgactcttctgccagcctctaaggtggactsctgtctgagccaactcaatggctgggttgaaaccttccaactgggacattcctgaagggggtgagtgtctctctggaggtcctcctgtagatggacctggggcctggagtcttcccctcctgggtctccccaaggcagtgtttgcccatgctggcctctgcccctggcctggccccgccgtggccttcaggacccctctaggtccctggcagggcagccccatgcctggctctggtcacggttcctgccctgtggccaggaccaaggcccccccctggcccttgcccagaccacccagcgccagggcctggcggagcccgggtggctggcgggcagtgctcccaggctggccagccgtggtctggccccgcctgaggggctgtggcctgggaaccgtcagctgtctcctyggggaagcggctgggatctccagaacaaacagggaaaccacaggctcccccaccacgcccccaaggaggggcacggcctctggccttgcccgccaacaccccactctccaggcctgkctccccacttctgggtgaatagaaaggaggcctggtggcaagcaggtcccagaagtgcctgatcctcaggtggtgaaatgacarggagttccccagacggaagcgcccagcacagggcactgcacacgggaggcccctgagaaacagcagccctggactcatccaccgctggctcagtgggagccacagcaatcctgggggattcctgtacttggcagggcaggctgggacagccgccctaattcagaccggctgggggatggggtgcatgtgactccactaaaagcygcaattagagcccaatttaaagaaacgctgtgttagttcctccccgggtagatgtgattataggctcggagctaaaccgtttctaacaggatgacacatggagaggccccttctgggctctggcaggatgcccagcccagcccccggctgcacgactggggaaaccaaggcccggaattcacactgcaggtgaagagggggcgaggcttcggctccatccccacctctcacttttctctacaggatttcatgctgcatctagaagccaaaacgctgacaccccttgaaaaggagggctgggaactgagatgattgacgccccaaggggaagcgggcgcttcccagaacagcctcggcatgacctggacatggagccaggcggctgctccttgcccaacccatgggggccttgcaatgattaataataataatgatgatgataatggtgccagcagcagccgtggctccctttggaagtgctcccggggggcaggcaacatctcacgcattctcgcaataatcctgccagggagctgctagtgtagccccattgcagggctggggaaaccaaggctccgaagggtcaatgacttgcccagtgtcatgccaggagccagtggtatgttcctgctgggattggacaagcgcctgagatcctgagcagggggcagagttcagggggcggtcggggggtcatctcagtgaatggcaacaatgagtgagtaagcgagcctgttagcaagtgaatgaatgagtgaacgaataaaaaggctgtttaaggaattctgcccctggggaggcatgaaagggccacaggtctctccctagttgcctccccccgccacctccagggagacccctgagattaatgggccacagacaaaggcccaagtctcacctgcccagaaacaaggacccctcacttcccgggttccaggggtcccctgtctcgtccaacaccccgctagggcacagggcactgcacacgggaggcccctgagaaacagcagcgtcactgagcagtgccctctggcctgcgcccccccaccttcatcccagccatccccaaatgccacaagggtagatcacctgccctagtccccaccaccacctgcacccttgcccagggctgaattcccacataggattggggtctggggaggggccaaaataagggaaaagctgatctctctttacccactctgccccctcccgtcccctttgcagctcatattggggagtccctgggttgggggtggcacacacttggttcctaggagcttgggcagtagggtactactgcccctccattccccggatgcgcatccccctccattccccggattcttcattcattcagcaaatatttatggagcccctactgtgtgcaaggtgctgggctcagccattcatgcacacacagacccttccttctgatgtctctggttccattaagaagactgtgtgtcacgtgcctccccaccacgttcccaaggactgtccccacaccaactcctggtggtctgtagctgtgcctccctcatcagactgggatttctccagggcatggttgtgacactgccatcagactggcctgtgcaacctgcctttcctgagaaacctctcccttcactccaagagcctccctggagacggttgccagataaaatacaggacgctcagttaaatttgaatctcagacaaacaaagaataattttttagtataagtatgtcccaaatatcgcacaaggtatacttaaactaaaaattcttccttgtttatctgaaattcaaatttaactgggcaccgtgggtttctatttgctaaatctggcaaccctagacctggagctctttcctcctgctggaagtgggcctggccagatggcccaggtcgtgtctggacttggctcctgcctgcccagttatagctcctgttggtccccaggactagttccctccctcgctgggccgcacctgaaaccccagctcctaggtgggcacagccgcccaccacccagtgcacagagcccagcgtatggacccttaggaacactgcatcccgcctcctgtgtgatgggtccagggagagagggggagagagccacagctgcagagagggaccacgagactcagagacagagagaggcagagacacagagataaagggacaccacagagactgagcactggagacagagggggagacagctgagagggagacagagagcttccggatccctgcccagagctgcttcaggagaccagtgaagcgggtggagggtcctgaaagcccactaggatttgcctgagtggattggggtggaggagaggtggggtccctgagccccaacgttgggccccagactggccggccctgggaggcaggggtgggagtccattcagaggccggcctcagccccagggctctcccctcgccctgcctcccaggggcaaacacagggacattcatggcttcccagaacggcctatggggcagccagagtggcttttaaaattagcctcgctaaccagatctggttatttcaggaggctccatccccttggcaaggcgggagcagggaagaagggagggacctccacattccagggtccctggctgagcaccccctgtggcctgagcagcagagaacgtccagctcccagtcccctggcacagccggcccgggcctgcggtcatctccttggcaaagttgccccagggttggccatggaggtccaagaacaccccagctgggggtgggtaggggaggacccccttgtattgggcacgggttctgtgccagcagccatcccaggtaccttagaggccaagacagcctcttcagagcaataggtaggggccttgtcctcattctccaggtaaggaaacagactcctggagacaggaggcccctgctgtgaggtaggggagatgggggagggcacgtcttccaggcacccaggtccctccacgggaggcctcttccctcctgtgtctggaggaaccccccggctgctgtttccactaccagagtaatttctaagcagagtccagcgcttcccggagcctggtaccccccgcccaagttctaattccagcctcgagtcagagtgtcccggctcgccctcccacctcacagcccagggtgagcacagagctggcgcgggcacaagagaaatagcaccggacactttgatcccagaggcccgatccgttgccagcctcccctgaccccacctcggagcttggagggatgcggtagggtgaaacccagccccaaggccttccttcccgcagacggcctggcaccagctggacagggatggggcaaaggcaggttctgcccaccaagctgcccacctgctctgccacagcagcccctgctgctctgtctcagctgtgggatagagtggagtgggggtgcattgctaagtacagggagacaagccggagacctcccccagctctgttatgggagcatcgtcaccccaggtaaacctggcaagctgaggcccagggaagcacctgacgccgtccattcccaaagcctcacatctaggcacctgtgctgggcccagtggcaggtgggcgtcctccacgcactgagcggaccccacgtgttctgaattacggacgtcattgatcccttcctgcggtatgcacactctcttctttgagcccaccacgtgctggggctgcacccagaactttatgaggtgtcacctcatttaatcctcatgccagggtgccagcgagggcagggctgttagcacccccactgcacagatgaggaaactgaggcccagggagccaaaatcatgtctgcatggtcatagcgcgaggaggcgaagcagctcagagctgattctgaagaagctcttaaccgtggtgctgaactgtgatgccggccctgtggaggtggggcaggaggagagagggcagaggactgcggcggagggatagggagcaggggtgcggctgatgggtgggcagttcacaggggactcactgggcccagagcagcctagagccaaaccgagttgggtggggctggggtttgggtgtgagtcaccacccatgggtggcctgaggcatcagagggtcacagaagggccctgtcgggaaaagtgtggcactccctggacaaacccctggggttccttcagcatcatcctgggaagggggcagggccagcaggggatagggggcactgccaagctgtcagggaggccaaggcacggctcatcccttcggggcccaatttggtgcctactcccaaatgtccccaaagccaccccgcagacctgctctcctccgtggtcctgccccagagggagagtcccctcattcacccaacacccagcctgtacccccgggagccacccgattccccccttagccccacagcccatcaggcgcttggtccccctgctcaggcccacctggtgtccttctcagcgtcctcctggccaccctcttaccccagcaacaacctcgttggtcccctcctccctccactggtgcagcctccaccagcaactaccgctcctgcctggggctccccctgcccttggcgcagagccctggcctctccgtcgggagttcaaggccacattgcctctggcctcatccctgcccatctccctgtcccctccattgtcaccttcccaccattcagagctggctgccaccttcctggttccaggggtgctctgcctccccgccctttactcgaggccccctcctgcagggtccctcctccctaggccttctcaggaacggggagcaactccaggaactttccctgacgcctctctccccaggccctgcttgtgcacacctctcctgtccccggctgcccctcatcacccttcgtcctactgtcccagctgtgagatcctggtagagggacttggactcatccccgtctcctgggtccccatcgggtcccgtaagtggtcccttggcgccgccttgtggccatatcaggggattcactgaatatgagaacagggagaaggaagtaattaattgagcacctaatgtgtgccagacactgtgctgtatgtttgatacgcaccagctcattgaatcctcacaacaaacccttgggagaaacactaccactcctattttacaaaaggaaacactgaggctcacggaagctagtaagtttctcaacgccacccacccagctaacaagagacggtcccaggactcaaacctaggtctgcctgacagcacagccatgttcttcctgcagtggggaaggggcccaggatgcagggaaggacagcaccccggggaggaaaccacgggcggtgctcacagagctggtggcttggctttggaggtgtccccaggcccagcagctctgatggggacaggcttgctccctgccaccttgacatccctggacatctgtctggggtcaatctggccacggttcacacaaagccaggcccaactctgggtacaatagcgataaatagaatttattttatacaactgttaccgacatccacacggccacaggggcttccaaaatgggtattggggccaggaggctggcctttggcgtgacgcctaaaaagtgtgaccagacacacaagggctcccagcagctgtgccgggctgccccctccatggcggtcgggggaggcaaggcctggactctcggccagctgagactcttggcctggagggcccagcatgggatggcaggggttaagctgggtgctggctgaggagccaggtaggtccccatcccccatgagggggttacttgtctgtcatgtgtaggcagtggacagggcatcggcagacctgtggcagaactggagggtccaggaggcatactgggcacagccggctccctgcccctcagcccacctggggctccagggacctcaagaagcagggtagggtgataggaggtccctgggaagaaaatcctaccttctaaggcaggtgcatgtaatcacagtcttcagtgacctctgaaataatcttgtccatttgtagcagacatgcccagagagggagagtgacttgcccagagtcacacagcagaacccaaattggaaaccaggacccggctcccaacccagtgctcactcccccacatatcacatcctccttgtgctgcctccaggggctaagctctccacacggagctgtctcaaactctctctcccaccttgttccctctgagtccagagggatgctcaggggtgatggaggcccagggagggggcaagccagacccccagtcctgcttccactgagcaatccctgccccagcccagacccccaggctgggggtggggacgatgccagcagcttccctgatcccaggtctggacggctctgccctgcagagacagcccagatgggtgggccatgggg

SEQ ID NO: 12533 - DNA, 43328 bp, Homo sapiens
tttacagcaagggaaacaaatgctttgcactctcattgttattcttccttgctgagcagcagttgtcaccccagctctccttggattttacatcccaaggagaacttcagtttcaggatccttcatccctgcaatactagactgtttagaatcagggaacccctgatgtctacccttaggtcttctggctgctctctgaggagatggaatgcagatggctccaatgaactcagccccatgggatgacaccgtgccaggatgcaggatgcatggtgacaaatttcaggtactccaacccaaagaccaggtggctcagaggagaatctgtggaaggaatcaggctgggagctgttcagggccagaaaccttccttctcttttacagatgggggaaactgaggctcagagagggatacaacttggttaaggtaccacagttggttgtgactgacctatgcctgaaccccagctctcctgacccctaagctgacagtctttccacccactgtgtgtggccaatgcggcctcaaggttgtttaaatctcctctgcagctgaccatgttggtaaatccggatcagagaggaaacagaatcatccaacatgtacaggcgctggctctacccgttatctgcaggcccacacatctgcacgctgcccttcttagcacgttcatgggcctttctgcggggtcggaagatctgggttcaaatgttacatctgctactcaccagctgtgtgaccttggccaaattcatcaacgctttgaaccccaaaaggagcagagcagcatgagagaagcttacgaaaaccaggcttgaaaggtttagctaaaagagccactttccaaatggacgctccaggctcagagaggggggcttccgttgtttcacttcagtgacgaaaataactgctctgatgtattgagggcccactatgtactccaggcaggtgccaaatgctttatgtgtgttttctgtttttttgttttttgtttttttttgagatggagtcttgctcttttgcccaggccggagtgcagtggcgtgatctcagctcactgcaacctccgccccctaggttcaagcaattctcctgccttagcctcccaggtagctaggattacaggtgctcaccaccacgcccggctactttttgtatttttagtagagatggggtttcaccatgttggccaggctggtctcgaactcctgacctcaggtgatccacccacctcagcctcccaaagtgctaggattataggcgtgagccactgcacctggcctatgtgtgttttcttgcttaactagtgctgggaggcagaactgttatgctcattttacagctgagaaaacaggctgtcagaaaccaggtgactagacgcccgtagcacatggcaaagccaagactgaagacccgcttgcttccagaaaccattaggacaacatggattccctgggtccttcagcctgccgaggataaaatgcttctgggctggggggacagtgtgccccggaggcactgctgccaaagcccattcaccacttcctggctcctggtcctcagagctcagccctcaggatagttgctcctggaaacatggtcagctctgctctgatgaacttcattatctttatcaaattaatttacacaagccagtgtggccacctaatgaggtcatttcccagggccctgtgcaggctgcttaatgaggcaggagtggctggactcaggtaccaagtgtcctggagtggaggagagtggagctgtcagcgtgactgtgactgctgtgggcttcccgctctgtcctcgttcagggctgtgaatgatcaccgctggtcatttcctccttccccctgcgaaagtcctcactttgccaggtgccagtttatcactccaggacttcttgagcaggcggatgtgctgcgacctgcagtacctgggaggcctttttattctagcacagacagattccttgctccaagctcctccttgttaattttgtaagtgactgagatatgactttcttttgtgcctgctaatggctcagccctgcagcagaatgcccccaatttggtaaatgaacttcttttctttctgtaaatgagatttttaagatgggaggagaagacaggcgagactgaaagttgagaggccaatacggagctgtggcggctccaggtgagcgagggtggctgtcattatgggaaggaagacagggagctgccgggaggcctgctccttaggaggagtgggggacggggtgcaggtagcctcatttccggcttgagcaactggacagagagtggtcagccttgccaattcattcattcattcattcactcattcactcactcaccaaatacacatgtgaatatacacacatatgcccacctattgtatgccaggccgtgggtgccaagtaccgttcataaagccatgaacaaaacagaccaaacccctgtcttcacagacccaacattctagtaagaatttaggcttaaacttctcacttagaatcttaaaattttgagtcttggtttcacccaatcttaaaaccagagactcttcactgtgactgttattaacttgcacccagtgagcacagacctcatgcatcgtctccctcagtcctcgcaacgactgtgtgatggatcctaggattgtccccattttacagatgatgccattgaggcctaaggagagcaagttactttggccaagttcacacgaccctgcagccaggatttggcccaggcctatcagacacctctgtccccctttgctgcctctttcatctcacaaattggggtaactttcaacaggcaccccagagttggaagggactgtcctccctgcctgcagaatctgctgtggtatctcttgaatgaggccatgcagcccccacctggctccacgttcattcttgtcctgatcctcaagcactcagggcctcgcctctctgcccaagccccttcctcaccatgccagctacttccatccccacttgactgggtgcttctcttcctcactcagccagactcttgcagctggcacccctgagtcccccactctttgccttcaccccttctcccagcctgctggatcagcttatgttgcggtagagccgtccctggtcacaggaaggagggaataatgacagcaaaaacaatagctctgtggcaggctgagcatacaccgtgccctgcctcactgaattctcccaggtgagtactgtcattatttccatttgacagtgcagggaatgaggctcagggaagggaagtgtcttgcccaggggcacacagatagtaaatggcagaggtgggaatggaaccccggaccgtggctccagagtccacatgcataaccagtgatgatgtggggagtctggaagctgggcttctcccaggagaactcccaactcagcgatgctccgtaagatgggcccaggtcagacacagtggctcatgcctataatcccagcactttgggaggcaggaggcagaggcagaggcaagaggatcactggagcccaggagttcgagaccagcctggtgaacatattgagaccctgtctctagaaataatttaaaaaattagctgggcatggtggcatgtgcctttagtcccagctcctcaggaggctgaggtgggaggattgcttgagcccaggaagtttgaggctgcagcgagctatgattatgccactgcactatgacctgggtgactgaatgagatcctgacactagagaaaaaaaaaaaaaaagaaaagatgggcctgatctgtaaacagctgcctgatttgcagtgaagggaggcagggaagaaggctggagtggcctgctgatggaacagcctgctgatagagtagctggccgctgctcagcagcaaagaactctgtggccaacgcctccttcctgaggactcaggaggccagaagtcccacaaatgttactggagtctcatttcactgtgattctcccatctgaagtaggcttccctcccaatcccatctttctctcttccttcccttccttccttccttcccttcccttcccttccccttccttccttccttccttccttccttccttccttccttccttccttccttccttctttctttctttctttctttctttctttctttctttctttctttctttctttctttctttcatcttgctctgttgcccaggatggagtgcagtggtgcaattttggctctctgcaacctccacctcccgggttcaagcgattctcctgactcagactcccgaatagctggaattacatgcgtgtgctaccacgtccggctaatttttgtatttttagtagagacagcattttgccatattgcccaggctggtctcgaactcctggcctcaagtgatctgaccgcctcggcctcccaaagtgctgagattacaggcatgagccaccatgcctggcctcaatctcatttttctatcactgatcagtattaaaattatcatgactctcttggtttactttttttttttacttgcgtgtttttttttcccttcctctagaatgtaagctccaggagggcaaggacttcatcttgttcacttgaagctgaagccccagcatgtacaatcccgtgctgagttgctggttcatccccagcatgtacaatcccgtgctgagttgctggttcatccccaacatgtacaattccgtgctgggtcgctggttcaccagcagagaggagcattgattctctttggaaaagataatctatctacacccctggaactgtggcacagtctcacggagggcctgcttccattcgggtcaacggcgaaaaaacgaataaacgtgagccgccatcaggtagggcgagatgccccttctttctgtcccagccttagtgctgccatggctgcctcctgctcctccacgcaagccccacctctgtctgtgatgtcagcgtggctgcccatgggatcccagcctggtttgcctttaaattttacaaccttgtttatgcagctcgaggcccatgcactaaagaccacacgctccattgaacatttatggctgcaaatggctcctccgtgcaggcaagggagggggctgcgcatgcttagggtgaggcggctggaacggggaggccaccagctctcagcctccacttcttcctcttaggattcctcccttggctgaggctgactccctcagtcttattcctgatgacattgctctgttcacactgtccaagtccatatctgggcactgctaggcatgagatagaagtgaacagatgttagtcactgtcttaggtggctgcaacggggcataaagatttgggtacaatcggtgctcccaggagaaagagcaagggagtagggaaagtgggggaggtgctggggaggtgggagcagccaagccagggtgtgatttccagaaaagccccagagagagtggcctcagcctcataccatagggcactctggagttggtcctgactcgggggcctgtcagtcatcggccaagggccaggctttggggtgtcgactcccacacagctcagctccctgaagatgtgggcacggtggtggtgggggctgctgaagagttgcagatgcagccactggaggggaggctgaggtcagtagccaggctcacagggacgacaatgggatgggaagcaacacctgacgggctcagctacaggtgctgacggattcacaggcaggtggcagaaggcagtcaaataaatgagacaatacagcgccctccctgcgaccacacacaccgctcacgcctgtgagtgttcggaatgcattgggtctcattctgcgtgttgtacgtgtcccgtgacgcctcatgaggatgctctctggcaggcactggtattgttattcttattttacaggtgaggacatggaagcacagggaggttatgccactcgcccaaagacaactaatcagtgacagctgagacttggactgcagaacctacactttataactattttacagttctgggcgtcacggaatcttgcatgaagagcccctaacctggcccgggtggaggtcagggaggtcttcctggaagagggggttcttggcagcaacttgctggatttggtgttccctgttggttggtcagtcgctagacagttattcactgagctctgagaacaggctgggccctgctccaggccttggttggacagcagggaacaaggctgggggaaatgactcccgagaaaatggacatgtgtgaccctgggttctgggaaggcagggagggaagacaagtaccagaggcacagcgagggtctctctggagccacagggagaggggagggatgcacaggcctggtgtgctgcagggcctgagcctgtggctgcttctggccaggaaagaagccaacgttacttaaagaagttattcatgtaaccaaataccacctgttccccaaaaccctatggaaataaaaaattaaaaaaaataaaaaagagtaagcaacaacaaaataaataaataaataaatttaaaaaataataaaaaaagaaacccacattaccaagtgtttgcgaagtgccaggagccaccctaaaaacagtcctgtggggtgcagccattgtcatctgcagtttcagatgaggaggcggggttgcagaggtgaaggtgctgctggtggtgtggctggttggtggctgagccgggaaggaacagaggagaccctgggggatcgatagttgtggggagagaggaaggctgaggaggggaagggacgtcaagttaaattgcttttagaggtgctgggtgtctgcagagatggttcccccatcatcgcaaggtgcttgtaaattgtcgcctctgcctccgatagcctcctcggaggagagagagtgtctggcttcctcaccttggtgtttctgcatcctgagaaactcgccgcctggaagctccagaccctccccaccttgtcagacacaggctttgctgggaagggcctccagcctcgggctttgcagcagaagctcagagctgcctggggggaccagaaggtgggaacagacctgggatctaacttctacagagcctcctgctggctggggaacaggaacatatcatgckcctctataagcctcagtttcctcatccgtccaatggctatgctaagcctctcaggcctgccctggccttgcagagagggtaggagaccaggatttcccatctcaggcctcagagacaaatgtgggtgccaaacactgcctgactcagtgtaggcagccctggtccccattgggcagggcctttgagggagggcgggcagaggggtgcccagctgcctatgtcctctgagaaggaggctcctggtgccgggaaagagtgtggactctaagtctaattggctttctctgcccagctgtggggccttgggtgagccacacaattctcggagacccagtttctgcagtggttttgctgagtcaccaggaagcctgttttctggtgtccgaggtgagggaatccccctcagtatctctttttggatcaatttctggaatattctaggtctttctaggcctttttaggcccttagccactgcccccgctgtgtgctcacagcctgtgtgggagttgggagggggctcctactggacctaaaggaactgccttgaggggaggatgtgaagtcaggggcagaggctcctcaccctcctgtccagcttcccaggagccagaggccggaaccccagactgagaggcctcgactcctcagccttttctcccccacctgcctaggcctcctcctcaccaatcctcttggccatttactcttcatcagctccaccatttctttctctcaagctgcagcaaccagaactgaggtctaactgtatatcaatcacgccaacaataaccataatgaagtcgatgtttgctcctgaacccttagtcctgtctgctcggggggttgcctttgtcacttctcccattgggtgaatcaccagctcaccgatgcccctcaccatcttgaatgccagctcaggcctgtgtagagagcctggaccctggtgtcagacagacttgggctctgacgcgggtcctggcacctgccacggtgaccctggggcctttgacctccccataccaggccttagtttcttcattggtcaaaactggagcatggtgatggcctcctgctgggtgttatgcttcttagacgcagcagggcttatgattcaygcatctaggagagtgtggggcacttggcccatctgcccactgcagagctaagccatgtgtcctcactcctgtccttagagaacttgctcctgggttcaaggaggcaaaacacaaaacacagttgaccattaagtgataattcagatcggtgtggtagacacagaaggcaactcaaaccctcccctacccccaaggagctcatagccaagcatgggagataggaaacaacatctttaataaaattacggtcacaacatctttaataattactaaatattgagtatttattacgggctaggaaatgtaaagagctttacatggattttattttaattcttacaaacgatgagaagacagatgttattatccttaattacagctaggcaaactgagcctcagagaggtamagtcccttgcccaggttcacacagcagagcacagagcagatggaactgagctttgaacccagatctgcctgatatggaggcccatgctcttagtttgcctgctctatccctctgtgcacaagtctgtgatcttccaaatgacatttctgtgscaaaccgggccctgttttctgcattaatacccatcccgattactgcagttttarttgcaaatgtcagaaaatccaattcaaaggacttaaataataaagagaattcactggcttacataactgaaaaacaggtagtgtctgcttcaggcaaggattgatycagctgcaatgcattgattggtatgaataggaccagtgagttttctttttctccatttctaggctytgcttcctcagtgtcagcatcattcacagcaggcatgtccctcctgcctccaagagagtcaccagcagcttcctcctccacatctgtgagtaaatgagagggtctattccacccaataactcaaatcccagtttcaggatttgacctgtggttggtcagactagggacacaagcccattcctgagccaatcactgtggctgaagaggtgggagacactgattggtctaagccagtcaagcactctcaaggccaaagtgcatgggcaagaaatttaggacaaggggaggaagaaagaaaagaaaagagaatatcaaggaggcaaatgacaaataaatasccactcctttcttcccacgagagagatattattccccccatttcatggaggaggaaactgacgatcagagcagccaggaaacaggatggcgttstctgctgagggacggtgtgttccctggagaggagatccagcttgccattgtgggtttcttacagcaaaaatcctgtgtgtacacatatgctgaacaaggcgcacacagtcttcatacttctttccccaaatccactgttgtacctcactctggaaaccaaagaatacaaatggagatgaggctaatttttgcccctcaaattggcaaaggtgaataaaaccatgtttcttgggctgtgtgtgatggctcacgcctgtaattccagcactttgggaggctgaggtgggtggattacctgaggttgggagttcgagaccagcctgaccaacatggagaaaccttgtctctactaataatacaaaaattagcctggcatggtggcgcatgcctgtaatcccagatactcgggaggctgaggtacgagaatcgcttgaaccctggaggcggaggttgcagtgagccgtgatcatgccattgcactccagcctgggcaacaagagtgaaactccatctcaaaaacaaacaaacaaagcaaacaaacaaacaacaaaccatgtttcttgatgctggggagtgtggagtgatgcaggttgtttattcctgcctgataacatagaaattaatatgagctttctggaagtgagagcttctacattgttttaagagtcttgagcattttgtaccctttgacttccagaaattttatttccaggaattcatgttcagataatgggagagatggacattgaatgatatataaagccatccacggctgtgttactcatagcggggaaaacctggcaccaccgtgatcttgattttttatgcttacatgtcattagtatccatctcagtctgccaactgccatgtgtaagaaaaatgcaaccctctttattgttctagaactgagtttaatttttatttcaagactctgagatgaccaagtggcaaaaacctagtctctgtcagctcagggacccccaccacatttccccctttggactgcatcttgcactggcacctatgaggttcttggtgtggtgtggttgtcagtctttgatctgtttggccaccgcctgtgcctctccattcctgatcctacaggctcttctggtcccacggttctctgtgtatagaaaacattctctgtctgggttgtgagaatgcggcaggcagtcaggccctctgcgtggaccccacaggtggtcaggcagtcttttcttctgctctcatgctgtgctgacgcagggactttggggtytccttgcttcctttgggattggcagcatagactccctctgtctcagatccccacgctttcatggaggtctggggattccttagctggcttgtggtaataaccattgcttttaaacgaacctcctgatttcttccacatcttctgcctgtgtcagaagctaggcagttagcacagaatgccccagctttctgaactttttgggggtggggtggtacacgaagaagactctggaggaaccttggttagaaccccaaataagaacagctagtatttattgagcatttgctaggtgccagaccctattctaactgatttacgtggatttgctcagttatttgttgtgaaaccttctttgatagtggaagaaactaaagcacagacaggggaatcactcatccaaggccacacagttgggaacggtaggacggggctttgaacctaggcagtccagttccacactttctgctcccaatcattctctcccgtggccagcaggggccktgaggggtgttggtgctgagagcrgggctggagaggtttgggggctcagagctggtctggaggargaaagaagttcagggtcagccccctttcctgctccctgctgctgtgaactgcctgcgcctggaaagggctgagccactctgagaagttcatgggccaatgttctgctgcagcaactaaatctccagcccactggccttgaccttggctctgcctgtggagttgctgaatgatccaccttgaggcttcttgcagcagatgcattttgcatgggggccttggaggctagctagctccttccatggtggggctgggaaatccagcctccttccacccctacatccagccccactcctgtctgaggtgcggggtggaatcctgagcacctactgttgtgttctctctctatatgccatctcatcggatcttcccaccagccctatgtgatgattcaccttaaatagttgagaaaacagcctcagagaggtgaagacacttacccccgtcacacagccagtgagaggggcagcgtggggttgaacctccccgactcatgctcatctcactccattagggggcgtgaataggaggtgtggtccctgctcttagacttctagcactgacagggtcctttggggaatgaggccagagtttgggttatgaggttcgaggtgaagaggcgacaagggcttagctctttgctaatgaatccaggaaagctttctgtagggattctttttaaaggacctgtttgaggctgggcaaggtggctcacacctgtaatcccagcactttgggaggctgaggtgggtggatcacctgaggccaggagttcgagaccagcctggccaacatggcgaaaccctgtctctactaaaaatacaaaaattggctgggcctggtagtggatgcctgtaatctaactactcaggaggctgaggcaggagaattgcttgaacccaggaggtggaggttgcagtgagctgagatcgtgccattgcacttcagcctggccaacaagagcaaaactctttctcaaaaaaaaaaaaaaaaaaaaaaaaaaaggaccagtttgagtgagaagggaaagtctgccatcgtgttccgaagataaactttggagtcgcacagacctgggtttgaatcccagctctacccgtttccaggtttgtggttttgaagaagttccttatcttctctggttttgggctttgtatctgagcaacaggtataataatgcctcctctgaccctagagaagtaacagtatacaatgtccacatacagacttagctgaattctttgagctctcactatctactaggccccaacctaactcttcccacctctaacttcatytgctcctcatcacaccccatggggtggatactcagagwtgagtcacctgcctgaggtcatgcagcgtggaggtggcagagctggggttccgtggcctgcctgagctcctcttgcccttctctttctcagtcccgcttgtgcttggctatggctgcagtagttctgatcctgcgaagagcttcaaggtgaagccggattcaggatttcccagggattctctagcagcctccattattccccggggagtgcgggcagctggggactcagggtgtggctcctcttgactctctccctgaggcataaataaccctttgtctcaaamcccaccttttgtttttgagacagagtctcattctattgcccaggctggagtgcagagatgcaatctcagctcactgcagcctccgcctcctgggatcaagaaattctcctacctcagcctcccaagtagctgggactacaagcctgtgccaccacgcctggctaatttttttatttttagtagagatggcgtttcaccatgttggccaggctggttttgatctcctggcctcaaacgatccacccacctcagcctcccgaagtgctgggattacaggcgtaagccaccatgcctggcccctcaaagtttttttaatccctcaagcttatagaatcttccctgctggggcaatgatactctcctggagcttgccagggagctgggcttcaggagtcattcagctggtgctcccggcccactctccacctgcagatggtgctcccagccccctctccacctggtggctggtggtgtggcctgaccctgagatggccagttggtggctgttggtgggccctggggtatccccagaagaatccctgtaaacctgcctggcaggcagcaccaaaggcacatcaccctagagaatcrtttcctggagcgtatctctctcattttggggtccccctcccaaaggcagaccccaagacagtgcttgktacaggtagtttatgtagggcttgattctgggaaccaggggargagaagagaggattcaagtgctacaagttagactttggtgtgggggacagtgctccctcttgctggaacattctgagaagccttaggaaatgcatctctgaactgtccaccaggggagatggaacrtttacccaccagtctgtgtccctgccagtagaggtggccccacaggtgttaactcccctgtgtccggactgtgcatctgtgaatccctctgctgcttcagagaaggagttccaagcactgtgaggtgacccttgcaagatgttgctggaggtctgtgtagaattggtccctgcagcagtggctggagaaggcatggcaggggcagtgagaggatttgcagaggggtagaatccgccagtgtccccggcttttttgctgtgtgctgaccaaaaatcagagtgccttgacccacggcctgtgaccaggccagcttcaatttttttcacagcacgtttgaacccaaactaggaccttgaacattcctaggcactgcaaaagatatctagggttactagaaagaaattggcccagccctttagccaaactccttaagccctcatgtaaattccatacctcaccccctcgctgctgacataacctcagtagatgccccttttctctcamggtccctcagaggattgtcatagcactctgtaagttccctaatgagtrctttgcayggactaccctggcgtttagggcttctttctttggaatctctgccctgtcctagtacagcttggggcactcctttgcgcgaactcccctgccattgttttttggggtgattccagctatggatttgcagggacgaaacaataggcgtgaaggagggtgcacacctgcatctctgcctcgctgggtcactcagtccccaacccctggcctgggagtgctgaggggtaccctgcagtaatagtccctctcggtccctagactccaagaccacagctggacttccatgcttttgtgtcttccatgttttttggagatggagtctcgctctgtcacccaggttggagtgcagtggcacgatcttggctcactgcaacctccacctcctgggttcaagtgattctcatgcctcagcctcctgagtagctgggattacaggtatgtaccaacaggcctggttaatttttgtatttttagtacagttggggttttgctatgttggccaggctggtcttgaactcctgaactcaagtcatccacccacctcagcctcccaaaatgctgggattataggcataagttaccatgcctggccatttttgtgtctttcttgatgagcaactgctctgttccagccctgtgctgggcatattcacatctttttcttctctctctctcttttctttctttctttctttcttttctttctttctttctttcctttctttctttctttctttctttctttctttctttctttctttctttctttctttttctttccttccttccttcttcctttctttctttctttctttctttttctttccttccttccttcttccttccttgcttgcttccttccttctttccctccctccctccctccctccttccttccctccctccctctctctttctctttccttctttttctttcgactgtgtcttgttctgttacccagtgtattagtctgttgtcacactgctgataaagacatacttgaaactgggaagaaaaagaggtctaattggacttacagttccacgtggctggggaggcctcagaatcatggcaggaggtgaaaggcacttcttacatggtggtggcaaaataaaatgaggaagaagcaaaagcagaaacctctgataaacccatcagatctcatgagacttattcactatcacaagaatagcatgggaaagactggccccccatgattcaattacctccccctggatccctcccacaacacatgagaattctaggagatacaattcaagtggagatttgtggggggacacagccaaaccatatcaccaggctgaagtgcagtggcacaatcacaactcaccrcatccttgaactcctgggctcatgtcgccctctccactccaagcagtgggactacaggcttgagccaccatgtctggctaatttttttttttgagaagtaggggctcttgctgctttgccaagactggtctcgaactcctggcctcaagcagtcttcctgcatccctcccaaaatgctgggattacaggcatgagccaccacacccggccactttaacatcttatttgatcctcccagttctacaaggcagtcgttacttccctctgcattttacaagggaggaaaccagactcaaagaagtaaagaaacaagccccaggttacttggctgggcaggagtggggtcaggattggcaaccagatgtcccccctgccccctgacccccaccatcacgtcccctgcatccctacttccatcccctgcctctgcagctcggccttccaggccagaccacccaggtgaaaggcaggcactatattttacaaggcagggagccctggggaggcgccgagtgggaggagatgaaataggtggccatagctctgccaggtggcggctgtgcccactcttagtcctgacagcccccacctcaagccatcctgcagccctcagtcttgtctctccaccatctcttcctcacccgcctagactcccagaaggtcctcatggcccatctagtctggacttcccttaaagtagtgaaatcctttgtggaaatgacatcttacagggactcccggcacatcacacagattagagcaggtctggtctggtggcagtcagggtcagggacagggtgccactttctcttcctcctatttaagatgcccctgaggccattgtggagaaccctggggtcccaaggaatgtactttgaaaacccctagtctggtccatacccctccttgagcaggtgggggaaggggacccagtraggtctcctgacttgttcaaggtcatctgaggagtcaggggcagaggcaaggcctgagttgcatggtgtcccaggcacgtctccccagagtcctctacattgccagggggtctccatggagccttccagagctgcactttgtgaaatcccctatgcaaatgccacgcctgcccgggtgctgcgtttgctcacagctgcagaggctggtgcttccaaagccttatcactaaagcgggcatctcattccgggcctcctgcaccctgctctccaggtggagataaggagcattatctgtctcagagagcggagctccaggagcggacttaataaatggtgtttgccgttgggcgctgtgttcggaagaatctccttgaaaaaaaacccagaaatagctctgcgggctccacattccccaaggcctgacttccccagaagacacaaggaccaggcaatgtgagaccgtggaagacccctgcttttataaggcccctttctcagggggagcacccagagaggcccccaacatgactcagggatgagctgggctaccagctggcaagacgagtacccagggtcccgttggcctccatctggctgtgtggctcagttaagtctctgcacctctccggcctcagtttctccatctgtcccagaagcccttggcctggataatccctggttccttagtagttcaggcagcctttgtcttctgaaccccatgctgccttgggttccacggaygcaggtaagtcttgggggttcccgccccacctgcatgctcagggaaggctctccrctgccgcattcccccgctgccagtggctcccacctgctcccctcccagagggctgactccaaaggaagcctgtcctttgtcagcagagctgccttgcccggcaaagaggctttcatctctgtgcataggacttccygccgcatcagcagaaacttctggctgcttagtgcagggactagggggtggctcagttgttgagggcgcaaactttggagtaaagcgaccctggccttgaattctggctttgccatttattctgtctgaccttgagctagttgcttaaccttcatctgactccgcatccctaactgggatatggagactaataacaatatgtaattaaattataggaatgactcaagaaataaatgataacaagtgtaaaacacccagcacacagcctggtgcctggtgcctggtagagactctattatgataaactgattgcattaacaacctcaagttttcagtctttcccatacctagaggctttgcaatgagactttgaagttgctttcactcaagaagcagaggtgatctccccatcctctgcacctggtctggctttgtgatgtgctgtggccatagaatgtggtggaagcaatgatgggccagatcagagtctaggccttgtacatttccactggcatgctcttgcacttccgttgtcagaagaacattcctggctacctagtggagaggagacatggggaggagctgagttgccctaattgaagccagcccagatcagtcaaccaaccccatgacacaaaccagagccatycaactgacccacagactcataaacttaagaaatgccagttgtttcaagccactgagttttgggctggtttgttacacagcattgttatggcactagataactgatatagatacttgtatgatttactttagaatgacagaggtagccctgtgtactaacttgctatgtggccttggggaagtcacatctttctgaactgtgagttcctatttgctaagtggcagtcttaacacccagggctttcgtggtgacagttctcgctaagcttcgttgctagaattagactggggtttgaacgttagcttcacccctttcttcatgcctgaacttgacttatcacttggcctgtctgagcctcatttccttcccttgctgggtaatcaagccatcttacaggactgtcgtacagaytacaaattcttacaggaagggctgagtccagtgcttggcacatattagggacttgttccagttatctattgctgcatcccaacacaccccaacactttgaggtttaaaacaacagctattgatcgttttcttaattctatgggctaatgggttgagttttctgctcaatctgtgttccgtagggtrgtggggtaggggcaggggggagtgttcctgggaattgaaaactgggagtgtcctaggccacctgagatgagttggtcaccttgttattgcctggatcattcatgtagctgcagccgctgtaggcttgctgggctggggggatccaggatggcttcagtcatgtggttggcagttggtgctagctgtggactgggagctcagctagtactctctgccagggcttctaggtttttctttatagcctggacttccttacagcatgcagttctcaaggcagcattccaagagggagtgtcccaagagtgaaagcccagccgggctcacgcctgtaatcccagcactttgggaggccaaggtgggcagatcactagaggtcagagtttgagaccagcctggctaacatggcaaaaccgtctctactaaaaatacaaaagttagccgggtgtgatggtgcacacctgtaatcccagctacttgggaggctgaggcaggagaatcacttgaacctgggaggcggaggttgcagtgagccaagattgyaccactgcactccagcctgggtgacagacagagaccctgtcacttacacacacacacacacacacacacacacacaaggccgggtgcagtggctcacgcctgtaatcccagcactttgggaggccgaggcgagtggatcatgaggtcaggagatcgagaccatcctggctaacacrgtgaaaccccacctctactaaaaatacaaaaaattagccgggcgtggtagcacgcgcctgtagtcccagctactcygtctctactaaaaatacaaaaatacaaaagttagccgtgcgtgatggtgcgcgcctgtaatcccagctactcgagaggctgaggcaggagaatcgcttgaacccggtaggcggaggttgcagtgagccaagatcgcaccactgcactctagcctgggcaacagagcgagacttcgtctaaaaaaaaaaacaaaaaacaaaaacaaaacaaaacccaaggagtgagcacccatagagcacccacttgcttctgctagctaatgccccaaagaccaaagcaaggggcatggcctcccccagagtcaatgtgagaggggacttcaggagggcagaaacactgagaggcatggttcactgggaccaccagcagatgtgctggtctgccgcagatccataggtagtttgagttgttactgtggttattatccctataatgaaaggcctggattgatgatctctgaggtcactcccttccagtgcctgtattctgtgattcaggaggatgaatgactcacccagggccacatagggaggtgggagaagaaccagataaaytgtggaagtcacataaacagcactattgataaaacaatcagtaactgagaaatgacagaaacataaaacawtctatatctagctgtttgttaggagttttaaatgtggcagkaccatcgcaggggcaagctggtctgtgcctgcatcattgcagacagtgatgggctgggaaaagagtcagagggacctgaggccatgagggtgatgcacacagatcctactgagcaaaggccttgccagaggggacktgccttcaaaccaagagtgaaagaatgtgtacaaattgaggctcagagagctcaagccatttgcccaaggccacacagctaggacatggtagagctgggattcaaaccagctgtatctggttgcaaactcccaggcttatttttcaggtcatactgactccagtcttcctaaatcagtagccctgctccagggtgctgggtcagggtagatagatggccctcggcccagtgggcctacaggtcaggaaatcccatttcctcgcattcttgatcggaaagcctttctgacaggcagcttgctgcatggttaaggtcagactttggattggggaaactggagtttgaggttcagataagtctcttcctggctgtgtgactttgggcaaggatcttaacctctctgggcctcagttttcccagatagctataaggatgaaatgagagggtgtaccccgaacccttagtcgggggtctggcacccagtaaaccctccgtaatgctccctggtgtcccagccccaaacaccgccatcctctgtagcagtagtggaagggacaggatgacagatgacctctctaggcccatttcagacaggattcttcccctcaaggtccaataatgcgggtgcagatatgtctgcctcctcctccatccctctaaccctccaccccccggccccgacaccagcacacgattgagaaggaaactcaagcaaaatgaatcggttggccggcaggagcagctgttgatttatttctgggaagggcccggygtcccctggaacggtgacctctattaatgttgacatgttcaaagcctcatattgggatgcagcacgcctctcctgtccctttaaagagcccgctgttaagtttcaaagacccttgcagagcatgaggagtgtctgggagcacgattcctcaaggaggaatattccatcaaaygccgcgtgataaatggggacccgcgtggttgtagaccctcactttggacgcgagtggcccagcgcaggcgacttcactcgctgggataaaaggagattcattccaagctgagagcctgaacaaacagccggcgcctgtgtgtatttcggctgcccctgtcctttgctgcagctagtttcttggcctggccggagctggtttgggcttggagaaggtcagctcctcaccaggaatcagaagctctgtactaaggcgtctctgtgtgcccaagatgtgctgggtgctttgcataagctgtctcactgcatgcccgctctttttggccaggtgagagttattattcccattctccagaagaagatgaggcccagaagatttggggaacttgcctaaggtcacacaacctaataatcaggaagccaggaatttgactcctaaagaattttcttggctcgcgcctgcctgtaaatgccagcactttgggagaccgaggcaggtagatcgcctgaggtcaggagctctagaccagtctggccaacatagtgaaacctcatctctactaaaaatacaaaaaattagccgggcgtggtgatgcgcgattgtaatcacagctactcgagaggctgaggcaggagaatcgcttgaacctgggaggtggaggttgcagtgagccaagatcgcgccactgccctccagccagggcgacggagtgagactcagtctcaaaaacaaaacaaaaaacaacagaaaaagaattttctttgtcctacccagagtgttagcaccgattgaacccctaaagacaagaaccaaccatggcattttacagttggaaaactgaggcccagagagggaatgtgacctgctcaagatcacacagcaaattcggcaaagagaaattttctagtggtcaacagagaaacaaacggcagcctctgacccatagttggcacttactaggtttaagtttgtttccttccccctctccctccctcccaccaagggaaggaagggggtattacagtgaagagaactagaaaacccaggggttggagtgaatggcctgggtcacacagggagcctggactggaatcaggtggtgataaacctcccttctgtatccaggattcccttcaactctcaccgaaaggactgttgcccaagtgtcagctgcggaggtcgctttgtgagtcaaggatggctccctgctctgttggactcccagcagaggtcacaaagcttccagaaggatagactgggatcctggagaatctggggttgcttggggcctccctggagctctggataacacccttctcttccatgtcacccgctstcccacccaggccccactccagagagacggcctagaactgattcttcaaaagtacataagataacaccaggacccctgctctccccctggctcttgtcccactgcagaatggctgctaagccctggacacacccaccctyttttctgcctctggctctttttcatgttgttcccccagctggaacacctttccctctcccttcgtagcctaacaaagcccttcctcctcttttgggctcagcacagtggttgcctcctccaggaagccctccttgcctttagcctgggcttgtgtccctcccctgggttcctgcagcccctgggtttgcttctctcagcatagtaatcacccaggcagtaactccctatttcatctattttccaaacagggctgtgarcctcttgagggcagggcctgtcccccattccggtcagtgcmccagggcctggcactagtaggtgctctgtaaacagctgtcctgcagygatcggtgggacgtgggcatggctcggtgtgtgtgtgtctgggcaggggtctcacatgccagctgctcctgtgggaaaaggcctcggagtagtggtttggagtggctttctcacccccacgggtcccacagcccccgcttccctgagccccactgcaaggggtagcctatgagggctggccagagtcagggctcttcacaccctccgwgctcccaatcaatccctgttcctaatgtgccctaggattgctattcttccttggcctggcccagggctggatcgattcytctcttaaaggcacaggcctccctttacagccatcagcgggcattctgcagagaagtttatttacaaaaaaagtcttttgttttattcttgactcggatggtgccagttctcattcactgactgtggacagggagcaggtgctgggcttggtgcttgttatggattatctagtttaatctctaggtaaccatctgaaatgggggtattaggattcccttttcaggtggagacaccaggctcaggttggtgtggtaacttttccaaggctgcacagcccccgaggggcagagctgggactggaacccatttatctgatgctgggatccatatgcataatggagaatgaacccagcttgggtgaaactctgacagcagcccctccacccccactacgggtctggggatatccctgaagcccccagcaccctgctgcctgctgtactggggccgcctcagccccagtccctggtcctgggagcaggtccctcctttcccatccctccctcagcctcwtgcctgcttgattgcaattaaggatgagaaccattgaatagggctcgaatggtgaattaataaccttatctcrccccagccaaatctggggccattgcgcacctctggcccagggtggggagggcttctttatcaggctgcaggcagcgctcagattttccttctcagacaagatgaaacaattatctggtctgctggctgcttcccctccccacccccagctgctgctgcgagtgcccagccactacctggaaattccttaaagcccagggcttctgttgggaaatgcaccccgagctgcttgtgtgaagtctcagtgctggattggttccatgcaatgcattggtgcctgcctctgtcaccaagcagggagtgacggtgttcccctggaaatgatggtactttgtctagttcggggtggaggctgtgtcatggcaagggccacttttaggctatgagctcccacctgcaaggacaaggactggtgttggcctggcagggaagggtctcagtacctaatttgagaaagaaaagatggcgctccccttgatcctctttggctgttggctcattttcctcctagccatggtggagaggggggctctgtttctcgggggtaccctgagggctcttgcctcataggcagtagagaggtgaaactgctgttgccctacctaaagtctctgcctccttggctgactctagctggttcacttgctctgctgggagacccttgtcatggtaaagggacccagatttggctgtgatgctggagggagagagaaacagctgacccctgtgacatgggcccacatttcagatgctcaccacggaggtggctcaacacagctcaaagaatgtggaggcttggtcagacctcgtggcatcctggctctgctactcgaaagccagggtctctgggtgaggaatctgactgttcttagcctcaggttcctcctctgtgagctggggacactggcagtaaggagtaccaggcgattttgagaggcaaacgagtcaatctgtgtgagtgcctagaaccatgcctggcccagagtcagggttgtgtaagcatttgtggtcattcttctatttgatcttcatgtgagaaccctctgagaggtcatcagaaaactgaggattagagaggggaggaacttgtccagggccacatagctttgaagggagagctgggatttatttatttatgctagagacatggccttgctgtgttgcccaggctggtcttgaactcctggcctcaatcaatccttccctcctcggcctcccaaagtgttggrattacaggcatgagcaccgcatctgaccttagagagctgggatttaaatctctaaatccttccaccttattttgcggacaggggcccagggctctgggtctcccctctgtccctgactcatcatgtgacctcaggcaagttacttcacctctttaggcctctgttgctgcacctttaagatggtgatatcctctgctgaaagaaggcagaggattgattagatggaatggaatagactcgaaggggcctcagaatccatccaggctcattctgtccttttaacrctatggtcactaaagcatagagaaaaggagagagcttccagaattacacagcgtttgggatgcagccagggccagaagtttccagcatccagagcccgggtccaagaagtcacctctggtggccttccttgttgagacttcaggatcctccccacctggtgggtggtgtcacccacatcccagctgcaggttctgtggcttcttggctcagccctcttatgcctcttctgatgggtctggccagttacaaactgtgtccatctgtggcacaccttccaaaaaaacctgtggaggccgggtgtggtggctcactcctgtaatcccagcactttggaaggcagaggcgggcggatcataaggtcaagagatcragaccatcctggccaacatggtgaaaccgcgtctctactaaaaatacaaaaattacctgggcatggtggtgcatgcctgtagtcacaactacttgggacactgaggcaggagaatcgcttgaacccaggaggctaaggttgcagtgagccaagatctcgccactgcactccagcctggcgacagagtgagactctgtcaaaaaaaaaaaaaaaaaaaaaaaaaaaacctgkggaaactggccccatttggcaaatgagtggggaaracaggaagggatcccccaraaagtggaragaaacagccttgaaataaacgatgccctgccaracccaatattgaagggggattggatcccatcttgggagactgatgccccaaccctgttggtctcgtaatgttcctattggattactgataccccaraaagcgaatgccccaggaatactgatctttaaggattattgggacctcaagctctggaaattgtgattgtaggagcattaattgcccaagaacactgttatttaagaagtactgagtgcccatctcaggaaattgatcccctgcaagtattgattctactgtgctgttgataccccaggagctttgctttctactctccaggcyctcagcaacctgactttccctgagttcatttaggggcagcaggggtccctgtgagtgatttcttccaggagggaatttggaggaacattccagagcttggctctcacacttgagctgcatcacaatcagctagggggctttgtaaaacacagcctgctgggcccactcccagagtttcagatttagcaggtctggagtagaggccaagaatttacacttgtaacaagttccaaggtctgtgaggccacactgtgaagaccactgttctagaggtgagatgatgggttctcagccccagctgcacccgggcatcgtccatgaagctttgaaaactctgtcaggggccccagacctcactcctagaggttgacttaattggtctgggatggagcaggacatttaaaaggttctctgggtgattctggtgcagtcatgagctgggaatcagccaagtttggggtgaggtgagtgagcacctgtaccctgctaaaggttctgagatgggggaggcaaaagacacaccttgggcttagctcccagtggggaacccccagactcagggccaggcagcgcaggggcctccccttggagctactgaggtagcactgctagggggtccattcattcatctacctgcctgtattcagtagacatggcactgttctagaccatggggatgaatgaggcagacagagctccccaccatcaagcagttcatagcatcaatgtggctatggaccacactggaccacactcatggtccaaaggtgtcctggcacccaaggctccctttgttcatactcatgactgtcaaggtgatggaagctagatactgggacaggcagtggagtcagggctgggcaggggacagcgggtgggctctctgtataccctctggggagattctccaaaaccagccaagaaggggtttgactgtttcttgttggcagacgttggtcagtttctaggcacctcacggtcacccagtccaactcctgcctgcagcaaagatggcagcagcctcccctactcatgggcttgtctcctggtggtggtctaggagccccttctatcttaggtctctgccccattttgttccttctttggctgacagtctctctctctctctctctctttttttagagacagggtcttgctttgtcacccaggctggaatgcagtggcatgatcatggctcactgcagcctcaacttccctggctcaagggatcctcttgcctcagccccccaagtagctgggactacaggtgcataacagcatgtcaggctaattttttaaaaattttaatagagatgaggtctctctatgctgcccaggctggtcttgaactcgtgggctcaagcaattctcccacctcagcttcccaaagttctgggattataggcgtgagccaccgcgccaggtaagggttttttttttttttgtctccggtttttgaccccttccatctctgtttctcctttgtttgcctatctccacccctccagcacccagtcggaccactgacaccttaggacagttggatttttttctagctctgtctccttggacagcacctttcctggttggctctcttccctgcccacacccccttcctcttgataaacactttccaaacctcaagctccaagacccctttggcaactgcttgacctgtttccctcccactacctgtggatataagattccctccctggtgagggcacacggagcatcccgcctttcccctctccccaggcttgtgcaccagggggctactcaaggggcagagcccccaatgggcaggtttcaatcttggttgggtcaggaagcgaggtcctcaagcctggtcggggtggtggctgtggttcattctctgatcaatattaatttggtgacaggtattgactgcctgtggtgcttcaggcagagggagagagaaatagtcacagtccttaccctggtgagttaaaaggataatgcttaagatgccattcacccacccttctatccatttghcattcattcattcattcattcattcattcattcatgtatccattcatttattcggtaaatagcaagcacctactactgtataggagtaaacccgagacaatctctgccctcaaagtcaccccctagtggggaaaacagacaagcagacagacaactggggggctctgagtgcagagctctcagcagattccaggtctgggtggccagacctctttttgagcagacccagcagcgggctaggctcggacaatcgctgcagcccttggctctggcctggctcagggacaggtggggctgattggacacagctcagaagggtggtcctgggatgctactaagcctccctgagctagaaagggattgggggccacagaccagaacctgctatagagtgcgccccttaaaacctcaaggaggtcgtgcatgagaatgcaaaccggctgccggggaaaggggaggaaatccatttcccagcttggaaattattgaatatttaggagccggagcagatcatttagaggggaaatgaatttctccggtttcctctggccaagataaatcagcccggatgctcttgtactttcatttacccccacagaacaggtctggatgggtgtttatgcagcgctcaaataatcattcttccagaagtggtagcgattgcttccaaagccatcgactttctcttaatgctggtgtggtgacccgcttggtcagcccctgcctgtgcacatccctggggtgtggagcccaagaaggggaggagcagggctggctggtcataggtttgtccktagtgccattgccctccggatggttgaggtcttgcaggcttgacagggcactgagcaagctccaagccttaaccaataacagctagagacctaccaaagttggctaagggtctgagctgggaacaggaggattagggggtgcaggatttaagtcagatttaagaaagaacttcctgggcccggcttggtggctcaagtctgtaatcccagcactttgggaggcaggtggatcacctgaggtcaggagtttgggaccagcctgatcaacgtggtgaaacccagtctctactaaaaatayaaaaaattagctgggcatggtggtgcacacatgtaatcccagctacttgggaggctgaggcaggagaatcgcttgaacctgaaaggtagaggttscagtgaatgaagatcgcaccactgcactccagcctgggcaagaagagcaaaactctgtcacaaaaaaaaaaaaaaaaaaaaaaaaaaggaacttcacctgcagtagatggttgtggtattgctctccctgggtgagtggtcagagcagagaccctcttctacggggcatggaggcaggggatggactgaatggcttctgaatcctgaatgacccaggattctgtgatgtccaactaatcttcacaaagtgatgttttcctagaccaggkttctgcaaactttttctgtaagggaccaaacaagtaaattattttggctttggaggccatatgatttctgttacaactgcacaactcaactccactgctgtagtgccgaaggagccgtaggcaacgtgtgaatgagtggaagtggctgtgttccaatgaaacagggagtgagtggcctggatttggcccgcctgccatagtttgctggctttattccagagactgaaaactctttgggggtttcttagaggaatcaatgtttctggctcttgtctgtttttgaaacaactctctttcgctttcctgatgaaaaagtaacatttgcttatagcaaaacattaaaataatacagaaaggtagaagggggaagtcgttggtaatcttcccctgctcaaagttcacagtttaatgtctgtatgtatttttgccctaatattatgttctatttaaaggccatcttatacagaccgtatttacagaggctgttgtattttgagtcccaagtggactccggtttaaaaaggaaatctggagacggccgttgggaaatcaagtccagggtgataggaaatggacaaagtagacttctctttcctgggggtgttccctctgagggagctgcctgatgcctctgagggtggaggagggatgggtggaggagggatgggttgaggagaggcggggaggggagggggccgggcctgctcctgctcctgctcctgctgggagctcagaagctgctgggaacaacttgcaagaacccagccatggggcagggaccgcgagaccccaagatgcacatcccagtgggtcccggacagctgcaagatgaatcctgagccgcacagggctggtttttggctgccctgaggagctctcagcttgggcctctgggcttatctgtccacttctggaggggaggagaggctgtttccaagaggaccccttgaatgctgtgggaggctgctccttctcctcccccaccctccaccttgagcaaaaagacactgaagcatccgagccctgaaacagaggcccacatccccatgcactggcttatcttcagtctcagatccgcagaggaggacatattttttttccctaatggtgacaggatcaaggagaaaggaagaggacaaaaaggccacctgaaccagctgtccatctccacttcaaggcagagaggaggattggggggcaggaatggggaacatcgccccctgccaaggcgagacttttgcccacagtccccactgtggccatcacacaccttggccctcactcatttcyggcacttggcgttctaggatcacaggatcacactcaggtctgaccctcggctcctggggacagggaagggcccaagacacagtggttttctgtcagaggccgaacagcctgatggttctaggaacaggtttgggaatcactcaggtctgagttcaggttccagctttgtcacttcctcatcatgggccagtttggccccatttgaacctcagttttctcatccgtaaaatgggtataaagttagcaccctaaggatgacatgagatgcttcattgtgtaaagtgtctaccccagtgaaagatacaagagtgatttttcattccttcctgcatttctttgataaaatctaattggggacatcaataaaatcttgtactaaacctcaggctgataggaggctctggagaaaactgttttctgttgtttttgttctttagaatcttaagattctcaatgacaaagstgggctgcaagctccttgggcagaaaccctgaccagcacattcacggctgtatccctctctaatgcccagccaaggcctggcgcccagtaggtgctcataagcagttgtggaagaatgaaggtatcaaaagctgcagaaagaagggcttccccctgcagagagtggaagaggcagaaaggctgagcagtcaccttcccaccccccacccccggcaacccgagagctgatggcccagttttccatgcccctgtgttatgctacaaattagtttcaggtcggccagatccaatttggttcctaaggcttttttttttctctttaaagaggtgtaattaaaaaacaataacaacaatggaacagaagttcagctatcacagttgatttttcacagaggctggtgatggggaagctggagcagccctgtgtgattctggtagctgtgccaggcagggagcaggcgggtgtccctgcctccttgagcatgtgctgtcccaggagggacaccgaggccgggcatgtcttccccccgactggactgcggggcagacctcactggcctcacagccaagctaacctctctctttgtccctgtttgtcttctgcaaggctgagtctctggtcagctttctgcagtcttggcctgcactcctcaatctgtgacccaccgcagtctcctctcatgcaggaaggctgcccagccgccctgtcatgtcacagcggtgtggagctgggaggggccttggagcctgggctcctactcatcatgacagccaatgctcacagctagctgtgaatgcacacctactatgtgcctgcatctcctcctcctcctcatgacatgaggtaggtgatgtcatgtcccccttttatagataaaataactgaggcttagggaggtgaagtttcttgtccaaggataacagctaacaaggggctaagttggggaagactgtgccggacgccaccctgcggcaagttgaggacacaaaaccaggcaagtcaagctgttgatgtcaagcagttcagagaccttgaaccaggctggctggctagctggatggatagacagacagaaagccagatttggaggcacagagaaaaacaggtaatgaagccaggctgcacagtggatctctttgttctcaatttcatgggcgatgagtgaacaagtctcattggccctgatgctagcttgctgtgtgaacttggcgatccattgattctctctgaatgtaatgatgccatctgtgaaatgagggcttagataccacagctcctaaaatcccattgggcctcagtgttcactaattttctaaatctccaaactccacagttgtaagatccacattcatcctgtaaatccaagggagtggtgtgggcggtggtggatgacattttaattctgacttgctgaaattctctaagagcagcaattataagctggcagctgagaatgagacacaggtatcttttgtgtacatccacaaatagtatttatttcttcttaattagcagccagcatttaaaatcaggtgatttttcaactttctttggaaaactgaaaggttaggcaacatgggatcctgctcccagcacagtggcagagagcctaagctttgcattgagcttgataggttccaatcccagtgttgccgtttttagctgttagtcttccggggaagtgactcaaaccctttgtacctcagttttcttatctgtgaaatggagatgatacctgcctcactgaactaactttgggagaaacttagtttatagtttaaacaaagatggtaacagccctttcccaaagcagatctccttgcctggagactagattgcctttgtaggactcacattagccacaagattagaaattatggtttaggggtcatgcagctggaggttacaagattctgaccctccctaaactgctcctaagatcagggcttgagatattttgcagaacctgcacttgatggatcagctggcctcctatcaataaactggcccatctgatcttgtggcccccacccaggaactgactgagcacaagaagacagctctgactccctatgatttcatctctgaccagtcaacactcgtggctcactggcctcccccacccaacaagttatccttaaaaactttgcttcctgaatgcttggggagactgatttgagtaataataaaactccagtctcctgcaaaaaaaaaaaaaaaaaaaacaaacaaaaaaccaaaaacaaaaaacaaaaaaaacctgcctcataggttcgtttgttgagtaaattaatccatgtagagcctagaacacattgagggctgtgtacatgttaacttttgttactgttatttcccccgcagcagatactatggcagctagggctgccattactgttctggaggctggaagtgcaagatcaaggtgcaggcagggttggtttcttctgaggcctctctccctggcttgcagatggccaccttcttgctgtgccctcacatggccttttctctgtgtgtgggtcctcctggtgtctcttcctcttctcacaaggacaccagccacactggattagggtcccacccttaggacctcatttaaccttaatcacctcctatgaggctctctctgycaatgtagtcacattggggattagggcttcaacatatggatttggagggggacagggttcagcccataacaccacatggtagcaatcggcccaagactgagtagctgctgcccccacaggacaggatatatatatttttttctgttcatgacagtcccacttaggctgaccaacctttagggtttgcctgggactgagggggtgcctgggatggaactctctattttaaaaccaggcaaaccaagatgaattggttgctttctttttttytttttttgttgagaccaagttttactctgtcgcccaggctggagtgcagctgtgcgatcttggctcactgcaacctctgcctcccaggttcaagcgtttctcctgcctcagcttcccgagtaactgggattacaggcacatgccaccatgcgcaactaatttttgtatttttagtagatagggttttgccatgttggccaggctggtctcgaactcctgacctcaggtgatctacctgccttgacctcccaaagtgctggaattacaggcatgagccaccacacctgcttgaatttgtcgctttcatcctaacctcaacccatttccatcatttattttacctgcctggctcctgagttttgcctctgcctgggagtgaccactagacccaggaaggccggtggagatgggaacagatgtgctctcggtgcttccaggaactggcaagtgacttggccaagggagggagagtacacagccctggggacccttcaggaggccgggctactgagggttaaatctacctcgagaaacaacatctagcaaccaccaagggagggaaccagmaaaagcattatcatgattaatgttatttcaaagacttaatttttccccctctttcaggaatgcttgtctgcagttgcaccgagtgctatctcttgattctgcgtgtccttcccccagagtaatttgggacaaggtcactgttcaccaggcgcgcctccttacccccaatctacttgctggcaggcctgcaaggctgaggtgctgggacagcaggaggctgcatggttggggagccacacggggccagtcttgatgcgttcagggctgggcccaggatggctgcagcctcacctcacccaggggcaaacagaggctcagcccaacggagtggcgggggaggagtctggagtgaggacccaracccttattttggctctaccccttgtcggctggggaacttctccaagcctcagttttgtcatctgcaaaaggggggcaagaataacgcttccccttccagatgatgtaaatggcactgtgcacaccaatcaccagggcaggtggcgaggtggaggtaagatggactctggactctgaattttttttttcttttctttcttttttttttttgagatggagtcttgctctgttgcccagactggagtgcagtggcacgatctcggctcactgcaaattccacctcctgagttcacgccattcttctgcctcagcctcccgagtatctgggactacaggtgcctgccaccacgcccggctaatttttttgtattttttagtagagacrgggtttcaccgtgttagccaggatgggctcgatctcctgaccttgtgatccatccgcctcggtctcccaaattgctgggattacaggcgtgagccaccgcgcccggcctggactctgaatttctaacaagtgctcaggtgacagccatgctgctggtccatgggccacattttgaaaggcaaaggttgtgaagacaaaatgcaaggtaagttcttagcttgtaggaagtgctcaaagtacacactacttatcatcatcaccacatctgtcatcatcatcatcatcgtcaccatttcatcttcatctccatcactggcatcatcttctttatcatcgttactgccatcatcactggcttccttgtggttggcaacatcatcatcgccatttcatcttcatctccatcaccggcatcatcttctttatcatcatcaccaccatcatcatcactggcttccttgtgattggcatcgtcatcagctcttgtcttttgtttcccttcctcacattctccagaagaggtaaccaagacccagagatgtttgagacttgcacgaggcaattttatacagaagagaagttgcctaggattgaggactgaagcagacaagagcctggtggctggaagtcaggagactgagattcaggtcctagtgctgtacctggctcattcagcctttgaactttctaaatggaaaggccattaaagattatccagtctaayactagcatttgaggaacctgaggccagactggggatggggagacaatatacaatcaagggtatagatgtaggagctagacagtttgcattcaaatctctactccatcacttgctggttacacgaccttaggtaagtcccttcatctccctgagtctcagcgtcttcatctgtgaaactggatgtgctatccagcttccaagatggcctccaaagagtgtcattccctggtatttatagccttggtcaatctcctcccacattgtcccagggttgttctgtgtgacccatagaatatagcagaattgatgttagtatctttggaggtgaggttatgagagatgctgtgggttctgttttaggttmtctctctctctctggccattcactgtgggggaagtcagttccatgccctgagtccattcaggcagcttgtgaagaggcccacatggccaatagccagtgaggaactgaggcctgcagtgaccacttggatgagcttggaagcacgtcctccagccccagtcaagtcttgaggtgagaccacagtcctggccaacaggtgactacaacatcacgggaaacccaragccattcagctaagccactctcagattgctgatccccagaagctgcatgagataataaatgtttgttgttttaagctgctaagttttggagtaattgactacacagtaatggataaataacatgtggggataactatcttgtaggtttgttgtgaggattaaattcacgtaagcactttgtatagtacacgatgtatgttgaaggctgtgtgaaatgtaagaaaacaatggcagcatagaaaatatcgtcgatgaaccccagggtcatgtagccagggtgtgacagggctgatgatgctgcagttcctagctgcccggttttaaccatttgtgccccctaatccttattgattgtggtgggcaccacaggctttgccagaaatggaacaacagtgtcagagggtggggagcagaagaggaagtgatggtgccagtcagtgggcccctggggtggggagcagccccagggtactgggggtggaagactgaggcacaggactggagtgagtgtgtgtgtgtgtgcgtgtgtgtgtgtgtgtgtgtataggtcacctctggagacccttccagcccaagactggctgatgatctgatttgctgcttgtttctggccctggtctgtgtggaagactcagaaaaaccatggcaaccacgggataattaatgatcagggatggaggaggccaggaacctggtgtccccgaggccacgtggagagcagcttgggaggaaggtccactgggctttctctccgtgaccatgtgggcttccttggaagagagatatcagagagggtccaggtgggagataagcccctgggcctgtagccctaacagtccaggaagcacaggcctctctgggcccagtagatggttcctttggggtcgttggctcccaggccctggactgctgaaattaatgcattgttttcaggaggccgtccatggcttccaccaggttctcagatgggtctgggacccaaaccatggagactgtctagatattacccattgtaaagacatggaaatggaggcacagagaggttaagagacctgtccaggccatacagcaggctgtggcaaagtcaggcctggaatccaggcctccttgctgaacactctcccagggtaggacccacagtgggtggaccagaatgtgctgtgcatgtgggcccccctggctggcagaactcccgtcaggacagctgggtcactcctgccccctccctgggccagatgggcagccctctcctctgctattttctccacctttgccttttcacagggagtgactggggtggaaaattctaggggagcacaaagtctgccaagtttaaacctggcaccaacccaggcacctggctgccaggcacttggaaatagaactggtaaaggggtccctgggggactgggctgctgggagcagcttggcaactgcctctcctggctccttccagaccttctatcccaggaatattccctcctcgctagaacctgctgccatgtgccaggaacatctggaagagagttttctggcaggtctgggggtacagaaatgggttacagggggcttggtcatgtattatatcacaaacatctaccgtgataagcgaaccagtgtgcgtctgcagcgcctgctgcaagggactgagcgaggcccccgcacatccttcatttccctttgaatcactcctgtgatatggggttccccattttacagatgaagaaactgaggcttgggaactccagaggactgcccaagttcacctagcttttcagtggcagtgctgagacttgaatccaatctgtgtgactccaaagcctgcctttttccatggtctctccctgtgccctctacacccaccatgtccaggtaccagtctagatgctagggatatagagataaacgagccatgagccttgcccttaaagcacctgtagtttagtgagtgtattagctattgctgctatgctaatgccccataacaagcagcccccagctcccacatctcagttgcttgcaaccacaagcagttatccttcttgttcccagctggctgggtcggctggggtggttctgcttcaggctgcaggttggccaggttggcttcacctgtctctcattctccttgcaccagtgaaaaagaaaaatactcaggtcctgttttcatgactgggaaggaacacacaatgtctcctaagggttcatcttagaactggggtactgtcatgctgcccacatatggagacaggttacacgggcaaggcctacatcatcagtgtggtggggaaatacactttgcctcctctgatgtgaggcactgcaaaatcacatagcaaaagcaaggatgcctaattctctaacagggaggcaggaagaataggtcacaataatccaatcacccacagtgtggacgagagacttatgataataatattgtactgcattctatcaaacctaagctgcaagacacaccattaatttatgtaccactaagaaagaaaagtggctgtgaacgaaagtatggcatgatgctttcttagcccatcatatttttattttattcttactgaaagagctatttgatgctgaggcatggaagtgtcaacaatgggaacagttggaaccaggtttgctcttgcagagacaatgacgactgtcacaactgtcactgtccaaggagattatgagatgccatcgattgtaaaacacattttgacttcaaggatgtgaaaatgtgaaaatgtgtgtcttagaacggatgaaatttgtcatttactgagagtaagtggttgttctagggtggacattgtggctaaaatttctatgtggacaggctcatttgtacctcaagacaacccaagaggaaaatattattatccccatttcaaagatgagtagggcaagattcagagtgatcatgaggtgggaggcaggacttgactcctgatgtggggcttggacaccggaccaaatggcggactagctaaaatagagggggcaaagcagctttctataagacacatccaccagtaggccatgtcagtttaccattgccatggcaacatgcaggagttaccacccctttccatggcaatgacctgacaacccaaaagttaccaccctttccctagcaattgctgtataaaccactgcttaatctccatgtaattaaacatgggtataaatacgactgtgaggctgccctgagctgctgttctgcctatggggtagccctgctctgcaggagcagtcaaagactggagctttatcactggcccttcaataaagctctgctttcttctacactttcttctcgcccttgaatttttgcctggaggaagccaagaaccctcatgggctaagctctgttttggggcctgcctgccctgcatcagtcagttgtcctgcccaagactcatggttagtaagtggaagagctgagatttgcacctaggatggtctgacttccaagacaaagtgataaagagtgtgggccctaggacaaactatacttcagtttcttcatctgtaaaatggggatgataggagtaactaccgcatagattattgtcctatgagagtttgaaaagagtgtcaggcacagagcactcaagacatgctgggttctctggtagaagcagagatttttgcctctctgaagctaacattagtgtaataaaagctgcaaccggactaagaggagaggactatgggagcccagaaaagcaggccaatagcttagtaatttgggggaaccatcagaaatttgctgtgagggagcaaaaagaatgtgtgattcatgtgtgcacttatttattcaacaatatttgtttacccactgtattagtctgttctcatgctgctaataaagacatactcaaatctgggtaatttataaaggaaagaggtttaatggattcacagttccacttggctggggaggcctcacaatcaaggtggaaggcaaaggaggggcaaagtcacgtcttacgtggcggcaggcaaaaagcttgtgcaggggaactcccgtttataaaaccatcagatctcgtaagacttattcactatcatgagaacagtatggggcaaacagcccccatgattcaatgatctccacctggccccacccttgacacgtggggattattaaaatacaaggtgagatttgggtgaggacacaaagccaaaccatatcacccactgtgtacaggtagtacacagtgactggatttgaaaccaagtttgggggctaatttttaaaaattgaggtataatttatctacaatgcaacacacagatcttagtgttcagtatgatgaatttttacaaatgtatacagcaccccaattgcaatagagagtatttccattgccctagaaaattccattgtgccctcttccagctaaatacacccatctccacctgtttttttttttttaatttctgtcactgtaggttgctttgcctgttcttgaacttctgtgaacaaatgtgaacctgaaagggccagaccttcaagatggatcctgagtggctaagtgggctaggctccgctgttcttgcttgtaatcccatcactttggtaggccagggtgggcggatcacttgagcccctgagtttacgaccagactgggcaacataccaagaccctgttctctacaaaataaataaatactacccccccccccaaataagaatgggtaagtgggcctaaatttaaaatagaatgaagcagccacttgctgactatggttacacaactaccctgacttccccagaaaacctgcacctttttatctttggtactttctcagctcacctgaaccaaccaatcagggctcaagtgtataaaccaatcagggtttggctgtatcaaccaatgagagctcagctatattgaccaatcagaactaagcaagtttcaatccttcatttgcacatcttgatctgattgggaacctgggcaggaacttttgcgcaaaacttgatgcttccctcattcttgggaactccccttcattttccagtggagggtgcatctccaagtttgcaaactgttttctgtactaaagtctctttcctctaaatttcttttcagagaattttgtgcataatgtaaatggaaacttacagattgtgctgctttgcgtctggtttcttttactcagcataatacgtatatgattaatgcatttgttttatgtatcagtagttattttctttttcactgctgatatttcattgttgctggttgtcaaattattgcctctccgctccacattcacccttcttgcctgcttggtaaaaatggatctgggccctttaaattttctccctggccagcaggcatgctgggctttgccagtagagggcgctggggagccccagcagcggggaggttccgcttcctgcttgccacgtgctcacagagtaggctgcggcaccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtacgttctaaaagttgaatttctaactttggctggttgtggcccctgactgtttttttttttttttttgtccttcctgtggcacagccatgccctcttaagcaaggcctggctgtcagcccccaagggtttgtgtgtggggcacttctttgtggggttggggagtgacaggctctacctcagaccaagggcttttccttagggacttgatttcagcttttggaggagactcttccatagcggctgtacctcagccacatgtgtgggactgggggcccttccttgggggcccaagcttagccccttgtgggggcaccgcctggagggggttatctcagcctggtggagggtcccttccctggggtgaggggctctttctggaggtctctatctcagcctgatatgggggtctctttttggggctctatttcagtcctggggtggggggctgttccttgggggctccacgtcagcc

SEQ ID NO: 12534 - DNA, 14175 bp, Homo sapiens
ataattttgtttttcttcgagggttgatggcaggtcatgagatttgagagacacacacagtagtcaactgtatggaaaatactgaggaagtgtgttttcggattacaaaactaaactgggatcaacttggactttttcagtcaagctgttagaatgtgtgtctaaagttggcctgcttatcatgtgttataatataatattggtttggtcagaccctctgatttgtcaaatccttgccaaaaatgggtcccatagaaggcaacctgggattagaatgcttttcaatgtaaagtctcaggtttccagggtaaaccatcttcacttagcagaactaattcctttaacaagcatttgttgattccaactgtgtgtcgggtactgtgctagcctggagcagcaaagaaggataaaaagaaccttgttttagaggagctattaagtcagattctgtccccaaactgaacagctacacaaagaggtgatttctgtttgaggggtttgtgtgatcatctaacaacaaaggagctgggaaccaagaaagttgggtcaataataacaatgactacattaatccagtatcatgccaggttctattctaagcaatttacatgtattacttaagtatttgtttacatttgcggaagttttccttgtcccgggcccattcaatgtgttatttttatctctacgtttagaaactttgaccttttttgttttgtggcttgtcccttatttgatttaaaaagtcattatatggccaggcgtggtggctcacgcctgtaatcccagcactttgggaggccaaggtgggcagatcacctgaggtcagtagtccaagaccagcctgaccagcaaggagaaactcccatctctactaaaatacaaaattagccgggtgtggtgatgcatgcctgtaatcccagctactccagaggctgaggcaggagaatcgctttaaccctgaggcggaggttgcagtgagctgagattccgccattgcactccagcctgggcaacaaaagtgaaactccatctcaaaaaaaaaaaaaaaaaagtcattataatcacctagtagctttagatatgactctatatataatgtatagaacagagaagagttgtttgctccataaacatgtacaattatttgtcaaaagagaaatacaagttattcatattagtattcacagtcttccctttagtttctcaccgactcagtgtatctaccaagattcccttggtaatatctgtccctcaggtagtctgcttgcccagtggtaagtctttctagggtggaaggattctttcttactgggtcttcttccaggactctacttctttctaataggctgaatggagcgaaaatgtaaaaatagggaagacacgctgaatcttcttaataaagaatttttaagataaaggggaaaggggagaatgcaaatttgaaactggttttgaaggttgggagtggggtaggttggtgaatgagagacccttgagcaactatattatatgagagaattgattaagagataaaaagtgtgttacgattttgatttcttctcgtatccattgaggaaagcatgtaaagactggaattactgttttttcacttttgattgttggactttctacccaggacagccacttagattgctggggtttattcaggttatacataccatgcctctctattttaactggctttttgtccctttccttgctcagcagtttttctgcaagtagctgataaatcaggaattcttaaattcttttaaagggtttttcctgaaagataagtttttttagagaagtagagtgggcctagggaataataccaaccttagatgtggaacctctaggggctggtcaaatgtatttggcacacttactctttactatgtcatcaacaagacttggatgtctttcctatttactgcctttgtcgttggagctacgattcacatctgttccagaggtcatggaaactcttcatctctcagcatttctagtgggtatccttggcaggcttaaagcagagtcaggagggtgagagctcagagagaggctaaggtgaaagcactttgtaaacttatagaggatggtattttgtacaaagcctggcacacagcagacattcagtaaaaatgcatagaattaaaagaaaaggaaaaaaagcagataccttttactcatagcagtaatctctcttctgctccccctaccttggtcaggataagagtgccttgtgacatggattaacaccatacgagtaatagtttatattatttaatctcatttcttaaactagccctacaaaatatagtatgattttgattttatgtttatgggaatgaaggttttagagggtctatgtcacttgcccaaatattacccttgtaataagagatggaactgggattggaatgtaaatgtgtctagcttcaaaaccttttatttattttttttctacctttctggccggtacagctgtcagactatgtttagaagtctcatgggtccttcaagtgactttactaatggtcttatgaaaagctgtctcccctgagaattggtgtttgacgttcttggttcattcagcaaatgtgtgcttagccccagctataagcatgaactgtactagacagcaaaggtggacaccaaagaaataatcccatcctcatggagctgccagtgtagtgagtgatcataaatataaacaatgttgggcagagtgatgttagcagtataacgtgaggttgtcctggaggaacacggaagagggattgaatgagggaaggaaaagaatcagcccctcttatgtaagaggcagcactatgtctgccagagcctaacatctcttttagccaccttagctcatttaatcttcactataaccatgtaatatcctgattatacagatcagcaacctacttggcgtttcacaacaaggagcagatggataggattttcaatctcagaactgtctggctgcaagtccctgcccttttcattagactactgagtatagactaagtataggtttttcctaatgtatgttttttaaatacatgatagttaaagttctattctgtatacaagggtatgcgttgtgtgagactcagtgtgtctatcgagatgcccttggttctgtctgcacctcaggcagtctgcttgctcagtggtgagtcttcagatgttgctgcttttgccacgttttctaacagtgctggctgtctcatcttccctctgtgagggtggggctctggtttggtctctgttaagtccattgtggagagaactacagcaactcatgtgcctaagccccatttggccagaccctggcctctcctaccactttcaagttcaaacgtggggtgtgttcttccccagtgactgtccagagtggctgggtaaacacagcctggaagtagggagtgagggcagttgacatcactgaccagagcagttggaagctggagaagggaaggagccagcagacaaattgcttcgtgtctgcctgcctttctcctccatttaccccttacacacacacacacacacacatacacacacacacgcacacacacatacaatattagtagttccatacaacccatcctgtaaccttctaaatgagcagttgtctgtgttttcatgctaagccgtagcgggtttgttgatgcatatagccttggtttcctttccctcctattctttcctaccagtctttccccactctctgctctgagattgcaacacatgataaacaggtaagctttgctccagactgttttctagaacctgggcacaatagtagtcaataaaaaacatcttgcccatcacagacccttgccctgtttgccctgttttataccttgttatttttcacttagcataaatcaggtaatatttgaatactaccatatgattaatgtgcaccaaaatcctgtgagataaaataaaccatgagtgtagttccgtatttgcatatataggtcaattgtattttcttttctttttttttttttttttgagacggagtctcgctctgtcgcccaggctggagtgcagtggcgggatctcagctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagtattttcttttttaaaggaaagattattgcttttgttaaaatggtacatgttcgttataaatcaagaaatgctaaaacaaacaaacaaaaaaccccacgccagatgccatcatctggtgataacctttaggtgaataacgttctgggggcgctcatgaagctcagcttttctcattatctttatagtagtgtccgagtatactactgtaatttaaccaacctgaccagttgataagcagttacagtattttatttacttaaaaaatgtgctgaaatgaccatccttataaatgcctttggattttttaaacttgttggtatgtaagatatatttctccccctgaaaatttttattcagatactaccttgtgaccaacacacctgttttgcagatgaaagactctgggccaaagcaaaactaatagcaagataatctgcccttaggcgactcttctaatgagaaagaatgggaacacaaaacactgtataagggatgcaagtttcacatcccagattttggtaaccaaaagaaaccataggccacacagctgatcagaggtatatttgagctattccattacattttagattttaactttgctacagtaagtcatggctcaaatacagtagaggcactgattgatcattaagtttatatacactgtaaactaacccagttaaaaggcaacagcaccatattttgaagacagggtgaccaagtttctaatgcaatgattgccattgattaatacaatgaactggagaccagcagggatgataaattttcctggcattgagaattacttatctgactttttttttttttttttttgagacagggtctctgtcactctgtcacccaggctggagtgcagtggtacaatcattgctcactgcagccttgacctcctgggctcaagtgatcctcccacctcagcctcctgagtagctgggactacaggcacatgccaccatgcccgtaaatataaatttatttaataagtaaatttattaattttaaacaaattaaaaaattttttaatttttaaaaaatttgtttgtagcgatggggtctcgctgtgtttcccaggctggtctcaaactcctagcctcaagcaattctcccacctcagcctcccaaagtgctggggttataggcatgagccgccatgcctggacttatctgactttaaagatgcttttctggggtctgaagttgaagatttaaacctatagagtttatttttgctgtcttgtcttttttttttcagtttgttaacatgctgtgtagttctgttacaaacatatgtagtgaaagaccagcttttattagggttaattgttccttttctcatttggtatgcactagtatttagtgaaattcttccttcgtgtagtatgctttgtttctatttttattaaaacatttgtttgtattgtgactatttgtgtagtaatttatatatttaatttgtagcttgcttttcagccatcagtactgtatttcagtgacttctgcacaaacgtgatttaactataggaaatttttttgtccaggataatttacataaagtccctcacttgagaatttcaggtgacagaagtttactatatttctaaatagcaagcctattatagagtagatcagaattaatcatattcatgaacagtattaatctgttgaataatcaaaccatcaaggcagatgcattggttgagttgctgttcatggacttcctggttgaacaaaatggtcttgccattcttagcaaagaaatacctcagcatgtggcaactcatggatgtggccagtaagtgctgtgagaagtgaacaaagaatagaaaattaagcactgacrgccgggcgcagtggctcacgcctgtaatcccagcactttgggaggccraggcgggcggatcacgaggtcaggagatygagaccatcttggctaacacggtgaaaccccgtctctactaaaaatacaaaaaattagccgggcgcagtggcgggtgccggtagtcccagctactcsggaggctgakgcaggagaatggcgtgaatccgggaggcggagcttgcagtgagcagagatagcgccactgcctggggggaagagcaagactccgtctcaaaaaaaaaaaaaaaaaaaaagaaaaagaaaattaagcactgacatattctgagatgttttctgaaggagctcaggctaaatgctctcacctccttaatactggctgagaggctggatcttctgcctgcagcccagtagcacttggtttataacactatatgaagtgactgcatctctaagccaaaaatcatgatacatgttctaagacagattatagactggtatctttagcctgaattccatctataaagtgttttgcttggcctgcagtgttttaaacacttttaattagtcgtagattgttaaaagctgagatctcttacataaaatccgtaaaatgtccagcttccagatctgggaacactgggcccaaatttctgcctagcagcaattagctggaactgggtggtagctttccatttaagccaaagcatatgctttctagtctgctgtatcacatgcacgcacrcacacatacatgcacacaccagtcactcatatatgtacctacctgaccctttacacttccagaccatatgcccttcgaaggcaggatttttgtctgttttgttcattgcttttttctcatgaccagaatgttgtctggcacaaagtaggttaaaggatattgctagatggaggaagaatgtatttgtgactcttggtccaagttgatgggggaaaagaaaacagaagttttcaatttggagctcctccagatatttgagctatgttcccctttacccctgagatactgtatggctcaggaatataccttagtatcataattttgtatatgacttatctcccttgctagatggtaaattcattgggttcagggacctgtcttgtatttttttgcatccttaagaataccttgcacataatggaagcttaaatactccttggatggttagtgggtttttaaaatttctcatgtaactttgtgaataaagatggggagattctaatgaatatgttgttctggaggatcatttgagaagcaaccatttgagttgcttctccactatattttctccaagccctatccccaattacattctattcgccatcatagtctggatggggaatagaatgtaattggggatagggcttggagaaaatatagtgaatatagaaggtttttgataatccttaacccctgctctttggtagcagggtaaattaaccccccatcctcactttgtgcatattctattttagtactcatctttttttttttttttttttttttttgagatggagtcttgctctgtcgcccagcctggaatacagtggtgtgatctcagtttactgcaacctccacctcctgggttcaagcaattctcctgcctcagcctcccaagtagctgggactacagacatgcaccactgtacctggctaatttttgtatttttagtagagacggaaatctaatttcgccatgttggccaggctggccttgaactcctgacctcaggtgatccacctgcctcggcctcccaaagtgctgggattacaggcgtgagccactgtgcccagcctattttagtactcatcatattatgttaaagagcttgtctcctacactggactgtgatttccctatcattaagaactcggtatggtttttgtgcatctaacagctaatacttgataatgtttgtgtgccaactctgtataaacactattctaggaactcagtaaatgtttgcattgaattgagtttgtgttaggagttgtattagaactctacaccaccttatagtttataaaacatatgtatattcattgtcttatttaattttgaaatcaactgagtgctgcaaatgagaaaaatcaaagcccagagaaaactgtaactggtccataattacacagcagttaatggctgaacatccaggctgaactttgccagttagtggctgaatattcacgaaattctgatgcctccatagagcgggatagaattatggaggacttgtcattctggactgcggaatttggacctgtgtattgaaacaagaagagaaagggaagtgtttcttaagttatttttggatgaaggctttttgcgatccaaggcttcatcccctcaagctcaacaatagcattccttgggggagtgagaagatgatgaatggtcatcagtttgcttgcctcacccagattccattcctacctcccagaattttccctggtcccacccagctccacagtaacaatcaatcccaatcagtgactgtacttcattttttggatcaaggaatacccctcccttttctgtcttcctccttagggctttggataggagccctttaattgatgttgactaaactggaggccagcccctgcataccaggaatgccagtggctttgttagttgaggagggcgctgcattagcactgccctctaaatcccagagcaggtggaggaaatctaattagcatttagtaagccaaggtgccctggggagtttctgataaagaaaaggtcactgcagaaggagaagggacactgatagggagacttcattttcctagtgggaactttctgaaatggactggcaatcaggtgagctggattctaatgcctgccttactggtggctttttaatcacacttaagtccctctgcttatctgagatttcattttcttgtctgtgtctagtccgttaccagactccttttcctacacaaatatttgtttcataacagtggaagggacctcagatcattaagttgctatcaccttggggtgacaggtacactaaaatctcagaagtcaccactaaagatcttattcatgtaaccaaataacacctgttccccaaaaccctgttgaaataaaaaaaatgactgcagccattcccacccttgtatttcaagcatagcattgccacctacttgcaaaatactatatagacgtatatatatatatttttaaaaaggtgctattacctgggaagcttttcccaacattacatatgtccaaatctcactctgtatctactgaatcttctgatatcagtagatatgtagtaaatatgtatagtttggggaaaatttctcaggaaagtttgataaaatccctggtttatgcttttttgaagaacttaaacacatatagcaaactcaaggcctatcacagcatttgctatcatagttgttagtaatatgtttggagaggaatttggggggatggctattaagtgagaagctagaggtagaataaccactgcaagcaataagcattttacaaaatggggattgagctctattcgtaggtgatgaaatcaatggtaatgagttgctaccagtattttcaaagtaaaatagtatacaaaaagtagcatgtattgtgtccagttaaggatatttattgaaacttttaagttcattgtatttatagatactgtgctacaatttaaaagacatttcttactgaatttttgtcaaaatccattgacctagataggaatctgtattggagtaaagatggttctaaggggaaggagtgtagagaagcaatgtgggagccacatgcggtggttcatgcctatattctcagtactttgggaggcggaggtgggaggatagcttgaggccaggaattccagaagcaatgtggaaaggacactagggaatgtaggttctagtctttatccaagctctttgacttcaagcaaatcacatttttctcctggaccttacattcttttttctcattgcccttagtaccttctgtctgacttcaaccccacatctgcttgacaagaattaactcaaatatctcttcttaacacctacctgattctggcatacagtaagtgcttataaatatatgttaaatgggtgagaacctttcccttaggtctgtgggtactttcactgggcttgtatatctaccactccatttaaaactctacttacagctttttaagaaaatgtatttctaagccaggcacagtggctcatgcctacatttccagcagtttgggaggctgaggtgggtggattttgtgcttggaaattcgagaccagtctaggcaacgtggcaaaaccccatctctacaaaaaatacaaaaattagcagggtcatagtagtgcgtgcctatagtcccaactacttgggaggctgaagtgagaggattgcctaagcctgggaggtgaagactgcagtgagctgtgggtgtcccactgcacttcagccttggcaacaaagtgagaccctgtctcaaaaaaaaaaaaaaaagaaaatatatttctatttatcttttactaggttgtggtcccctggaaagcagacatttttattcatctgtgtattctcagtacttaacacagtacctggtatgtaataggtgcttcatagatgttggagagaatacatatttttaagaggagtattttagtagatgactcataaaacatttattgagcacctactatataccaggcagtgtggtaggtatgggaagtgatacaaatgtgtgtaagagaccaacatcttcccttgaggaatttagagattaattgaagcataagcacacagaattgctgacaaagccattagtgttagtctctagctatgtggttgcttatgcagctcatgtgtaacttctcatttctgtgtttgaatactggtcaccagaaccagacaggaagaatgtctttccgttctgattaattttcttaggaattaagtaagaaattgtgtatctgatatggtgatctagttccaaggaaggttaacttgagttggcaaaaggagcctcatcttttttatattagttactgggaggttgtttaaaaatctcccattatgtaatggacttgtcactttctacttatagtaatggcaattcttgctttatatatttcgaggccatattactaggtacacatactttttagaagtacatgacttctgggcctttgaacctcttatctttgtgaagtgcctgaccctctttgcctttttaccttaatatctttttttgcttggtagtcatatacctgcagcagcattcttttgagtaatgtatatgctttatgtaattttttccatcctttgatttcaacctacctgtgctcttgtattttaggtgtatctttaaaaaacagtatgtagctagattatgtttttgtttagtctggaaagtctttcttttaacttgagaatttagttaattcacatttattgtggttaatacagtgagacaggctttatcttttaaatggtgaattaaattgatttacatttattgtgattatggaaatgttttgatttgttgcaaccgtgtagtgttgtaccttaccttacactgaaattttctgttgttttttttaatcttaccttttggattgaacattttgtttcctttttctaatttcctttttatccctctgcttatttggaagttacactctaactacttcattagaagttactctaggtattttattatgcatacttattaaaatgtttaaatttaatagataatacatgcacatggcttaaacacaaaatatttgaaaagtatactgtgagaagtctcttctctatccttctgccaccatctgctcatttctaataacctggtgtatttatctttataatgtatgttggcctgttaacatattagatatgttagaatatatctaatagagattataaatacgcatacaaatacgtattaactcctccatttatacaaataaaggacaactttctctatacttgctttttttttttttacttcataatatatcttgatgctctttccatattgatacatgaacagttttcttccccatgcctttttaaaaagcagctgagtggtagtacatcaattggtgaaggcataactaagtctttactgatgagcatttacattgttttcaatattactcttttaaatagatcccaaaatgcacatatgtcattgtgcacatgttagtttatctctaggataagtttctggcattgcctggttaaaggatatatactcttacacttttggtagattatatgtaattttgccacattgctctccagagggtttgtaactatttacactcctgcctctttttccacagtcttgccaagatgattaccaaagttctgtatgtttgccagtctaatgagagaaaagtaatatttaagtgtatttttaatttgtattccttttgtaagtcaacattgatcttttcacatgtttaaaaatcatttatagttatttgtctgtgaacatttgcttatttttctgcagggttaatgttcttactgatttgtaggagctctttatgtaggagattagccctttgtaataggaattgtgaattttagcgaaatatttatgacttctaacccaagttaccatttttttccttgctttgtccataggcatttgtgtgggtgtgggggggtgtgtccgtgttgccatgcaggatttgaaaatagttttcatttttagatttataggtttctgtgtagtcactataacaatcattgttatggtttctggattttaggtaatagactttccctcttataggctataaaagaaatgtactatgttttataatttcattttatattacatttaaatctgatccagttggaatttttcctgatctatgcttagaggtacaggttcaactttgtttcagctttatttttaacagtgtcattaaatctttcccatggatttgaggtgctacttctatcataatctaagcattttatgcattagtaaccatttgtgaactcactaagtattaaattccattagtctgtatacttataaaatatatatagcaatacgctttgttttgattaatgaggtgtgttttaccatatggttgtaatagtgtcctctgctattcttgtttttctttatgaactttacaattgtattctcttatttagaacaaatatggtgggttttttgttgttgttgttgttgttgtttttctttgagacgaagttttgctctgttgcccaggttggactgcagtgacaagatcttggctcactgcaactgccgcctcctaagttcaagcgattctccagcctcagcctcctgagtagctgggattaacagggacatgctaccacccccagctaatttttgtatttttagtacagacaggttttcgccatgttggccaggctggtctcaaactcctgacctcaggcgatccacctgcctcagcctcccaaagtgctgtgattacaggcatgagccaccacacctggccaaaaaaatggtgtttttactgagtttatgttaaattaataaattcatttagggagatttgagctctttatcagcacatacattttaattttttaatttggcctaaagtatagcagtatatttactctctgtattagtttcttttttctttcctcctcctcttcttctttttttttttttttaaatacagaaacagggcttcgtcatattgtccaggctggtctcaagtactgtgccagctttggcctcccaaaatgctaggatcacaggcttgagctatcatgccaggcccttagtagtttcttgtagttgctgtaacaaatgactacaaatttgttggcttaagacaatagagatttatcgtcttacagttcaggagagaataaatccaggtgttacagcgctgtgttccttctgaaagcactggggaaaatcttttgcctcttttggcttccggtg

SEQ ID NO: 12535 - DNA, 16869 bp, Homo sapiens
tttttgaactctgcaaaagtacatctttttgagtccggccaacctctgcagtgttgatgtctgactgtgacagggacaagtgactgcagggacctgagaagggctacagcctggatcgcagctctggccatgctttgccctttctgggagtgatcacttgcctcagtgtcaggtgctactggacacccatctgggcagctgtgcagtggctggtagcccacctcctaccccctcctcgacaagctgtcccaacttttccagaaggcatatcccatgaactaccacagcctctggatacacaaggggaggttgaggggaaggtgtttcctgaggtaaagaaggactgtttgggtttggctgatgtgcaagtgttcctgctgtgtttagagttcagcctggccccttccagcctccgtgtgggtgaattagcagagctgcgtgccactgggactgaagtcttagttcagtgtaggtcagtggctctcacaccctgcagcggacaagctggggaacattcctgtgggttccatcaccccatcagtgtgatgcctaaacccgcagggaccctgggccacacactccctccggcatgggcattgccagccacctccagcaggctgcactggctggcccctgcacacccacttcctcagccagtcctgggaggtgtgtgcagatgcatgggctctcagtgagggccactctctcgcacacatgtacgacctggaggtcccagccagctcatgccctggggtccatgtctctgtgttgagcagcagcggccaagttcttctccagcagctgcgtcccctgtgaggacatgaagaatttccctcgcctgtgtcaactgtgtgcagggaaagggacagacaagtgtgcctgctcctcccaagaatcgtactttggctacgcgggagccttaagtgagtgagaccccactgctcctcctcctcagcctgatgttggggagacaaaggcacagagagcgaacagggcccaccccaggccacctagagcatcagtgagaaatctggggtcccaggtgcctcccatggccaagccttgctcctaaccatccacagagcactcttctgtgtgggagccctggcctccccagagcttggggtttgcccatgttaccctcctagacaagggaatgctagggagacagactcatgtctaggactctgagatctacagacacaggtctgggcttttggcagggccaaaggtcaggacctcccagctcacaactttctgctgagctgcttcttgtgcgtacctcgccccatctccctctcagcccccttgcaggcacttctgcacactccatgctccataagagaaatagctactactccaaggctatccaaagttattagtctccatgtaaaggctttaagcctttagttttatttatttatttatttatttatttatttatttattattattattttcatttaaacctgttgcttttggctgctttctaagaggaaaatgaggatccttctttcccatcctgcctcctcagagttgtctggtttggtgactgccagggctcctggctgcttttggcctgggcttcgctgtggggttcaaaggcccttcagacaaagccgtcacctctgtgaggaaagactgatactcaggaactctgggcaaagccctgttagccagcagtccgggctgaccctcagaggggctgcatgggggagaagtgaggcctgtgcctgactgtggctctcctgtcatgtgtctgaaggatggtgtggaccccaccctagccagaggagctggttctttttttttttttttttttttgagatggagtctccctctgtcaccaggctggagtgcagtggcatgatctcggcttactgcaacctccgcctcctgggttcaagcgattctcctgccttagcctcccgagtagctgggactacaggcacatgccactacacccagctaatttttgtatttttagcagagagagggtttcaccatgttgcccagaatggtcttgatctcttgacctcgtgatccacccacttttgtctcccaaagtgctgggattacaggcgtgagccaccatctctagatataagttgccttatatctgatagaaatttaatttgttataagacccagaatctggaaactcaagttgccttatatctagagatgggtgaagctcattaatgccacaggagagtttctatgtaagcatttcttttacagtaattcccccttatccacagtatcactttaacacagttggacttgtggccaaccaaggtgcaaaaatattacatcactactcttgcaccttggggccattactaagtaaaataagagttactggaacacaagccctttgataccacagctgtggatctgatcactgagaaggctactaagtaactaacaggtaggtaacgtagacagagtggatacagcattgacaaagggaggattcacaacctgggagggacagagcagaacagtgcgaaattctatcacactatcagaacagcaagcaatgtaacacttgtgaattgcttattcctggcacttcccgtttatgtagcagtgccttcacaagaagggtgagtatggtataagaagatattttgagagagagagaggccatattcacttaacttttattacagcatattgttataattgttcaattttggctgggcagagtgactcatgcctgtaatctcagcactttgggagggtgaggcaggagaatcgcttaagcctccaaccaggagttggaggctacagcgagctatgatcacgccactgccctccagcctgggcgacagagcaagaccctgtctcaaaaaaaaaaatggttctttttttattaattattgttgttaatctcttactgtgcctaatttataaatcagactttatcataagtatgtagtatagaaaaaaatactatattagggtttggtactatccgtgatttccggcatccactgtgggtcttagaacatatcccccttgaataaggtgggactctgctgtatttgttctttctttagtgctcagtttgattcatctataaatctactaaacaaattttatgaacatttaaacaatacttaccatctaataaaacaagttgtaataatcaattctcttagtcattgaaatttcaaatttaatcacattctcctgaacatttcattataaatgtctctcaactgcttcaggcaccttaagcaaaacatacaaattattgtaaatatttcagaacttattagcacatctgcatttaaatctgtttcaaaagcattattgccatggacaaaagtgtacttcttcttcttttttttttttacatttatgaaaaaaacccaaactttttcagaattttggacagtttaccacaaacaaacaaaatatttcagactaattgagtttccagattctgggtcttataacaaattaaatttctatcagatacagaacattcaaaacatttgaaatacatgtatatattcactgtgctaagctcatttttataatgtctgctacttgaggagaattttagatcatcgctttttacatgggtcccagttccttacaacttaatgtctttcctaacatgaaattgacttcagtgtcctttgttcccttgttcagttattcacaattcactgtctcctcattattacacattgactataattattactcattattgcactggtttgttagcattttggcaattgatgcatgtcttattatccacaattttaattagtggggtcacctatgggtctcatcaaattattattattacacattgactacaattattactcattattacactggtttgttagcattttggcaattgatgcatgtcttattatccacaattttaattagtggggtcatctatgggtctcatcaagttgtttcaaataattattatgtcctttggatgctcaggttaccacacttaatgatagtggcagcatcttctatctccccctgaagtatttgaaaacatcctcactttatggaaacgacagattgtcccagaccatcttgatttacctttgcccaaagtcacttgtgtgctattttgtaagatctcttcttgcctggtaggagaatgtcatgagactatgacaatgagtgggggtggagagccctgggctgctgctgcccccctgggcctttgagtggccaaggtggaaaagtgatttatttctgaggccattaggtcatattgattctctaaatttaattctaacattactaaatcattttgaaatttttcttttaatgtaaagatttaaaacgtattttctagagaaaatactaaattaaaattgtaaccactcacagcagccctgataacactctttctctttcagtttgagattttatcaaccccaaagaccatctgatgcaggagaatagggatatagggtaatcaagagttaaggcataagcaatagggcagcaggtgtagtcagttagttctaggcaagattaggcagcatataggccacatcctcactcctgtgataacaagactgtctccacttcagcctctaattggccatgggccagtccttcatagggtataaccagctggaggcctctaaacagcacctggggtgttaccaaattctttttgcttaataaaaaccctaaagaacactgtgatcaaggctcttgagctgctcgctggagcctgctcccactctgtagagtgtactttcacttcaatcaatctgcgctttcattgcttctttcattgcttcattctgttgttgctttatttgtgcattttcttcaattctttgttcaatgtgccaagaacctggacaactcacagtcaagactttccatccagtaacacatctgtattcgttttctaggactgctgtagcaaagtaccatgaactgggtggtttaagcaacataaatatcttgtctggtacctctggaggctagaattccaagatcatgatgttggcagggttgggtcctcctgagagctgtgaggagaatctgttccaggccactgtcctcgcttctggtggtttgctgctgatctttggtgttgcttgactcacagacacatcactccaatctctgcctttatgttcacatggcctgtgtgcatgtcttctgtgtccaaactcccccttttcatgaggacaccagtctttttggattaggggtccaccctatcccagtgtgaccgcatcttaactaattacattttcaaggtccctatttccaaataaggtcacattctgaggtaatgtggattaggacttcaatatatgaatttattgaacccacaacacttttcaatacctagacaatggaatcaaagaggctgttttactcatagggtctttctggttcatctttgtacctgcaggttaccctgactgggcccctagacctccttccatctctcaaccctctcaccttttcccagcaggctctgcatcaaagggaatgtggcccctttagtgggggacctgggccatcttggcatggtaatgcgtcagccccagactagttaccttaagtctctgagtctcagtttcttcatctgtagaatgagataatcatattactggcctctccaagttgttgtgaggattaaatgcaacagagcctggagagccttcagcaagtctttgatgagctatgagtgcacattacacatttgctgtcaccattcctattagcagagccaggcagttggagggccctgggccaggcacactgcccagccctgtgtctacctgcagtgagattgtgaaccagctgtttcactcctgaggcctctagtccttatctgtataaaatgtttttggaaaaaaattctccctcagtcctcttcaggccacatatttgatggttcggtgaggggcatgggtcatcctaactatggctcatggctctcctgcgttaggctcacctgggctttccctccccagagaacctggcaaacaaggctgacaaggaccagtatgagctgctttgcctgaacaacacccagaagctggtagttggatacaaggactgccatttggcctgggtcctttctcatactgtcatggcctgaagtgtgggtggcaaggaggacttgatctagaagcttctcaaccaggtccaggtatccccacctgccatcttcccctctggcttagtgctccctgcttggatttggagggaggttaacttccttgccttcttgtcattctggaagtcctggtatgttcagggtacagtgggagccatgccacatgtgatcctcttcactgacaagccgctcagtctatatgtgttatatacagcagaggaataaaacctcatctggaaccacgaacctggtggactgaagactctctgcagaagttcttcttgtcccatttaattatttttcattctaaacaggtcctcaggatgagttcacatgaccctcttcctccacaaagtcctcccctgtcatcccatggcatgtgatcctgccctcctgacaactctgccaacgctctctccttagcactgggggactcagagatgaacttggcaaagacttgtcttgagtcattcacagatgagtgtgggaggcacacgagtatggattcttacctgatggaattggactacctcatggacatggatggcgtcctttatggaggacaaagggactgatttgcaggrtgtatctgggaaagttcctgggccctggggagtaactgtgtgcatcctaaggaggtggggggtgggggttgtcagggagggcagcaggtggcatttcatgtagagtcactgcaaaagcaaacaccagccagccatttgaaagagcacgtcggtaggtgctgctgtgagctatgtcaggagtggctttgggccagtcaaccggagtcataggcaaagagccctttggtttttggaggccagaaaggggaaggaaccgtttggtgtcccacagctggtccttcagtggcaggcttggcgtggggagaagaggagctcaggaagtctgattgcagcccatggtgctggatcaccagcctctttaggatggagaccgccacgggtgcttagggtgatcagatggcttgagggtgaggcagcctttgctgaactgccccatgggaacacagagcctcagcccacagtggaaagggatggatctggggggtggcccctggcaatttccccgaggccacaccaggcagacaagctgggatctgaggagagctttccctcaccatgagccagggatgctggggagcttggccaccatcttcaccctcagacactcatatcttgctttctgtttcccttgtctgttttggggtttgttttacctttacctctatgccgtccttcttccttcaccatctcttttgtcctttgaacaggaacattttggaaaagacaagtygtcagaatttcagctctttggctctcctcatgagacagatctgctgtttactgatgytgcccatgggtttttaatggtcccacctaagatagatgccaagytgtacctgggatatgagtatttttccgcgactcaggatccaaaaagaggtatgtaaggtcccgggagggacctggccagcttgggcagcagggtggggtggggccatcatgggaggctttccaggtgcctgcaagcttcacccaaagtttattggcctgcagagcccaagggagctactaactgcattgggttaatgagggggttttctgtgattagaaagtggctttaatggccttcatattctagaaaacttgaagacatgatkgccctggctcctttttattaggtggggtcatcccacccagggtgagtctattcgacatggagtataaaaatagtccatcttaaactgaagtgggaatgtggccactaccaccatccagaggtttctggtctggccatctactggatctctatggtttatttcttccttctttccttcttctagctttgccctccatttagtcaaccagtaggtatttgcatctacagaagggcagccactgtgttagacgtgggcatatggtggtgagcaaagacactgggtgaggggagagcaagcaggcccacccagaacagaactcgtgactgccaagtgggacatgcttcctggatggggagcccagtcttgcaagagaaaaccccagaagaccctgagctgggctggtgctcagagaggcctccctggggaggtgatgcctgaggagctgaggtcaggagcagggggaagctctgtcttcactgattgatttttctgagaagtgagttccccatttctcctggagggtgacaggcaggaattagcagtgtcatgggaatgagacatgtcagctctgctgctgccagtgaaggccttgttggacagccactctgcagcgctaagctcccagacctacctggggcttcctttggatccctccacccggcctagatgtggaagactccccagggtgcggtggtgckcagtgggccaccatgagagggccaagtgtgatgagtggagtgctgtgactggtggtgccttggcgtgcaccatggaggagaccccagaggactgcatcactgccatcacagttggagggccctgcttttaaggctgggctcagacactcagacacacagcacttctgccaaatctggcattgaagctctccttcccaaatgcctcttcctcagcctccaggataaggacacctgttgtgtgctgcctcccacccaccccacaggcccctccagctctgggcagggcagaaacacagagccaatccaagagctggactcctggggggctcagctctggagtccagttagctcaggggagtgtcttgcctaggagtcccaggaagtagggtgacattccgggctatggtcagggctactgtgaattgtgaaagcagatcaaccttttcaatcctttaattgtaagtttattttttctggttataaaatattacaataaataaataaaaatagggctgcagtgagccatggtcacaccattgcactctagcctgggtgacagagcaagaccctgtctctaaaaaaatcagaaagtaaaaataaaatcattcacaacttcatcactcagagattatgtgatgatgatctctgagtgacgaagttgtgaatgattttatttattttatttattatgatctctgagcaatgaaattgtgttgttattaactttatgagcagaactatttttgtgattaggaaaaaataaacttataaataaagaatgaaaatttgacaaacttagaaggctatgcaaccatttcattttgttttgtttaacttgagaagaccctcatcttggtaaaccttcctagcaccaattcctaagattaagatcttgatggttatgtagtctactaaatgtgtcaattgtaaggattaagtaaatctcagtacrtataacattgcctggyatatagttagcagtaactaagtgttagctgttattattattcaaaatcccagggacagttggtatattttcttaaataatgaaacactcatttaaataatggctatgtaatattccaccaagtatgttagcctccatttaaccagtttctcagtgtttatatttgagttatttccaaatcctttgctattatagacaatgtgggattgaaaaatctttgtatctataaatgcctatatttctgagtatatctttaatattaatggtaactaatttttctggagttactgtgtgacaagcatgtttatgagctcttaaactgtattactcatttagtcttcatgataaacctatagggtataatttttacccaacttatggatgaaaacatgtaaatagcatagtattgagggaaacgtgctttagggtagacagatcttggaggccatctggaatagtggttacaaggaattaaattgcctaggtttaagtcttagccgctgttgattggacaaatttaacctttctgctttcatttataaaagaggggaaattctagtatctagcttattgaagtttgtgaggaatatatgaggtaatcactgtgaagtgtttagaaaggagcctggcacataataaggcttggtaagtttttgctgctgtagtcactgtttttagatttctagaagggtagtgaaaaggtcaaaaacaaagagcatgtatrtgcatgtttttatcttggtgaccttatctataagtatacttttttactctattagaaaaattaattgattaaaataataagtgaattattagtgtattatctagagaaatgaattatttattgaaaatctttgttgtgccaggcactgagtacagtgctagtgggattatgggaacagatttgaactccattatctggaagaaacatatcccatagaaacaggttaaatgcatttcctgagtctggccatgttaattgctgggttgagtgactatagccacaaagaaggggtggtgaggtcatatccaggacgcagcatgggtctcatcagaggacacagagatgtccagggggcatgacctgggttggaacttgttcccaggtcaacaggccaagagcatgtccagttttctaaaccctgtgtttacatggcagaagctttgagtgatccacaattggttaatcacaaggatgtttacatgaagccagtgaaatgagaacctctgagggtcagaggcccaggagacagctattgtgctattgatttgtttcttaacttcagaaaggggaagctgatgccatgagcttggatgcaggattcatctacatagcagggaaatgtggtctggtgcctgtcctggcagagaactacagtaagtggaggggagtgtccgtctccattttttctgtccacagttcccctgggctgtgggcatagaaagatgaggaaataacttagtttagtgttgagataataactattgttggaatgtatggagctagtagaaaaaaaaagtctccctctcctggagccagaaacaattaagatatagacaaaggaatcaggcagaaagagatcaaaataacacctttacttctgagattgtgatactggagtgtgtgatgtagagctggcacggggctgcaagtcacccttaccttaaagttgcccactagttcaggaaaacgggtctgatggcttatgccaagactaagggcaaagggaaacacattttatcataggtgagaagacccaaacaactctctccccattgtcttcaagaaagaaagaggggctgagccacatgtgctcatgatccttcacccagatgcactgggtggttgagaaggtggggctgcaaggtcatgttctttagtggggatccatccacatggaaaaatgaagctggtgtaaaagagggtttccctaatatcattgattacacctcatctgctacattatctttcaaaacaaaacgactctgtgaggtaaatagtggtatctccattttatagctgtaaaaactgaggcttagaaaagataagtgatgggtcgggcgtggtggctcacacctgtaatcccagcactttgggacactgaggtgggtggatcacgtgaggtcaggagttcgagaccagcctggccaacatggcgaaaccctgtctctactaaaaatacaaaaattagcggggcatggcagcaggtgcctgtaatcccagctacagggaggctgaggcaggagaatcgcttgaacctgggaggcagaggttgcagtgagctgagatcgtgccattgcactccagcctgggcaacaacagcaaaactccatctcaaaaaaaaaaaaaaggataaatgatgtttccattgtagaataaagactgaatccagatctttctgactccctggactgggttctttccctcccgtatagcaaaaataatgattgcctaccacagtctaagactctgaagggaagaaagatatcaggatgacttattacacagctaatgcaaagggatatgacctctccctctcttccccttcaatgagcacctccactttctttgcctgcatctgctagagtactggggagattttgggatggaacctatcttcaaataggaaagagcagaagagggtaaaatgggcttgcagaaccttaacccactgatacccaatgataccttgctcatattattattgactattgagattgagaagctcctgactttggatggagtaatgtgagggtttaatgtcatgtaccttgattgtttttctttttctttttagagcagtttaggtctaagtgtgtgaatttacccatggaaggtgagttagaatcagtaatactggctcaaaggtaaaggcccattgttggggagaggaaagcttaaaaacaaataaaaatgactggaggtggaaaaaaattcacagttaattgttaagatgcaaacctatcctggggtgtaataatactatttgcagggcactttatagttggcaaaggactcctgtttgcactattcctgttccctcttctcagcaaccctggagtatgtgggcattgttgtctcatgttatggagctggagtctgagactcagggactgagtgacttgcccagggccacactgccaggaggcggctgcacctgggtttcagaagaggaggaatggctggaaaccccaggcccttcctggcaccacactgcgcctgagcacatgctgcctgcccatctctgtgtgaaggtccacactggggcccattcctggcatttctggactaagtagagacctcacgagagaaggagattcatagatgctgataatgaagatgaggaggaaaataaaatccacctttcagcttttagccagctggagcttgatggcaggggagttgatcagtctttagagtagaagaccaccactaggaggcaagttcctccgttttgtgcctccagataagcagagagggtctgtctctagtacctactcctggaaaatggatagaacagtggttctcaggtgtagtctctggaccagcagcatcagcatcccctaggagtttgttgggaacaaaaattctggggctccatcctagatctgagtcagaagctctgaggctggggctagcaatctatgttttaacaaatttaatgcgcattatggtttgaaaactgctgtgatagagaattccctgaggtgaaaaccaagtgcatacttgggtttagagtttcttctgaggcaggagggctggggaagttgagggatttagagcatcacagcacaaggagctgtggtctctgtcccctgctgagcactgggtcataggaccctgcacagcccaccctgcacaaaggccactggagtgcaaagttgaggcatcatttccctgctcacctgcagcagctccccttcctgtgtggcaggaccccagcccggggatatgctgtacctcatccctctctgctgtcatgtctaagaagccttctttaaattgtgtcttcatccctaatcctgaagtccagcaaacaatcttctatctgctatgtattctattctgatcatttatagtcagaaacaaccctaactgcttcaagagtagttgacatattcagaaactgcaatgatacacaaatgtagatcagcaagcatacttagaggatggtttagtcaccagcagagtgactgactgtgatggagaaggtgccatctgagtagagagggggagagttaacctcagagtcacacacacacacacacacacacacacacacacacacgcatggaaagatggatgacaataatgaatgccataggtacagaaatagtggcattgaaggaaggcactatgacagcatttggctaccagactggtgtcatggaccgcagtgtggtaggcaagggcttgccatggcctcaggagaacctgcttcactgggaggggcctccagtcctgcttctgcactactgctggaaagccacctccctaacctgctcttcccattcctgatttgcctgtgctcatatctgcacctctgatccccatcagtcactccaggaggggttccactgccaccatttaactgaagaaaaatttaggctcctagatgataaggacgtgtctgaggtcacctaagaaggacaagacggaccttccatctgccatgttgactcccaacttctccaagtttgaatttgtagagacctgatctacaacacagagaaaaggtgtgtacgtggggaaagcagggagtggtgagccgcattatcgtctaattctaagaatttatgattcaaatcttatgattcttttcagtttgcagttcaacctaactcaacaagcacaattcagttatatagtattggcactggaataaatgaaatattcatgatattctcattagaatcaggagcaaggcaagaatgcccactcccaccaaagacattcagcattatattggaagtaaatgcagtaagataagaaaaagagttgggtttttaaatattgggaaagagaaaagagattaaattgtcattattagaaaatattattgtaaacctagaaaatcagagacttaacattaaaaaataactcattaaagctttcttttgaacttatattcaacagaaaaacttaaacaagtgcatactcataattacaaacatttatagaaataaatgggttttagtaggggaaaatgggccacaataaaaatacctactagtatagatatgatacatccatatataataagatataacttagattcagccaaataaaagaatgatgtagccatatctatcactactgaatcaaagaagtgtccacaatatattattgaggaggaataaagcaactcacagaaaataatgcagcaagactccgtctcaaaaaaagagaaaataatacatagcaagattctattgaaaaagtacggtgtatgtaaatatatgtgggtgcatgtatgtagacatagctagggagcagtagtgttagtctgtttggctcagttcctaataatggtagctattgggagggtcctctactagagtaacatgaggggttcaagatattccctctccccagggagagtgacaggcaggggctagcagcagtagctctaaaatatattttcagagtgccctggaggtctgataatagtatcttggcaccccttccactaatatatatatgtaaatatgtgtgtgcaaacatatatatataatttataatgtgtgtatttataaatatgtatacttatatgtatatatgtataaatacatagtatataagtaaatactatatgtatatatttaaatgtataggttttttttttttccgaaagagcaacttgctgccagcaaagtcttctctgagatggtcttgctgtctgcttgaaaggacagacagagtacatcactgaggggtcagtaaagaaatgaagcactattttaagcaggaagggatttaatacagggaattaaatgttaacaaaaagtggacactaggttcctggaatgactcccacccatagtgaaagagagctgactccctaggagacctactacctgcaagacctctactagtacagtgatttcaagacacatcctgtagctgtgaccaagggataggaagccagaattgatagtggctgctgctgctgcatttgctgtaatagcttctaatcctctaggatggagaagggatactagagatctggacagaaaaacctaacatctccaagaatttatttcctagcagaaaagaggtgagggggaaggcaaagacctctatgtgacttccaccttccaaatttcacacatccttttacactaagaacacagctgcaaggaaacattggaagtgtagtttccatatttccagccagaagggggacaggatggaaatggagaataccagctccagcatagccaccatatggagatggcatttaatggcccggtgcaggagggctggccagatctcactggatcgtacattcttcctcctccttccccttctctccctgaaaaagaagaaattgcatcttggtatttcaatttctaggctattatgtcatggctgtggttaagaaatcagatgctgatgtcacctggaactctctttgaggcaagaagtcctgccacactgcagttggcacttctgcaagctggaacatccccatgggcttaatatacaatcaaaccgggtcctgtaaatgtggtgagtatgttctgggaggtgttgtggcagttcattccctgtgcctgtgcctgggtaaaggagaaattcagtttgatgaatggcagaaaatgccataaatgggtggtgagcttaagagcttgacagaaattgtgggcgagcctcacatctccttgagcaggtcctcctccttctcatccttttgcttctgagggaaataccttggcccaaagggcagatctcagggaaatagctctatttttgatgtctcacaaatggctcagggaacaagcctgggttcgcaaagcaagaccagcctggatgcgttggtgcgcgcgagtgtgttgttttcacatataaaccgaaatggctgccttcttaattggaaaccttccaccagtaagtcctggagtgctgtttttcatgttcatcctcatctctcccatccaagtactagcaaggcctgaccctgcttagcttccaagatcagacaagatcaggcgcattcagggtggtatggccgtagaccatcctcatctctcttagatgcattcatcatttcagctatgctcatgccactacctaagaggctcctgctcctctgctttccccaactctctgaaaatcccagccctgactgaaccctattacctgctctctttt

SEQ ID NO: 12536 - DNA, 12933 bp, Homo sapiens
  misc_feature (1)...(12933): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagcctcccagagacccccgccgaggacccctgcccggcggccaaacccccgcggaccgcccctctccgcccgcgccggttgagcgcgcccgggcgctggccgcggtgctgcccaggccggcgctggccgcggtgctgaagctgccggcgctgccgctgccaccgcgttctccgggcccggcgccgccgcccccgggggcatggggggccgctgactgaggctccgccgcggcggcggggggggggaggggaagggggccaccgagccgggccagccctgcacccactcgcagcctccaggcccgggacggagccgctccccccctctccgcccccccagcctcctcccccgcctgtccaggggcggcaatgcgggctgggaagccgggaccagaggagggaaggaaggaagaggagaggagagaagaggagagaaggaaggaaggattgaaggaaggaaggaaggattgaaggaaggaggaagaagagggatccggaggggcaacggaggagacgcagggcagcaaggagagaggacaccactcgcgcggcagcatccaaaggccagagtggggacccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaaggtgagcgctggtctgagaccagggcgcggggcctggggctttgctggaagcggtggagggccagagtgtgggggcggagggcagggcccggggaaacagactgaagggaaccagaaacggcaagagtctgtggctggagcctggacggtagaggggaggaaggggaacacagaggccaaggctgggcagggagagtgtcgacgttggacagagggtggggaagaggatcaggaactgaggtacccaaacgcacacatggacccacatcctgacccatgctgggacagacacagccgcatgggcgctgccatgacgggacccagccatgccggcacacacagacctacactcaagagaccagggccgcctcgccaccctctcctcttccttgactgcaccaggacacctgctagggttagctggggaatgcagggagctccagggagtaggcagggggtccaacagggccgcccacctgtcagagcagagggccagcagaggcagcagcagtctcttccctgaagcctgggtcagggagaggaagcagggaggaggctgtgagcaagggacgcccaaggtgtgggaggcagggggaggctctttgtgtaagggtgcccaagttcaaggacaactgtcagcatgcaggagagggggacaggagtgccagcagcatggggtggcagagcaagtgtgacctgcaggagtgtgagcctgtgtgggtccatgtgactgtgtgtggccatgtgaccgtgtgcgcttgtgtgtgaccctgtgtgtgtgtgtgcttgcctgtgtgccactacatgggaccatgtgactctgaggccgctgtgcaccatgtgacttgagagtgtgtccggggtgactgcatgtgtgaccctgcgtgagtgaggaggtggtgagttcggcacatcagtgtgcagcccaccctgtgagggcacacaagggctgatcatgctgggagactgggtgtagccctgaaggaggcagagcgtcgcgaggggcgtgcatttgtgactttgaggttatgagatccatcttgtgcctggggagcaactgcagctaccggtataagtgatgctgccctcctgcagctcgtccctgtgaaagtggacgccctggccctctctgcacagttcaggggcttgggaaggccctgaaaggggttagggtgtgagcaggagagggcaatgttgaacagggtaggacccaagggtgcaggatggtgagagggagttcggaggagaagcagagtgcatggaggagcagggagggcagggtcaagtccagtgggtggccggagagctgagggaggtgctggtgaggccggagggaactgggggagggagacgtcttcagggcttgttggaggaaccagaaggccagagggggtcaacatcaaaatggagcgcacgttctgcaggccagagggagagccggccaggaccccggagaggtgggacagacggggtccctgggccggcagtcctggctttgtgcgccgcgggtctgcagtgtgttgcataatcagggaaaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggaccctgtctcatcctctcctcccctctcttcccctccctgctgtctccatcctccctgcccggcggtccctcggcctcctctcctttgtcctcctccctgttcgcctctctcccggacccgggtctcccggtccgcgtctgctgtctcccgcccccccatcccccgtgtgtgtcctgccgccgccccattcccttcccgctgtccgtccgcctccgcccgcagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggcgctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccctcaagcaatagggtcctgaggggagaccaaccctgagccccctcccttcccttccagggtgcccccggctttctcccagcaatagggtcgacgagacctagaaccgaacctcatctccgagttgggtctctgaagacgggggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgcccctgagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcatactttctccccacccctccccgacccccacggcagagcccggcggctgtaatggttccatgggcgggggtggggtggttgcccccaagacccctccttcaggcattaatcattcactgaccgttcattgagcacctmctatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcatgtgccccgccgccttgtacatattcccacccggaataggccgggatttttactcgggccgtgcccctcttccgcccccatttggggccaggccggccggacagacggacggacggacagacctccttcctaagcacaatagcaccagctccccggagcaccgcacctccacaaggagaataaatgccactcttgatagaatttggagtgtcgggctgatgtgtcctgggctgggcccacgctgttgggtggctgggagggtcttcccagtctggcagtacctcagaggctggtgctgcaagggtcagcctgaggcctttcacaagacggccctcttcttccactggggaggacaggcttggcaggcccaaccacaggagcatcaggtctgaaggcaaagtagttggcatttcccctggggtaggtggatctgctccacaccaggaacaggagcactaaggggttccagtctaaagtcaggccaagcccacggttggaccagagtgggcagggtaggtatagtaggagctgctgttccccagcctgggtgccttcgctcttctctccctgaaggagctttatgctgtgatggaaggcctgatagccacctcaagccctctgagatgctgttgcaggaaatggggacagtggagagttcgaggtctggcccttttcctgtggcctgctgcccacattctgacccccaggcttcccagatatgctcccccagtgtctgcggatgcctccatggatagctgggttggaccggttccagggaggaggtgcccagggggcagagaggcttctgcaaccatcgcccaagggctctagacagaatgagtagtggaggagataagggacagggaccctttgcccagcaatgtcccctggtaaccaggtaggcaggcatgagccgagaggcccaaagtcttcgggcacatacattcaaaccaggtcagtcctagatccagggccagcaaagctgcccacaccctagcagggacaggggacagacctgcccagactccactagggtggagagcaggggaaccaggtctgcagcatgtcatggcctgtgtgcctggcacttggaggagctgtggtgcaggtgggtgctctctttgggagagcactaccagcaatgacaatggcagacagcaatggccaggaggaaggctcctagcctcactccttccaaaggactccaacagcgactggctgtttctacttctccaggattctgatgcgtagagtgggtggaaggatggaggtggcctccctgaggcctgggatgagctcgaccccccagttcctcccagccacagacacaagtttccctctgaatgagcagcacaggccatagaccaccactggctgtgaactctcctgggacccttgcttctcacaggccttcttggcccacccatggcccctaggccctgggatcagcctgaggccccaacccacttccagccctttattccactagccctggaaggcaactcgcttcgggcttgggccccctcatttgttgctgcccccagcagggtgatctgcatcatgctttcctcgatgacccagccatacacacccttgtccccaaccaacctcacctaccctgaccattcccctcaccctagatcccagggtatagggcctgtctgggcagggcttcacccacctctggagctgctgccccgccacgcccccacccccggtggcaaagcccttccttaatggcccgcccacagccagtgctttccccattggctccaagcctggctctgctcaccaggcccgacccatcctccctggtggtccagtccaccctcccattgtctttctcctgtggccacttgccggctttgagttgggacgcgaccacaggttgagtcgttgatctcctctgcctagcatgaggtgctccgtggccaggtccagacctctctgagcttgctgtcagtccatactcagacaggtctgggcctacctggccacagagtgtgtctgccagcgactgcattcaacaaatgaatattctgagagactgggtaggagatggggctggtcctgaccgaccaaggcccatgtgtgaggggctcttgggtccagtgagggcggccccactcggcaggctacacaaagggcatctgccaggtagctccagcctgcctgatacctggttggcagcaacccacagcggcctgtggtgacaagaatatgtcaccaggggggcaaccaagggggcagccctgctggccactgttggtggaggtggtggaagaggacggagctcagaggcgaggctgtgaccagcccacgggagaggaccccacctcaggaggagcacctgtttgcttccagagaagtgctgcttgcccctgctcaccccagaggaatgaaggtgtttctagagtcagagtcctcagtgaaccctggcatcctgagatccaggatgttctcactccatgccctgtgcaatatgcacaccaagccaaggtgggccgcaactgtggctgttacagttgattagttgcttcatttaacatacaagatgtctggggcagtggctcatacctgtaatcccagcaccttcagaggccgaggtgggaggattgcgtgaggccaggagttcgagaccagcctgggcagaatagcgagacccccatctttagaaaaaataacaacaggccaggcgcggtggcttgcgcctataatcccagcactttgggaggccgaggtgggcggatcacgaggtcaggagatcgagaccagcctggccaatatggtgaaagcccgtctctactaaaaacagaaaaattagctgggcgtggtggcacgcgcctgtagtcctggctactcgggaggctgaggcaggagaatcgcttgaacccaggaggtggaggttgcagtgagacgagatcgcgctactgcactccagcctggcgacagagtgagactgtctcaaaaaaagaaaaaagaaaacaaaaaacaacagggcggttgcacaggccgtgcaaatgcacagaagcctcttgagtcccggcgatccagcggcccagacttctgacatcctggagaggctggcccacgttggaaactgggaggccctgagagttgagggacgtggagctccttgtggagagagtgggtgggctgagaagacaccaccaaggggcctgcgccctcgccctcgccctcgccctcctctcgccgggctctgcaggcccggaggtggagagcctgggagtcgcgtgcaaggcaggcgtcccggtgacgcagggcctggtgcatttctccagcttggtcttctgacctggcccttgtctgacgtccccctaaggcgaagaaaagcaggttcctgccggggtaaccagagggctcgcggagcagaagcgcgccagggacgttactgtaagctgcgtgcgcagaaaccaacgcgctgggtggcgggcgacgcgagccgccgcggacaccggcccggacagctggaccgtggcgcactaggcgcttcctaaatgattgcccggagtgactcgccgagaccccgtgtgtacacaagtgggacgaggggcgggcgcacagcggccaggaagtcggggcccagcgcacccctcagcggaccatcccgctccgtggggccggacaggaccccgggaccacgcgggagcgatgcaaggtccgttcccgctgcgcgcacttgcggcccgcagccccggccctgggagctgccacggctcccagggtgttctgcgccggtgcggccgcggcgactacgactcccagggtgctctgcgccggcgcgcccgcggcgactacgactcccagggtgccctgcgccccgtcagcctctccaggccccgcctcaggtcggccgcggactacaaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtagcggagcgcctgaccccctaacctctgacccaagggccccgcgactttccggggttggccgaagcgcgagctccgagtccgagaacatgggccctgggctaagcggggatcggtgtgccctatgggccctgtggggaaactgaggcttggggagagtcacctgacaaggtcactgggtaggggctctggagctggccttggccaggcagaggggagccggcaggtgtcccgcatccagatcctcttgggtctgtgcatcctcaggggctcctgaggagcttttcgaggggcgggctggtgggggcccggccctggacagtgtccccttatatggaaggagtcagataagatctgggcagtttgtggtgataggttccttcttggtgctatgagcggtgccttgcgggtaggaaaggctcccagaggagggctggcctgccagggagggggccagaggagcccaggcctgtccgaggacaggggaatcagcagctgccccggacaaggggcagtgttagaggcgttcttgtccttgcagacccttctgagagtggctgcgtggcccattcattgctccagtggttaggctggcctggagccctgccgatgttgccagagccagcgtctgttgtagggacagagagttgggttctgtgttgggacttccatcctccaggtggggagtggggtatgggggtggtggacacacctgcaggcgtgtgccctgctcagctggatgactgacagagaggggtggagggagagaaccatggccgatgggaaggacttggccagcctgggcattggcttcctccaccaagctggccttgagcaatccccttgccaccctccatcccccctttatggcctttaccctggcccaggggccctcagggctttgttttagagagcagctgagggcctagaggttatcaaggcagaagtgggctgattttggacatgtagttggcaatgatttgctctctcagtgagcaagaacagagctttccttcacggggcaccatggggagggggttgggggagggcaggcactgtcgtggccctcagggtgctcagttcatctgggagataagataacctcagcaagagtcaggcatggagcaacatggacaaaggtcgggcacggaggccttgaaggggccgtggggaggagggtggccctcctgagaggggtgcttgcctgctgtgggcctggggtgctggtgagggaggctggcctaggcacctcctacctgaaaaggaggtgtggctcctggagttaccctctctccaggaggcagggggatggctacatgacctgtggaggacgtgggaattgagatttctttttttttcttttctttttttttgagactagttttgctcttgttgcccaggctggagtaaaatggcacattcttggctcactgcaacctctgcctcccaggttcaagtgattctcctgcctcagcc

SEQ ID NO: 12537 - DNA, 13820 bp, Homo sapiens
aataaaataaaaaagggaaataaccaaacatttgttctgcctttgttgtacaaattgtatttcagggtagccaatgagttttaaaggaaaagtccttttgtataaaatattttcaactaataaatgtaaaagaaatgataggccgggcgcggtggctcacgcctgtaatcccagcactttgggaggctgaggtgggcagatcacgaggtcaagagattgagaccatcctggccaacatggtgaaaccccgtctctactaaaagtacaaaaattagctgggcatggtggtgcacgcctgtagtcccagctacttgggaggctgaggcaagagacttgcttgaacccgggaggcggagattgcagtgagccgagatcgtgccactacactccagcctgggtgacagagcaagactctgtctcaaaaaaaaaaaaaaaagaaagaaacataacaattgaatatagtatgtggatctttatttcataatccaattatttaaaaataaatttctgagacaatgggcaaatttgactataggctggatattaaattatattaaggaattaatattaattacagattaatatttctgtcagtgtcttaatgatactgtggttgtgtttttgaaaacagttggcctggtgtggtggctcatgcctatatcccagcaatttgggaggctaaagcaggctgattgcttgagcccaggaggaattcaagactagcctaggtgtcatagcgaaaccccatctctacaaaaaaatacaaaaattagctggtcgtggtggtgcacatctgtagtcttagctacacggaagcctgagatgggaggatctcttgaggctgggaggtggaggttgcagtagcccagatggagtcacagagcaatagagtgagtccctgtctcaaacaagaaaatggaaaaaaaaaaaaaaagtctttttctgttagagacatatactgaattatttaaggatgaaattatacggtctccagtatttccttcaaaatacttcagaggagaggaagtggcagcacagaagattaggagagagtcaataaattttttttattatttttttttgagactgagtctcgctctgtcgcccaggctggagtgcagtggtgcgatcttggctcactgcaagttccgcctcccgggctcacgccattctcctgcctcagcctcccaagtagctgggactacagacgcacgccactacgtgcagctaatttttttgtatttttagtagagacagggtttcactgtgttagccaggatggtcttggtctcctgacctcgtgatccgcccgcctcggcctcccaaagtgctgggattacaggcgtgagccaccgcgcccggccagtcaataaatattaaggcttagtgatgggtacgcgggagcaggggaggagcataataccatttttttttttttttttttttttttttgagacagagtttcactctgtcgcccaggctggagtgcagtggcgcaatctcggttcactgcaacctctgcctcccaggttcaagctattctcctgcctcagcctccccagtagctgagattacaggtgcgcaccaccacacccggctaatttttttgtattttttagtagagacgggtttcaccacgctggccaggctggtctcaaactcctgagtgatccgcccacttcagcctcccaaagtgctgggattacatgggattacaggcataagtcactgtgtctggcctttttttttttttttttttttgtatgtttggacattttcgtaacaagaagttaaattttaaataagtaaataaataaaggctttaatgcaatttatgtctgcacttggcttatgccctggggaagagactgaatgaatgaatccaaagaactgtaatatcgggatccctgtaccacttggttttgagtgctcttgtctaaatgtgtaatcctgaggaaaaaggcatctcccttccttttttagtggaaggcttgaaggaaggtgtaccagtatcagccccagcgaggacacaaatctcaatccaagtcatttctttcagatggcctatgtgttagcaagagatcacagtattggtagctggaacttgggtttgagatgggctgcaattatttctgactggggctttagtagacataaggatactgtgctgaaatcctgtggtcagcagtggaagttgacaaaaggcatggcttttcaagggtataactttgacaaagatattgctttaaaacatttcagaatcagcagtgacaccgggctctcagcttctgcagcagctagggtgataccttccagagcaatcagctgtggttgtgaccactgtgactcctaagcttatcaggggaaggaggttgagctaagaggggagaaggaaaggtctagattttccactaatctaggcacatgcagcttgagttgacaaatgaaaggcatccttatggtgagatgtcttatgttcctcagctgatgaagcaggatttactcattacctgttcttgaattgtatgattttagtattatattttatggaaacaacttttgactatgattcagagatgtgactagagtatctctgccactcccttgtcacttgtgtcatcttgggcaggttgatcttctttaaattaagataataagaccttgcctgtctacctccatggttgttgtgaggatcataagagataatatataaaactataatttttgtaaactagctgtataaatctaggcatcattattattgtaagtgactaagtgatttacatcttaaagccccttattttccttgattctatgttaacaataaatgtttaattggtgtgctataaaattagatagttccaaaacaactacaaagaaatttagtgtatagtatgatctttctacgttctgcagtgttacataggaattcctgggaataagaaaaattttatccagttgctattttatagttatatccttgactgtattctcatcaatttaggagacaaataagttacttatttattccataaatagtgccaattattttataatctcaatttaagaagtcaatatttattatgttcaataatgtataatcaggccaggcacagtggctcatgcctataatcctagcactttgggaggctgaggcgggtggatcatttgaggtgaggagtttgagaccggcctgaccaacatggtgaaaccccgtctctactaaaaatacaaaaattagctggcatggtggcacttgcctgtagtcccagctactcaggaggctgagccgagatcgtgccactacactcaagtctgggcaacagagcaagattccatctcaaaaataaataaataaataaataaataaataaataaaatacaaaagtaaacatacaaaaattagctgggagtggtggtgtgtgcctgtaatcccagccacttgggaggctgaggcaggagaatcacttaaacccaggaggtggaggcaagatcgaacactgcactccagcctgggcaacagagcaagactccgtctcaaataataacaataataataatgtataatcaatcagaagattagagcggaagttggtaaagtgtgccccatagaatgaatctggccactgtggcctgaaaactaagaatcatttcgacattttttaaatggtctttttaaaaaaatcaaagaagactatattatgacatgacacctgaaaattatgtaaaattcaaattgcagtatcagccaggtgcagtggctcacacctgtaatcccagcactttaggaggccgaggcaggtggatcacctgaggtcaggagttcgagactagcctgaccaaccccgtctttactaaaaatacaaaaattagccaggcgtagtggcatgtgcctgtaatcccagctactcaggaggctgaggcaggagaatcgcttgaacctgggaggcagaggttgcagtgagctgagatcccgccattgcactccagcctgggcaacaagagtgaaactctatctcagaaaaaaaaaaaaaaaaaaaaaaaagggccgggtcgggtggctcacacctgtaatcccagcactttgggaggccgaggccggtggatcacctgaggtcgggagttcgagaccagcctgaccaacatggagaaaccccatatctactaaaagtacaaaattagccagatgtggtggcacatgcctgtaatcccagctactctggaggctgaggcaggagaatcgcttcaacccacaaggtggaagttgcaataagccgagatcgcaccattgcaccgcagcctggacaacaagagcaaaactccatctcaaaaacaaaaacaaaaattgcagtgtctatttattaagacatggccacacccattcatttatgtaccatctgtggctacaacagcagttgagtagttatgaaagaaaccatgtggtccacaaagacgaaaatatttactacctggctctttatagaaaagtttgcctccccttagactagacgattcaaagggatagaaataaaaatgtttttctaagttgctagctccctgttagtataaataaacctgggatacaggtactcaaatgacgcatatttcaaaaactcagttatggttttttaaatgaaattacatttaatttttttttttttttttttttttttgagatagagtctcactctgtctcccaggccaagctggagtgcagtggcataatctcagctcacagcaacctccgcctcctgagttcaagggattttcctgcctcagcctcccaagtagctggggttacaggcatgcaccactacacctggctaatttttgtatttttagtaaagatggggtttcaccatgttggccaggctggtctcaaacaccccacctcaggtgatccacccgcctcagcctcccaaagcgctgggattacaggcatgagctaccgtgcccggccaattttttttttttttttttttttgagacaggacctcactcttgttaaccagagtgcagtgctgcgatcttggctcactgcaaccactccttcctgggctcaagggatactccagcctcagcctcctgagtagctgcagatatggttttaacatgcaatgaccaactaagccaattttaagaaattaaaagccaattttgtttttgagacagtctcactttattgcccaggctggagtgcagtggcacaatctcagttcactgcaacctccatctcctggttcaagcgattctcctgcctcagccccccaggtttctaggactacaggtgcacaccaccatgcccagctaatttttatatttttttagagacagggtttcaccatgttggccaggctgatctcgaactcctgacctcagatgatccgcccacctcagcctcccaaagtgctgggattacaggcatgagccatggcacccggccacgaaaatcttatttacaaaatgtaataaataaaatatgaataagtataatgcaattaaataatttaaaaatttcccattttgctcattgatggtggcagaaaaaaagagaattgggattatattagttctctgactaacacacaatagaaactgactctgactaagggaagaaggggtttattggaaaaaggattcttgagtagttccagaactgagggaagagatagagatcatgacctttggaaggacaggaaactgggaagctccaggtccttaccagcaggtgaccctgggcctgctctcagggcacatctatgagacttcaagaggctttcattggagtttcaagttttatggagaaataaattgatgggcccagtttatggccacgtagccaaagggagggaataatgtgattggtaacctccctggagtcccatggttgaaatggagaaggaagaaaggagaggtaagtaggattaagggatgccaggccgaggagaaccaacagatgtgtgcacagcttgtcaggaaacatgggctataatctcaacttcaccaaacgggtgaatatactgggcttcagtattatgttcaatatgtaataattatatattagtataaaacgaggggcaaaagacccatctgccataaaattattcattggccacagtgcagaggatttggtttttttgagttaaagaattttttttttttcttaagagacaaggtctcgctctgtcacaccggctggagtgcagtagcactatcatagcttactgtaacctcgaattcctggcctcaagccattgtcccgaatcagcctcccaaagtgttgggattataggcatgagccaccataccaggccaagagctttgtatattcatatacagaattcataaacagttcacctgatatacagaattcataaacagtttacctgaaccaacaagaaaagacatcaaatagtgcttgacttcattacttattaggcagatgccaaatacttttctttctttttttttttttttttttttgagacagggtctcactctgtcacccaagttggagtgcagtggcaagatcatggctcattgcagcctccacctcccatgctcaagtgattctcccacctcagcctcccaggtagctagaactacaggcatgtgccactgtagccagctaatttccttttatttttaggagagataggttttcgccatgttgcccaggctggtctcaaactcctagtgatccatctgcctcagcctcccagagtgctgagattacaggtgtgaaccaccatgcccggcctagagatacaaattaaaaccaccatgagataatactgcgtatctactagaataggtaaaatgaaaaagacagacaataccaagttctggtaaggatgtggggcaagtggaaatttcatacattgtttgtttgtttgttttgggacagtctcttgctctgttgcccaggctggaatgcagtggcatgatcttggctaactgcaacctctgtctcccaggatctagcaattctcctgcctcagcctcccaaatagctgggattacaggcatgcaccaccacgcctggctaatttttgtatttttttagtagagatggggtttcatcacgttgaccaggctggtcttgaactcctgacttcaggtgatctgcccgcctcagcctcctacagtgctgggattacaggcatgagccactgtgcccagcctactttcatacattgttaaaagcagtatcaaatgatacaaccatgttggagaactcttcagcaatatacactaaagctgaacacattcatgccccagaatccataaattccacttctacttatgtacccaggcacctaaaatactcttccttaatgggtttaggcctggggccacaaactcaaatgcacacagaaagattctatcatatgatcaattgtggtagacagtagggagtgtcaaggactgtggttaaactggagagctccctattaagattatgttaaaaaaaaaaaaaaaaaaaagacagcctggccaacatggtgaaaccccatctctaccaaaaatacaaaaattagctgggcttcctggcaggcacctgtaatcccagctactcgggggccaaggtaggagaattcgttgaacacaggaggcagaggttgtagtgagctgagattgccccactgcattccagcctgggcaacaaagcaagaccctgtctcaaaaagaaaaaaaagagaggagttcttatctatacctgtagccattctttccaagggctcattgcactttgtgcaggtcttcagatgcaagaagacagccacagctgtggcacactgcaaacgcagcaatcaaggtgaacaggcggcccctggagatgatcgagctatacataccaatatatgagctgctggaaccagttctgcttccagacaaggagtgatttgctggcatggacgtgtccatgtgaagggtggtgatcacatggcctagatatatgctatccatcagtccagcctcaaagccctggtgtcctattaccagaagtatatggatgagttttccaaggaggagatcaaagacaaagatcaaagacatcctcatacagtacgaccagatcctgctggtggctgacctccaccaccactaatccaaaaaattaagagacgctggtacccatgcttgctaccagaaatcctaccaataagcccatcatgagaattggggtttacttgtataataaacaatgtttgagagatttttaaaaaaacagagatgatccttttgtagttcatgagcatgatgattgggtgttcctgcccacgtgtgagatgagccaccctcgaaccttgttaccatgttgacatattacctgactgacgtgagaaaaacaaaaaaaaaggagattatgttaagtgcctgggaaatactcttcttactgaggaagaaacacctggccagttgtacatactggccaggagagcattttcagtaaaagttattcaagtgggtactatggacaccatttggtataacttcccatcactcttgtacactttcctctggaaatagccctgctgccatgtctagacttcaaggttttgcctctctctcaatggctaattgctcttgagtggacaccttacccaagccaggagcagtggattctgttggtgctctacccagatctccttgactaggcagtgcaccatcccccagctgctgtgaatgttggctatgaacacctcacaggtggctttgctattgaatcatcttcccaaaaatgcttgagaaagtatgttctccccctcgagggagaggaacaccattgcttcaaagtgggataactcagtcatgtcattcactctccaggtcccaccaccggatcaggctgaggctaggcttgcttagctctgtctcctgtaccaccctgcttccctcactcccttaatggatttctcctgagagcactctccccgtacatcacaacagaatccctctgcctttggggaacccaagctaagtcatagggcccatgagatccttttatcccaaagaaccagagagcctgggcacactgaaacagaatcatatcaatggcaacacaaccatgaactcctggtgctcagtttcttcccttgctgagctgtggttatccagctttctttttgatttcatcaaagcccacaggagcttcccaataatcctcctttttgtttaagtcagccaaagtttccttttcttccctgaaaccaatataaccttaactaatgtgatgggtaaccaaggcctgacctaacgtggctttggaaatatgacccaatactttatgggacaacctcagttggaatcctgagggaaaaattaattgattgcccttcctatccctaggcattagtaactagaaatgttgctgggatcactccctgtctttaatcctccaggaatttgccttgctggggagctaatttgttactcatggctgttttcctgagaccttgtgattccctggaggcacaggagttaaattacttccactggccgtcacacccttgcatcttttgttgtttccagtactgtcaggaaggctctaacatctctctgagccttcttgtttctgaaaaatgcttttcttcatctttgtatttctctgtgtgtgtatacatgtggtacatttgcacacatgttaggaaagtagaaggaggtcgggggaagtcagaggaggagtggtcagatttcagatcactgaaccatgggttataaataaagggtgacacaacacaagcctgattagttccactcagaattgctcactgattcatcagaaaattgatccttctgacctagacactcctctctcaatagtcaaaggcagcttttgtttgagtcagtaattgtgcctctataggaattttatggagtttagcccaagaaaacgttctatccaagccaaatgtgggtatggtagaatactattgaagatattaacctacattctccgattggcatgtcctcctcttctttccctccattcaagcagccatgtggtctcagggagacatgccgcagagagaagaatgaaaagttgacaagtttttctggcttgtttctaataatagatgccataaactgatagttcactgatcttcgaacacccacacatgagtgccactgttttggcccacacagtacttttttaaagtatgatgctgttcacatgaggctcagctctccaggtcaccacagtccccagcattccttattgtctgtcacaattgacattacctgcctggcctctttctgtgtgcacttgattctgtgaccccaggcttaaacccattaagggagtttatattaggtgcctaggaagcaaacattctttcctcttaggaagacccggaagattaagagagggaaggtttccctcttaagaggaaaaaccctagggttatagtcaataatgagccagggcctcttctttgtatcacagagagtggaaattctggactctcaggcccggaacgctggggtccaaatgcctgaggagatgggggagttacggaaggagcagtactcccaagacaggatagaggcaaagaggcacatgtgagggtctcgagtcacagtgaggaaattctccctgcagccacccattaagtccccttctttttcccacatgattcatccaccaaacagatacttagtaagagttcactgtgttcactgtgtgccagcaatgaaccaacatttgtgggcttttcattatgtaatctctctctctccatccatccagattctgaactatttccaagaaaatgtcaccacttgctttacctcctgaggcaccttgaatacccctttgccttgaatgagagagagaaaattgtttttccttcattcatataattctggaatgatagctctgaaaaagccatgagagctgataaaggcctcctatctccgagaaagaaaagaaattaagaagatttggtatctttggttcaccactgtatccctagcagtgtcttgaacaatgcctgacacatagtaggttctcagtgtttatttgttgactgaatgagcagctaagcagttaagggcagagtgggtcccagttgccacatgtcctcaatctttatccaggctctttcccaaactgcaggttagcagagggaaagccaatgtttttttataagagccttcttttttttctgtttgtttttgttgtttgtttttagagacagggtctcactcttttgcccaggctggagtgcagtggcatgatcatagcttactgcagcctcaaactcccgggctcaagcaatccttgtgctgctaaattaaaaaaaaatttatatatatatatacatatatatgtgtatatatgtatatatatatataatatatataaatggagtctcactatgttgcccaggctggtctcaaactcctagcctcaagtattcctcccaccttggcctcccaaagcactgggattacaggtgtgagccacggcacacagcccccataaaggctcttaataagaaactaagagggaaaaaagaatcgtaacgggagatttaatggcagtgacagttttcagaagtgtatatgaccatggtggaagtctagaagaacctggcctaatggagccagtcttgagctgcaattcttttaactaattctcccagaacctcttgacttagttgctttcactggaaaataggtgtattctgggggttaaaaagttctccagggaaagcttcccacttacctcactgtcttggtatcccgctcttccacccaacatacaaacatgcagctggtcactcagccagtccctaaaacctgttaattggcccatagtttggctccgagcaaacctgtggacttaggagcctcagctcttgcctcccaggagtttctcaactttgggggaaggtaacatatgtgctctgaagcaagcacaatgatggctatgacaggcatttcgcagcacacgtttaaataacaaccctaggtgaggcaggtcagtgagaggccatcaatagggaaaatagcagtgtgaatctaaggcttgagagaagggagagaaggctgtggccttagtgtccagcctgctcagcatcccttctcccctcttctggtagcagcacttttttttttttttttttttttgagggaaggtctcactctgttacccaggctggagtgtggtggcacgatcttggctgactgcaacctccacctcctgggttcaagcgattctcgtgtcccagcctcccaagtagctgggattacaggtgtgcaccaccattcctggctaatttttgtatttttagtagagacggggttttaccatattggccaggctggtctcaaactcctgacatcaagtaatctgccctccttggcctcccaaagtgctgggattacaggtttgaaccactgcgcccagccttgttgcagcactgtaattatcctttaagaaactgtccccaactagttgcatgtgggtggacttggcggaactatgcattttttttttttttttttttttttttgagaccgagtctcgctgtcttccaggctggagtgcagtgcgcgatctcggctcactgcaagctccgcctcccgggttcacgccattctcctgcctcagcctccagagtacctgggactacaggcgccggccaccacgcccggctaattttttgtatttttagtgcagacggggtttcaccgtgttagccaggatggtctcgatctcctgaccttgtgatccacccgtctcggcctcccaaagtgctgggattacaggcgtgagccaccgtgcctggccgggactatgaattaaagtgctgtggtcgatgggtatgtgtggcccagagacccaaactaggccattcacactctctcttccaaggatttgaatctttttttttttttttttttttgagacggtgtctcgctctgtcatcgtccgggctggagtgcagcggcatgatcttggctcactgcaacctccgcctcccgggttcgtgattctcctgcctcagcctccggagtagctgggactacaggcgcgcgccccgaccctggctaatttttgtatttttagtagagactgagttttaccatgttggccaggctggtttcaaactcctgacctcacgtgatcctcctgcctcggcctcccaaagtgctgggattacaagcgtgagccaccccacccggccgggatttgaatcttgagtacaggaacataagggtggaaaatctatcccggatggaagctctctgaagggacctcccattaactcctgctacttggacacctcaggtcccctaactgctcttcctggggcctgccggctcagattctgtaaattctgtgagctttcccatatcattccaataaggtcttttaagggtctgcttctgtgattggcaacctgagaaccctgcttggtacaacaagggttcctggaaaatgtaggaacgtgaactggcatgagtagctgaaaaggatgcagaacttatcccagtccaggagaacatcatctgtaaggcctctccagaactctgcttggcctaactcaaggggagattccaaagggggaggtatgagaagttaggagggggatgtggagtggagccagagtggactggagggtatggcctttctcctagagcagaggttcacacaatgttgttggatacactgctgggccgtagtcgtgagagctgcagatggaggtagagccagccaacagacaagttggcaggatgcactaaaaattggagctgggcctcagaagtgggttatgctggccaaatatcatctgtctagtgtg

SEQ ID NO: 12538 - DNA, 26205 bp, Homo sapiens
acagagttttgctcttgtttgcccaggctggggtgcagtggtgccatcttggctcactgcaacctctgcctcccgggttcaagtgattctcctgcctcagcctcctgaataactggattacaggcacacgctgccacgcttggttaatttttgtatttttagtacagacggggtttcactaaaaccccagtttgttggccaggctggtctcgaactcccgacctcaggtgatccgcctgcctcagcctcccaaagtgctgggattgcaggcctgagccaccgcgcctggccaaggggctggttttggagcagagtcagaggtctgggacgtggaataggtaagggcagggcagtgcgggggagcaggatagaactgcccattggggctgagcgcggtggctcatgcctgtaatcccagcactttgggaggctgaggtgggtggatcacctgaggtcacgagttcgagaccacactgaccaacatggagaaacctcgtctctactaaaaatacaaaattagccaggcatggtggcacatgcctgtaatcccagctactcgggaggttgaggcaggagaatcacttgaacctgggaggtggaggttgcggtgagccgagatcgcaccactgctctccaacctgggcaacaagagcaaaactctgtctcaaaaaaaaaaaaaaaaaaaaaaaagaactgcctacgggcccctgggctgagatgttctcagatgagctttctagctggaactgcctggccaccttcagagacattatagcagtccccaatctttttggcaccagggaccagttttggggaaaacaatttttccatggactggggagggggatgggagggggtgggagggggatggtttcaggatgattcaagcacattacattcattgtgcactttatttctgttataataataatagaatatatagtatatataattgtttcggtatatattacaatgtatattacaatgtaatatataccgaaacaattatacaattcaccatcatgtaggatcagtgggagccctgagcttgttttcctgcaactagacagtcccatctgggggtgatgggagacagtgacagatcatcaggtattagattctcataaggagcttgcaacctacatccttcgaacacacagttcacaatagggttcatgctcctatgagaatctaacgccgctgctgatctgacaggaggtggagctcaggcggtaatgcaagtgatggggagcagctgtaaatacagatgaagctttgcttgcccattgctcagctcctgctgtgtggcccagttcctaacaggccatggcctggcggctgagggccctggtattacagcatcaggagctagagtaggaccgagcccctgattcccaccttccaggtgcccctgagccagcctccagaggatgagctggataggctgacgaagaagctggttcacgacatgaaccacccgcccagcggggagtactttggtgagctgaggctgtggggtgggtgggacgtgggaagggaggctgggagacagaggggacagtggcttcctgggtctgtgaagactgatgctgtttctccctgtcctcaggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggtgagtggctggggctgggaggagggagtcagtggctggatgcagggggcttccatccaaggtggtaactagagcgtccaagaccaaaggaggaacggtgctaaaagccaggcgactgaaagtgatgtacaaacagggcggaattctgcaagtatcaagcaagtagcttaacactggtggctgaagggaaggacgcagctcttacaagtgtggagcatcttacagttaaagagaatgtgttagattcccatgacacccctgtgaggcaggtattactactgattcctggttttgttttttgtttttttttgagacagtctcgctctgttgcgcagactggagtgcagtggggtgatctctgctcactgcaacctcagcctgccctggttcaagcgattctcatgcctcaggctcccgagcagttgggattacaggtgcccaccaccacacccagctaatttttgtatttttagtagagacagggtttcgccatgttggccaggctgttttgaaactcctggcctcaagcagtccgcccactctggcctcccaaagtgctggcattacaggcgtgagccactgcacccagcctgattcctgtttttctcatagtgtttaaataccgtgtatagtgctgggacctgaactcagatctgctcaagtctgcctttcaccgaatcacatgcaggaggctgcatgcaggaggctgcagaaattagatggctgggttgctggggttcctgttgagctgccatggctcccgcccgctcccagatcttcctgccttccttcccaacaggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggtcaggcctggcctccaccttgtctcacaatgtctgacctttcctgtctctctcatctcttcatgccccaggactgtctcttcctgtttccaaccctggccctccttcgttctttgttattgttattttttagagacggagtttcactctgttgcccaggcaggagtgcaatggcatgatcatagctcactgcagcctccaactcctgggctcaagtgatcctcctacctcagcctcctgagtagctgggactacgggtgcacacgccaccatgcctggctagttttcttcgtttttttttttttttttttgagatggagtctcactctgtcacccaggctggagtgcagtggcacgatctcagctcactgcaacctccaccacctgggttcaagtgatttgcctgcctcaacctccccagtagctgggattacgggcgcatgccaccacgcctggctagtttttttttttttttttttttttgtatttttagtagagacaggctttcatcatgttggccaggctggtctcaaactcctgagctcaagcgatccacctgcctcggccgcccaaagtgcagggatagcaggcgtaagccactgcacccagtcttcttctttgtattttaataaagacagcgtcttgctgtgttgcctaggctggtcttgaacgcctggcctcaagtgatcctcctgccttggcctcccaaagtcgggggattgcaggctagagccactgcacctagcctctctcattctctttgacatcgtcccttccccaagacctaaggccatacctctggcctctctgattccctcctgtgccccaccttctctgggttccattgttggtgccctgcaaccccaaggcttgatggccttcttggttctcttcccctgcaggaagtttgccccaagatgctcagtgtgcggtggggccataatgcctgagccaggtcaggaggagactgtgagaattgttgctctggatcgaagttttcacattggctgttacaagtgcgaggtcaggggcccccagcacgtgcaaggggctggcagtgtctagggtgctgggtagagcatgagggggaacacagaggtctggggttgatggaaacctgttgcttctttcttttttttttttttttgagacggagtcttgctctgttgcccaggctggagtgcagtggcacaatcttggctcactgcaacctccacctcccgggttcaagtgattctcctgcctcagcctcctgagtagctgggattacaggtgctggccaccatgcctggctaatttttgtatttttagtagagacagggtttcaccatattggccaggctggtcttgaactcctgaccttgtgatcctcctgcctcggcttctcaaagtgctgggattacaggcgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacacttccaagtctgttgtctcatctgattctcccagtagcccattacaggcccagtcattgttactgcctgcattttttttcttttttttttgagacggagtctggctctgtcacccaggctggaatgcagtggtgccatctcggctcactgcaacctctgcctcccaggttcaagtgattctcttgcctcagcctcctgagtagctgggattacaggcgcccgccaccacgtctggctaattttgtatttttagtagagacggggtttcaccaccttggtcagggtggtcttgaactcctgacctcaagtgatctgcccgcttcacccaaccaaagtgctgggattacaggcgtgagccaccgcccttggccactgtctgcatttttacatgtgaggatgtcagagctgagaggtgactcccccagattgcatggttcttaaatggtggaacctgggtctttttgactcaggtccagttttttttgacaactcttgtaatccgtcactaccctcctctcagtgctgggagcaagcacgcctcagggaggaggcaagatttcctctatgtatctattttgagacagggcctcactctgttccccaggctagagtgcagtggtgcaatcaaggctcactgcagccctgaactcctgggctcaaacagtcctcctggcttagcctccccagtagctaggaccacaggggcatcccaccaagcccagttattatttttttgtgtgtagatgggatcttgctatgttgcccaggctagtcctgaactcttgggcttaagtcctccctcctcgaccttcccaagtgctgggatcacaggtgtgagccaatgtgcctggccctaaatattctgtaaaggggccttgctatgttgcccaggcaggtctccaactcctgggctcaagtgattctcccacgtcggcctcccaaagcgctgggattgcaggcgtgagccatctcagctggtcttcctattaagtctcacactcaattcactgagaggggccttggtgttactcccgggggtggtaatccattgaatctgggcggtccatactctgtttagggcgttaacttacagcctatttcatccaaatactgagcggggttaagactgagatctgccaattttacttaaagacggggcgtctttgtcgaggaaaagcaggaacggcggactttgcatttagtgcgcactgtggcacccaattttggctggatatttggagcagaaaatggtgggatacgatgctttaaaatggttgcttccaccttccatcccctaagcgcctgcgcttcccaagcccacgccctgcccgaggaggggacgaaatcacccccggtgaggtcaggaggcccgtggggggaacatggctggatgagaaccgtcttaggaccccgacacatctggggtcgcgcgatcctcgacttccgctctcccttcgcgcccagagggcttgttcgcctcccgaggccgcgcttggcccagccgaggtcccgtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggtgggggccgcggagggctggccttggcgggagggaagcgggcgagctgcccgcgagggacggtcccttcctccgctcgtccttttgcaccactcctaccgcctctccccggtccccaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacaggtgagccgtttttaacttcatcttgtccccgtttcatgccgtttcactccacccgcgtcgcttttctttctcccccttgtaatttttatgagggcgaatcctatgaaatggctcattggaccgttttctgtggttcagcctatttgctgttggccaaataactagctgtggcttggtttttgaaattctctgcagatcagagctatagagctaagartttgagtatgaagaagcactgtttatacatgcacgaaaagcgtgcttttttgcttttttttgttttgttattgagatggggtcttgttctgctgccctggctggagtgcattgatgcagtcgtagcagcctccacctcccgggctcaaccgagcctcccgcctcagcctcttgagaagytgggactccagggggaggccatcacgcccgcctaacttttaaaaattattattgttatttcgagacagagtcttgccctgtcgcccaggctggagtgcaatggcgcaatcttggctcactgcaaccttcgcctctggggttcaagtaattctcctgcctcagcctcccgagtagctgggattacaggcacctgccaccacgcccgtctaatttttgtatttttagtagagacggggtttcaccatgttggctaggctggtttggaactctcgactttaggtaatccacccagctcgacctcccaaagtgctgggattacaggcatgagccagtgcttggtctaaaattattttttgtagagacagcgtcttgctctgttgcccaggttgtaaattatattttaggaggattgcttcagaaaaataataatatagagttgatctgactggagaggtcgtcagattatttccctgacaatatatgattaggtttcttgtcactgttttgcctaaaatctcagagttcatagggcggtgctgattggattgattataagatgyggttattgaccttagggtgttacagtgagcttggcatgggggatcagaatggcagtggatgtattctgtaaatgagtatatatagtggaagttataaagagggtaagcattgagggaacagatctctaaaggaggggagcggtgctggaggttgtgtgtcagggacccactggaaagtgacacttggctagacttggaaagatgagtgggaattccccagacacgagtgacatgaacagcttggagttgtggacataacgtgtgattttagcatattctagtttggttagagtcctgtttctcaggatgtccacagaccatagggggtctccgaggctaaaattagtttttgtggtaatgtttacatattattgccatttccactgttggtgccatagcaatgatgggtaaaaccgctgatgctttaccaaacatcaaggcagtgacagcaaagagttaaaaaaaaaaagccagccgggcccagtggctcacacctgaaatcccagcactttgggaggccgagacgggcagatcacgagatcgagagattgagaccatcctggccaacattgtgaaaccctgtctctactaaaaatacaaaagttagccaggcatggtggtgcgcgcctgtagtcccagctacttgggaggctgagacaggagaattgcttgaacccaggaggcacaggttgtagtgagctgagatcacacccctgcactccggcctggcgacagagcaagactctgtctcaaaaaaaaaaaaaaaaaaaaaagccacttccatcaatgattcttgatgaaagagtaaaacatttaaatttgattagattggactcttgactgtacgtcttttttaaaaaaatttttttttgacacagaatcttgctctgtcacccaggctggagtgcagtggggcgatctcagctcactgcaacctccacctcctgggttcaagtgattctcctgcctcagcctcccgagttgctgggattacaggtgcgtgccactctgcctggctaatttttgtatttttagtagagatggggtttcaccatgttggccagctggtcttgaactcctgacctcacatatccacctgcttcgacctctcaaagtgctgggattacaggcccgcgttagttgtcttgagcaagagtacgcatgtgattgagtgagctgaactaacagcttttttccatgggatgttatttttacttgaatgaatgacaaacagtgattgttcatacttgggtatttggcagacatcttgaaaatgaactgagaacctgttacttcagtgtaagctgttggtatttgttgccagtgatgaagtagaactttccagtgaaaattaaaattttgggccggcgcagtggctcatgcctgtaatcccaacactttgggaggcgaaggtgggtggattgcttgagcccaggaatttgagaccaacctgggcaacgtggtgaaacctgtctgtacaaaaaaatacaaaaattagctgggggtggtggcacatgsctgtagtcccggcaactccggaggctgaggygggaggatggcttgagcctgggaggtggaggtgggagtgagtcttgatggcaccactgcattccaacctgggcaacagagagataccctgtcaaaaaaaaaaaaaggaaattaaaattttggaaaacttctactaatgtgagcttgacagcttcccattaagtaaagactttcttggtgagataggcagtgatgctgatgagtacattttgatattgggtgagacataatccaggtccattgaaagggaaagatagaacagtggattttaacgcagcagagaaagaaatattcactgatactatttcagattgaaggttctaactagcctgtgagaaactacttccttcttggacaaggtagcataaagaaaagaaaaaaaagaacctacttcttgttgaattttgggtagtatccaaaatgaatatctacagttaatctgaaaaggcctttccaactccttatcagtatgaggcctgattttctgtttttttttttgagacgggtcttactctgttgcccaggttggagtgcagtggcacgatcatggccacagatcactgcagccttgacttccccaggcttaggtgatcctctcacctcagcctcctgattagctgggactacaggtgtatgccatcacacccagctaacctacttccttccttccttccttttcttttcttttcctttcttttcttttcttttccttcctttctttctttttctttcttttctttctttctttcattctttctttcagatggagtctcactctgcccaggctggagtatagtggcgtgatctgggctcactgtaacctccatcttccgggttcaaaacgattctcccacctcagcctcccgagtagttgggattacaggtgcctgccaccacgcccggctaatttttgtgtatttagcagagacagggttttgccatgttggctaggctggtctcaaacttctgacctcaagtgatctgcctgccttggcctcccaaagtgctaggattacaggcatgagctaccacttccagccagccagctaagttttgtatttttagtagaaaggtggtttcaccatgttgccccagcctggtcttgaactcctgggctcaagcaatccactgcttcggcctcccaaagtgctagcattcattacagatgtgagccaccatgcccggcctgcctcatttttcaagcagaacaaaatatctcaacagattcagtgtagaagctatcctctacaaagccagaacttggagagattggtgacaatgtaaaaacaatgccactttttctcaccaaaatttttctggaaaacgatttttcataaaaacatgtaatgtgtttcatcttactgtgtaatttaaaaatgaaggttttggaacatttygttttaattttgaatatagtaagtatcgatagatgtaacccacataagcagaaactctttggtgtcctcagtcatttttaagagtattaaggggctgaggcaggagaattgcttgagcccaggaggcggaggctgtagtgagccgagagtgattgtgctgctgcactccagcctgagcgacagagtgagactgtctccaaaaaaaaaaaaaraagaagaagaagaagatgaggatgggggaggctggtgattggttgggaggttggtgactggtggagaggctggtgactggtcgagaggctggagtgacagccaggagcccaagttaaaacaatagtgttgcttactgacattgaagtaacggtgtgatgtgatgagacttgtgtttgaggaaggtctgcctgccagtggggagacagaagcgagagaccagaagcaggcgggcagccagggctgcaggagccacactggccaaggacaaagactaggacagggtgtgtggggatggcagagagtgggacagctttgataggctttgaggcagaggattagcaggagcagtaattagcggtgagggtagtgaatgacagctggcragagatgctgttccgttgatacagcagagtggggagcgggaggaggaaaagacatttgggcccatagtggtgggatgaataggcttgattcttttttctttttttggtgggggggatgaagtcttgctctgtcgcccaggctggcttgcagtggcgcgatctcggctcactgcaagctccgcctcccgggtccacgccattctcctgcctcagcctcccgagtagctgggactacaggtggctgccaccacgcctggctaatttttttttgtatttttagtagagactgggtttcaccatgttagccaggatggtctcgatctcctgacctcgtgatccgcccgcctcggcctcccagagtgctgggattacaggcgtgagccaccgcacccggctgaataggcttgattctgacaggctgaatttgagggggtgatggacttctagtaggggatgatttttaaaaagttttctgttttatttttagagacagggtctccctctgtcacccgggctgagtgcactggtgcagtcgaagcttgctgcagccgcgacctgcccgtaagtgggcctgtagcaggggtgattcatgtgggtctggagcacaggcggaaggccaggctgggagaagagttggagaaccatcagttcttgggtattggctgaactcatggagttagacaagaatctttgttttgttttgttttgagacagggtctctgttgccagggctggagtgcagtggcttgccctgactagagaaaaatctttttctgttaggagcgaagttttataattgtaggctttttagtctggtatctcagggtgtaagaagggcctgtttaggaatgtggctgtggcatatccagctgtatctttaattattgttacctttttaaaaaataaaaaattttttgtagggatggcggggggcgggggggggtctcactattgcccaggttggtctcgaactcctggcctcaagtgttctctgcctcggcctcaaaagtgcttggattacaggcatgagccactgtgcctggcctttaatctttgttacttgttcttactgccagagagtgggaccgtggccgtgagcgccgtagtcggggtgaatatcgggactatgaccggaatcggcgagagcgcttctcgccacctcgccamgaactcagcccrccacagaagcgcatgaggagagactggtgagatggagcggtttccctctcctcccctttgcctcagttccacctgggcctcccctttctcccctcacctgtgcctaaatctttgtcatttccttttctcaacttcccatcacccatcgttactttgtcmcttgaaacccttgtctgggagaccatgctgtgtgtacccccgtctgtccatcctccatgctctggggaggtgactcccttctctgctttacttttgtgtcccccaccttcagggatgagcacagctctgacccataccacagtggctatgagatgccctatgctggggggggtgggggcccaacttatggcccccctcagccctggggccaccctgacgtccacatcatgcagcaccatgtcctgcctatccaggccaggtaagggtggggcttctcagaagagggttggtaggcctgggggatggatggggttgctgaaggccatggctgaagccagggagcgggtcaggcacacagaggcatgtccctggggtaggggtggtagctgttggggtttggggtgatgtccatggtggacaaagtaaaggggccccagctactttggcccctgtagcctcccaccgttccccaaaaaccaagccttcctgaccggggtcccctccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtgagtgcccctacttccctggacctctgccctggcatgtccccctggccccgctggtggagccacagccctgtcctcttcccagttttccctgtccagaactttctgggggcgggggtcgggaagtatgacagcattggctgatggggtctccccctcacttcagcaactgccacggcccccgccccgccctgtctcctgtcctgctgtcctcagagagtgggacacctccaggcagcaggccagagccacttggccccttggggcagcagacagactgcttcccacttgttggtgttgggtcattgtcatccctgatcaccaggaccctgtgtggctgtggcgtcctcctaaagcgacgagtgaatccagacaagaaaagcaaagatctcggtcgtttgacagaaaaagaattttaatttttttttccttttgtggatgttttaattttaatcaaccatcttttccccccttcctgctcctcctcctcctcatcctctttctgctcctcctccttgaaaagagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtaaagatcctggaggtgatgcctgcggctttcctttcctcttctgccccactcrtggttctgttctgtcttcgctgtcccctctctcgaattgctctrtgtctttgtcctaatctctcagcaccttcattcttctctgtttctgttcttgctccctgcctaacaccaccttcttccctgttggtttttttagtttctctctctgatctttagtttttccctttgttttcggtttctgggactttctcacactctcccctttcctccctttccccttttcctcatactcctcatttcttctgttttccctctgaggtcctatttgaaatgttttatttttcttctccctaaccttccagccctctcctctctctccccctgtgggcaggacctgaggctctaaagggcactccagtgtctcccttcggtctttcctgtcccttcaccgtcttgcttatcttcccacgggtggagaaaggtgccctgcctctgggcttttgctatctggccctctgtcttccacctcggggtggagggagttggcgggagcagtttttgaatgactgcagtttggggttggtgaggagagggaggttcttcagggcctgctatttcctgagccttcctctctgaagctttgggaaatgacacctttttactacgttagtgtttcccagagatttaaagtggtaaatctgcctctcctaccctggcgtccccctgtagtcattggtcttcccaaatccagagctcttagttcctggttctcccccaaatcttcacagaacacaacttctggttccttttggggtgttgggtggttctagcgcacccctatcccttaatctctctattttgatgaccttttgtggttgtgagaggaagggggatatgccctgtctttcctgggccccttcccacatcctggccttggcttccaataactgttttgtctttccctcccccgcttcgttcccaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcaggtgtgcggatttggaggggtggcaggcatctgggccccatgggggtgggggtgtctggggatcaggtagaagccggttgacaggagccagggccctggggtcatgacctctgttccctttgttggtagccgtgattaagatggaaggaggcacggagaatgatctycgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggtccgagccctgggtctcctagtgttgtccctggcagcctgggggaggggggcgggtaggggtccataggagctagaagtagggggctggggaaaatgaacctgtggcctcagctgtgggggtgggggccctctgataaaggtgggaggggaggtttgacatccccagtggttgtctcttaccataggctgagaatgacagttctaatgatgacaaaacaaagaagtcggagggtgatggggacaaggaagagaagaaagaagactccgagaaggaagccaaaaaggtgaggtgtctgtggcctggggtcagagtgttggggctggggttctggyacgctgacttgtcccctstgctgtggctyacacagagtagcaagaagcggaaccggaagcacagtggtgacgacagctttgacgagggcagcgtgtcagagtctgagtcggagtcagagagcggccaggctgaggaggagaaggaggaggccggtagggtttcttttctgctttaaagtgcgttctccyaatgcgggtggggaggtgagagrttggcgacattgacgggagggtgggtggcttttaggggaaagcttctgtatcctccccaccacaatcagtaataaaaatgcaccaactccttcctaccccccttcctgcctagaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccgtgagtggggacccgtggagtcagggcagggctgatggagaagtggagggtagagggaaggcagtggggccctgcctgtgacagatgcccccgtttcacctgctagggaggccccttccccaggttccatggcctccgaggactagtcctgatagcgccattggctttcaggtgctggtgttctgaagccctttagtggtttttccctgcccaaggatgggaagagtgataaggcagttagtccctagggttctgagggcagtgggggattggaggaagaagcgaatgaatccttgagtcactgtggggctgcttttctgcttcttgcagctttgtaaaaggtacccaggctttatgcgggtggcgctctcagagccccagccagagaggaggtgagtaactcggtgcgttggagggaaaagtgcaggggaacgttaatggccaacaccaactccctcgcttgactatgctaacattttctttcttgtgtaggtttttccgtcgtggctgggtgaccttcgaccgcagtgttaacattaaagagatctgttggaacctgcagaacatccgtgtgagtgctgggggtgggactgtggggaagaggaagggagactctgtgccacacgggacctctgtgtgactttgttcatctgatagtttggttgttctgcacactctttgaccgttttgtctggctacgttgtctctgggcaaggctctagggcgttagcatggacggaacctatgtggtccccgtccccagggagctcgcagtctgatcaatcgctggtgctcaagagggaagggtcttagagctgctgtttctctggcaagcggggtaagtggggtaagctgctgatgatgtctgccctccagctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacggtcagtgactccccaaaggactttgtcagaagcaactggtagtgcctctgctgtgggcacctctgaccttacctatctgtagccttgaacccttgcacccactcgcctgctcactcatttgccccttcgtgtgtgggtagcagcacctccagattccagcagaactggggggatgctagtgatcatttgtggctggggtggaacaaaagctaaaataaagacaaatctcaagggggcaaaaggtgccatttatgtcyggtgaactcctgtcycctcgctgctctttcacttgtggaaagtctcaggttacctcctctgaaggtcktctctgccttacttgcttctcttcctcccatcagagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtgccagtggcagcgcggggcacgtgggggctcgggcggtgagggcaggagctgaacgctcscattcacttcccttaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaaggtgagctccaggttcccctttgttcccggctgcccctggccttggtcctccagccccttgccaccatccttccttctggctcccttgccaaccttycttcctctgttcccaaaccacagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaaggtgtgggatgttggagaatggccgtgctacggtggtgggaggtggggttgagacaggaagccccctgggcaggggtgggggaactgcttactgcactggcaggcgggagctgggaatccttccagctcgggcctgggagcgaggcaacccttatgtggctgtcctgacccctctcctctctccacccagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtaagatacgatccatgaaggtcgcatgtgccctcttccttgastayccrgggactcctgtttctctttaacgtgtcacccsgagaagtttctgccccatcctcaggccatagccctagaagtcaattgtacccgtatccccctccccgcccccgcagtaattcatgtccctgtccgtgttgtactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatagctggtgctgtccgccctgcagtccccacaggaggccctccatacccccatgccccgtatggtgctggtcgagggaactatgatgccttccgaggccagggaggttatcctgggaaacctcgcaacaggtgaggagggcrgacgcccaagctttgttgmcgcctgcagactcccttttgggagccctcagctctcatcctgtacctctcacytcacaggatggttcgtggagayccaagggccattgtggaatatcgggacctggatgccccagacgatgtwgatttcttttgagccgtcccccgttcctcagtcctgtatcatccatacttgtactaccttgtcctatgaagctctgagaattttttgtacgatcagccttactgctaataaaagcacttccmcagggctcctgactctcgtgtgttacataactcctccatccttccagagtaactcctgaggtgttgctcagccctgccacttttattattgatgtcaaaagcgccaggctttgcagggacaccagtgggaggtacataggtgcgtgtctgggacccgagaatctcagttctgtaacttcgtcctcagtccaaggtgcgctgctgctgttgggagctaaggctggtcaagcacaggttgtagaaggagttggggtcaaaggctgcactcacctcttgccagcccacccacccagcagcctgtagttcactggggctttttggagtgccccagtagtgagggtccaataccaggacataggcttccgtgcctgaccctacgcagactcccagcaaggccttggacctggcatctgcgtcccccccaaccatgactgggcccccaccccctgcgaagtgcgagtaaagcctctccagctccccgtgcagccccactccccggggtacgtggcagaggcgtccctggggccctccgaagtgagcgaggcagaggctggcctccacgcagccgatccagtcccgggagccccggaagccggggggcttgtcgcccatgtcctccagggccgcctgtacggcggccagtccaggtacgcccgcgggctggccctctggccacgagcacagcgtctgcagagtgcggtagccgcagccccagccgcggtcgtccaggccgtcgcagccgtagtggtagtagaggtagtggcccgagagcagcgccaggcggacagggccgcggctcggcggggacaggcccacgtggacgtccctcagcggctccagggcggtgggcgggagcggaggtcccaggccaggcacagcgtcctcctagcggcgcggagcgacctcaggctccaacacttcctttcggctccgggtcttgggccagctgccgcaggaccggcgcgcagactggggacgcgctccccgggcctcgttgatcaccgcaggccgcaataggcagccaccgaccggcaccgaccgaggagctcccacaatgctccgccgcgccccgccccgcccctcccctcccctcccctcccctcccctcccctctcctcccctccgccgtgccagctagcctgcctgcgggcctcattacgcaggcgcgagctccgcccggcagggcagggctaggggttggcctttgccttgcgcccgcctcggagctcgcctgtttcttgccctccagccccgctcctgcatagactcggcccccgtgattccggcgttctgcctctacccctggctccctagtcgcgcacactcccgtggctgtaacagtttattggcagcccagaggggcgaaggcaccgcgggggagggagctcagcctgagacatgcagaggaccgggagccccgggggacgtcggggtggggtggggatgggcagagtctggggctcgtctgtgttatagcccagccctgaaataaatagtatatacagctagggggccgggcggagcggaggacatgggggtcccgccggggtcacaggtctgagcagcgatcctgcttgctgtagtggtcgaactggttcttccagtgcaccatgtaggagctccagcggtggaactcggccttccactggcgctccgcctcgtcgagcgtgtctgcggccagggcgcccagcgaggcgggaggggaggacggcacgaggaaggtcggggatcggacatttgggcgggttgaagggggggtatgagtgcagggaggacgcacggagaaatgcaggcgaccacgtgggacggtggcaagaggatcaggagaatgtgcgaaagacgagagggaggatgagggcagaggcggggccggagaaggacagcaggaaggagagaggaggagaaaagaatgaccggaagacgggaacagaggggacaggagggggaggttgggggaaaaagaagagacagaaatggttgaccgttatagccccaatggggggtgctaccccgtccggggcctcccacttccccccaatgtcaggctcaggttccaaaagataattttataaaagaatactggcttttccatttccattcaaacaacaaaggcgtgggggtccctgagaagggtgggaggcacggccccctcctcctgccctgtccagtgtgagtctctcggtttgaggaggaagggagcactaggtctgagatccctgagtggggcccttccccacggtccgaccactcattagaggaggggcccctgtggccgtaggggaagaggccgtgttcacagccgccggaggtgggagaggaagaggaggagaagctggtggaggaggaggaggggcagggggaggccgggcctccgagcagcctccccatgggtgaagcctgggcaggtgctgggagcctccgaggctagggggagaagagaggggttacacctggcgggctcccactcccctcctcccagccgctgcccgctggcccctgcataccggtggcgctgagcaatttggggaggaagcggttccagaaggcgcaggcctgggcgcgcagcccccgccgcacctccagcggccgcaggtccagactaacgtactgctgagcccccgccgtgtacgggggccattgtggggccttggggtctcggggctcattgggatccctgcggaaggaagggaaggctcagtccagacgggcagtgggaggaggtggcccccaactccacgggatcccggactcttcagctcagcggagagccccagagaacccgtcccctccctcccaccactttctccaatgtgcgcggtcattggggtcttcccttcctcaagcgctccgtctccttccgtttccctcagcttttctgttccatctttgtttctctcactaaaaaaatggctaggatgtcttgagactttcctaaataaccaggacgggtcctatgtctacaaacatcacattttttaacaacacccatccaatgctagatttcattgtcctcttctcgatccaggtaaactggtgtgtgtgtgagagaatgtgtcactgctagtgaatcatcactggtttgacttaatccagctccaactcctttgtcttggtctcccttttttttttttttttttttttccagagatagggccactcaggctggagtgcagtggtgccatcatagctcactgcagcctcaacctcccaggctcaagcaatcctcctgcctcaccttcccaagtagctgggactagaggcacgagccaccgtgcctggctaagttttgtattttttttctttttaagagtcggggtcttgttatgttgtccagtctggtctcaaactcctggcctcaggggatcctcccaccttggcctcccaaagggctggaattacaggggtgagccactgtgccccgccccctccatgtctacctcgtctcctcctcactttcctttgcctctgtctctgcaagaccccctctgccttctctgtctcctttctttttctctccccttttatctactttgtgagcatatccctctctggctgttctatcctgcccctgtcccacccgtcctttctgtctccgtgtgtctgcctttgtgtgtcctcccgcccccgactcctgtcctccccagccttctctccctctgcactgctgaccctgtgcgggcaaagttggcccagtatcgcatcagtcgctgggcgaagattttctcctctgccgtgtagtttcgagaggggtccagggggatcccaaagatgaactcgatctcgtagccgtggggcacccccatccacaggggccaggagagcgtggaagcacggtgttcaaagacgtaggcgtagacccgggcaccctgggcagccagtcgcccagccagctgggccacggggcacacgacattgtggtcgcccaccacatcgctcagggcctccctcaggcgtgccgggtcctcgggatgcagccagtctgtgtaatgcaggaccacagcctcggctgccaggtcacttacctggggaaccccgacccgcaccccggccaggaactcggcccggctgatgagagactcgttgtctttgctgaagcctggggccccgtaaaccagaaaatacgagccctcatccttcaccacacccaccagcacctgggggtgagggagaggggggtgggatggagcgacaggcacagacagacaagtagacagaaacagatggacagacaaagagccagagagatgaacagttacagacccggaaccatggacagagagaggacgagatcaggggagggatgcagagaaagagaaaatagacccatggtggctttcctgtctgccctgctgaccaccctgggatctgagccctcagggaggacttctgggacttctgggaatgggcctggagaagccctcatgcctgggtccctgcagggaggggagggaccgttgggacccagaggagccagcttcacgccagctagccactagttacctgcaggccgtggaagtctcccgcgttgatgagggcctctggggtgtcactgaggaagtctccatctaccacaggcacgaaggagaaccggaagacgctttcttgaggcagcacgtgccattcgtggttcaccaggacctgcgctggtcgtgtccgaaggcaggctaccagctctgtgtcattcccaccagtgccgcctggaggacagcccacaaggtgggccagctgcgtggccctgcgacgggcctctcccatgcccaccgtggcccagggtccattgggggcaccgctctgcagcacggccctgtggaacaggccccggctgggcggggacagcaggtgcatgcccaccgaggcggctcccgcgctctccccaaacagcgtcactgatgtcgggtcacccccgaaggctgccacgttctcctgcacccactgcagggccagcctctgatccaggagacccacattgcccggggcctctcggctccccggcagggccaggaagccaaaggctcccacccggtagttcatggacaccagcacagtcctctcggcctgtaccaagaagcggccatcgtacacgtccaaggaggaggccccactgtagaagccacccccatagatccagacgaggacaggggtgggggatgtaggccgggggtatggtgtccacacgttgaggtacaggcagtcctcgctcagctcacggttggggttccacatctcggtgccctcaaaacctgggtatagggtgtccacatattggtagcagacactctggaaggttgtagcgtctaccacccctgaccaaggctgcttgggctccggtggcagaaagcgacggggtcccatgggtggctccgcaaaggggatgcccaggaaagcagagacagggcccccgggggtcttcaggcgaatgccccgcagccggcccccacgcaccgtcaccagcagctctgcatcctcccggccctcagcccccactcctccacccaggagccagaggaggaggagaaggagtggggaagccagggaaggcgtgtgcagcagacactgcgggggcctcatggctgcagggcaggcggcgtctgctgggagaaagaaagggaaagggtgaagggtcggtcgagaagccaggagggaggagattagggcactgtcggcccaagggttatcgctcagctgcagaggaggtggggcaggttggcaaagatgaggggagagagggagggagggaaggagacaggcagagacaaggacacaggccagcgggcaggaggggaaagagatcaggcagacacccatatccagacaaatgcagggaacagagaggagcaccctctctgctccgcaggggtccactgccctcacctcttcccggaactgggccgggcccagctcgtgcagtgagggcaccagaagcctcagtccacgaacaggccacccgacaggggcgcggcctcacggacgggcagcgccgctgggggagcttgcggcggcctgaaggcgcagccccgctctcctgggtcggccagacccggggccctggggggcggtgggctgggcattcagggtgtggaagcctcaggtcccggggtcccccaaatcctgcctagtccactccccacccaaccctgccccttctcatccaatgtctggcaccgagcgctgatgcccgcgggttcccatcagctgcgcacgctcccagcccagccccagcaaacaggctcgccagcccgcgtcccccaggactcgagagccccccatccgtctgaagctgccgtgcacgccgccgccggcggagggcagtagagaccgagaaaaggtcggcgctccccgccccgagccaggagccgggaacttggggagggggcctgggggctcgagggccttgcagagccgcctgaagggcgagccgggacgcctgcgttcccgggactccggagatccccggctgcaggggcgggggcgctattttgggggcagcagctgctacggttccggcatct

SEQ ID NO: 12539 - DNA, 78555 bp, Homo sapiens
  misc_feature (1)...(78555): n = A,T,C or G, or insertion/deletion polymorphism (see Tables 1-2)
gatcttgggttcccacagaatgctcaccctagacggcaggagtacaggtgcgtttccaagtgtaaacctgtccctgggcaattcccttctagaagtttgtttttcagcctgcaactcttccatgaactcgacttgtctagccaaccccctacacgtcaccatgaggctctccagtaagtgccgcgcaccacgcctccccagcacagactccagattattcggcacccacctggccctctcctagtcttctcatcaatttttagcatcctgggccagaaacctggggtcaccctccccagctgtgagctggtggaagtctgccattcaacccacctagactgccaatgaaaagaaccaccagatgccctgtggggcaaggggctgtggctaccctctctctcccccacctgtggaccaggtccccgagagccaggcagccctttcctgggagccctccctgcattcctccggctggttagcccagtttggggttctgccctggtaggctgatagcccctcacctcatgccgaggctgctgccccgacttgcaggaaccctcagatgaaggaccctaaggagggccagctctgtgtccatgcccacttggatcttgagagctgccccaggcacgtgtggactggtagtgcccctggactcagagctttgggttttgcccaccctggagctgcccggctctgttcctcagcatatactctcttcctcattcctacttcatggttatatgtaaatgcaagcacacagaagttttctactttaaaactcagaagatcagcagatcactgctctctcctggtgctctggggagccacgtggcctctctttgcaccaaaactccccatccaagtccagctccactctctctctgcctcagctgccctgcagccctttcctcttgctctttgatgttttgtaggcctgcagctcccaagcacagaggcatgagtggggagaatgtcaccaaggtcagcaccttcatcctggtgggcctccccacggccccagggctgcagtacctgctcttcctcctcttcctgctcacctacctctttgtcctggtggagaacctggccatcatcctcatcgtctggagcagcacctccctccacaggcccatgtactactttctgagctccatgtctttcctggagatctggtacgtgtctgacatcacccccaagatgctggagggcttcctcctccagcagaaacgcatctctttcgtcgggtgcatgacgcagctctacttcttcagctccctggtgtgcaccgagtgtgtgcttctggcctccatggcctacgaccgctacgtggccatctgccacccgctgcgctaccacgtccttgtgaccccggggctgtgcctccagctggtgggcttctcctttgtgagtggcttcaccatctccatgatcaaggtctgttttatctccagcgtcacgttctgtggctccaacgtcttgaaccacttcttctgtgacatttcccccatcctcaagctggcctgcacggacttctccactgcagagctggtggatttcatcctggccttcatcatcctggtgtttccgctcctggccaccatactgtcatattggcacatcaccctggctgtcctgcgcatcccctcggccaccggctgctggagagccttctctacctgcgcctctcacctcaccgtggtcaccgtcttctatacagccttgcttttcatgtatgtccggccccaagccattgattcccagagctccaacaagctcatctctgccgtgtacactgttgtcacgccaataattaaccctttgatttactgcctgaggaacaaggaatttaaggacgccttgaaaaaggccttgggcttgggtcaaacttcacactaagacaactaaatgtcctagagtaaaatctgtagtgatgaaacaacattgtatgtggcactttgtgctctttaaattaatttttaagttaaatttaacaaacctacagaactaagtgaaatttaacaaacctacacaactgtgcacaagtaacaagccttcgtctgcatatgttttcacaaaaggactgtgctcatggaaccagctcccagatcaagaactagaagctgccttcacgccctctcccagtcattaacccttctccacaaaaagcactgtcctgacttccaaaaccagatgctagcattggtgtttctgaggggcttacacataaagtatgtgccctgttatgttcagcttctttcattcaccgtgttgcttgagtgaatccttgatgtttttgcatgtaacaataattcatgcattctcattgctatccaatattcataataaataatacatttatactgtataatacacaatgcataatacattcatactgggataatacatatactgggataatgcatatactgtattgtgtattatatatacataatacattatgctgggtgaaaccctgtcccacctgtcccagcaggtgtgagccactgtgctcatccataatttatgcatctaaacacagataaggtaagtcaaaatataatgtcataatcttatgggaccaccatcttatgtgccgttcagttcatcattcaccaaatgtcattgtgtggtgcactactgcgtcagttgagaatatttgtgctggcttatttctggatcctctgttctgttaaattgatctacgtatctatcaatatcacaccctccatccatacaacacagtcttgatttatatgattatgtagtaaatcttaacactggaagagtgactcctcccactttattcttctgcttcaaaattattgtggctattgtacagcctttatatttttatataaattttatagtaagcctgtcaatgtctacaagagaacctcgctgagattttgctagaaattccattaaacctaaaaatcaatttgggaagaactgacttcattactctgttgagtctttcaatccatgaacatagtaaacccctccaattattgaggtcttcattctttaaatcagtgttttgtactttttaatatgcagattctgtgtgtgttttgctggatttagacctaaatattatattttctttgaagcaactgtaaatggtattccatcttttatttcagtttccttctgtttgttgttagtacataggatgcagctgattttcatatgttgacattgcagcctgcaaacttgctgcgctcactcattagttccaggaggtttttgtagattcctttgggttttctatgtgaacagtcatgtcaactaaaaatagacagttttatttcttcctttctgatctgtatgaatttcattttttattttttgccatactgcatggcctattactagaacttccagtgctctgttgaataagagtgggcagagcagatatccttgccttgtttcctccttagaaggcaagcattcagtctttcatgattaagtacaatgatgcagagttttcacgcatgtgctttatcaagctgaagcagctcccctttagtccttatttgctgagagcagtttttgtttttatcataaatgagtatttaattttgtcaagtgatgcagaaaactgcatcaggcaatctggtcatagatttcgtctttcacctgctggtaaggtgtattacattggttgattttcaaataccagattagccttgcatcttctgaataaaccaccttgggttgtggtgtatgattcatttcatatagtgttggattcaatttgctaacatttcgttaaggatttttgtgtctaagttcacgagagatattggtctattggggtctgaagttattttcatgctgtctaatatagtgtggacgtcaaagcgacctcctagagaacattcctagctctcagaacgttctagctggggagggaaaacggaaaaaggggggcgagaagcggagggacggggaagtatatagtaatacttcccttgaaccagtaaaactgtaatgcccaacctggtttttactaactgttttcagactctcccttttcctttaatcacctagccctgtttccacctgaattgactctcccttagctaagagagccagacagactccatcttggctctttcactggcagcccctttctcaaggacttaacttgtgcaggctgactcccaccacatccaagaatgcaattaactggtaagatactgtggcaagctacatccgcagttcccaggaatttgtccgattgataacgcccaaagccccgggtctatcatcttgtaatagtcttaaagcccctgcaccttgaactgtttactttcctgtaaccatttacccttttaactttttgactactttacttctgtaaaattgttttaactagaccccccccccttcctaaaccaaggtataaaagttaatcaagccccttcctcggggctgagagaattttgagcgttagccgtctctcggtcgccagctaataaaggactcttaattcgtctcaaaggtggtgtttttctaactcgctcaggtacaacaaaacatccacgcaaacaggttgtgagaagttacgtctgcgtgctgtgatacctagaggaaccactacgaaaactatacataatgatatttcccaagacattatcagtaaatcaagatggaattctaaaaaaatgtactgtatccattggaaggcacaaaaaaaaaaaaaaaaatgcaaaggaaacaaggcaaaaaacagcagacatgaaccctaaagcttgttaaatggatttcaggtgccctccaggatctaaaaaccagaccctcctgcgttggggaccgggaatccgtatttttgacaaaaagcaattcttcaattatagaaacatccatagaaccggccgtagtttacacagctgcattcccactgttttacaatcgcatgatcatttctgaaaagttgaaaacaaagttaaagaatatttaaggggttaagaacaaaaagcctggggaacacaaaagattataaaaacccttcccaacagcaggcatacttggaaggaaacctcacatgcaaggctccttcgtggagcccagagcccaggtcctgacgggagcacattttaagagatggacttgccggcgcggtggctcacgcctgtaatcctagcactttgggaggccgaggcgggtggatcacgaggtcaggagatcgagaccatcctggctaacatggtgaaaccccgtctctactaaaaatacaaaaaattagccgggtgtggcggcgggcgcctgtagtcccagctactcgggaggctgaggcaggagaatggcgtgaaccagggaggcggagcttgcagtgagcgcgatggcgccaccgcactccagcctgggcgacagagcgggactctgcctcaaaaaaaaaaaaaaaaaaaaaaaaaaaaaaaaaaaaaaaaagagatggacttggagcgtgtgcttttgttttctatgctattcaatgtgttcacagcaggtcccctggatgagaccacttagccttcagctccggaggcgacccaggccggccttgccaggtccctctccctgacaggcgccccgcgacaggggtcccaccccgtccctccgctcctcgccccctctttttccactttccctccccagcgagaacgttctgagagctaggaatgttctctaggaggtcgctttgacgtccacaccgcgcctgggggattctgcggggagcacaggaccctgggacgagacgcagaagtcgctccacgccctgggcggcctcagctcccgcgacaccgcagcaactcagaacccaggcaggggccgggcagccagcatgctgcccccacgttcacctccaactcccacctctcggccctcgccccaacccgcaggaccctggcagcgcactggctgtctccgcggaagcccccgagggcctcggcgcggccccgccccctggaaggttcccgacaggcgccgcgggcaccccggccgtgacgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtggtgagcgggcggcggggtggcagggtggcggggtggcagggtggcggggtggcggggtggggagcagttccacatctcccccggcctctggcggcggctcccaggtcgctctccgggtgggtttgggggacccctcctgcctccggaattgtttggtctttggtcgtggacagacctcagggggccacgagcttctccaggccattttatctcagctttaagcaaaacgctggagcgcggaggtgatcagggccccgaggctgccctgatgcgggaggcccgtgtgcaggtggcaggccgggggcacacgcgcttgtcattagataattcacgtagcagccctgtcaagagccgtttaaaggtcgggccctgctgggtgcttgggtgatgccatgttgagcagacacggagttcagtgcttgtgtccgcttccttttgcctttactctgactgactactctcatttcttagcattttgcccccaccttcttcagtgaaatcgtttcatacatttgtaacacagttggattgctttgtcacattctgccttacatcttgggatccttctacctaatgcgttttttaaaatgtgcatacattgagcgcattctttgtgctataaggttctatggattttttctttgtgctataaggttctataggttttgacacgtgtgtaatagcatgtctccaccattataggttcgtacagagtagmttcactgccttaaaaaattcccctctgctttacctattaaacccttctttttctccaacccctgacaaccacagatctcattaacatttccatagttgccttttctggaatgtcatataattagaatcatacaatatattgccttttcagacgccttgaatacttggaaatatctatgtaagattcacttatgtcttcgtggcttggtaactcatttctttttaatcactgagtaatatctcattgcatggatgtacttcaattcattcagcaattgaagggcatcttggttgcttcaagtttttggcaattatgaataaagctgctgtaatcgtgtacatgcagatttctttttggaaatacatttttatatcatttgggtaatacctggaagagygattactcatgtagtaagactagttttctaagaagctgccaagccatcttccagagtgactgtgccatttgactcccaccagaagtgaaggctctccttgttgctctgcgtgctcgccagcatgcggggctgtcggttactttggattgctatccattctgatagctgcgtagtggtatcttgtttcaactttggaatatctcatgatatacagtgttcatcttttcatatacttatttgctatctgcgttaatttcatttgcgagaggtgtttacatcttttgcccatttttaaattgggttgtctgctttgccttgttttgtaacttgtttcttccttactcttcagttatcaaatcaagatcgaaaaatatcttgatatttcatattctcctgttttatttaaatttcactataaagtattttaatatttttgtgtttttctgagtacttagtattccataatatggatatgccttaattttgtttaactattcctccgttgttggacatttaagggtttctatttgcatttttggtgttacatcatacttcattgagcatccttataggtcaatcttatgtatatactctttgaatggattcctaatgctgtagacccagcgtcctctaggtttcattaccattagcagtttaggatggtactcattgtcttgtcctaactctgtaatcattttttaaattatttctcattttgacacatgaaaaactaatgtttccttgttaatagtcttttgtttttttgtagcaaggttgaccactttttcatgtggtttttggctatattttataattttaaaataagctgtgtgtttttattctttgttttcttattgttctgtacaatttctgtatatagtaaggttattaccccatcatatctgttgaacttcttcagtttgttttacttttggttatgtttcttttctttttttggaaggaatgttcccactttagtgtggagagtaaattgggctgctggagacaggcattgaagcaggtctttgccttgtagatgagaggtgtgagggtgccgacagagtcagcacatggcatagggaggcgatgcagtgtccagagagtctgaacagttaggattttgtgtgtaattctgcagttgaaggaaggagaaaggtatcaaagacgacactcaaatttgctctcttttgcttgttaggtagtggatattccttgctgtgagggaaagcagacttgggggctaggatatggatgttgcatttcaccttagctctgttaccttcaggtgccttcaggacatctaggtggagctgtttaataggcagtggggtaacgaggtcaggacatggggacagaagcttggattagagaaatgttttttattcccttcccttcactcctgagcttccctccatccctgtctttcttcctcccgtctgtccgtccatccatccatccatccacccctccctccctccctccaatttttattgaacatagtaaacatatttaataaaaatttcaggcattgttccagggcctgaggatttagcagtgaacaaacagacagtatatctgcctttaacgaaacttacatggacagagtggtgggggatagacagataattaaacaaattaataggcaataaagatgtagatgttggcatttttatcacyaagaggtttcttggtatttttacctaatagttactaatgcctacaggaaccagagtggtcacaatgtgctgctgtgtgattttgtgtttttcagagaggaattcatagcagtgtgcagtgcaarctgcgctatggaatgtggcatttcctacttggggataaagcaagcaaaagactgacagaacgcagcagagtgataactgtagatggcartatatgtactggaaaaggcaaacttgcaaaagaaatagcagagaaactaggtatgattttatgttacacagaatgatacctttttctcagatatatggttgcttatttcactggtttttcttcaatattaatattaaataatattaaatatttaataattgggcctaaggtgggtatttcacatttttgtttattgaaaaagctgttttataaaacraaacaagaaaaagctgtttttaatcttttatgtttggaaaatttgtgaaaatccatgctggttgtcaatttgaattggaattttatgtgggcagtgtaagcagggcacttccacataaactgtcgtgtttgaactttgtgacagcctctgaaatagagccgaggatggtactcactcacagatgggtgtactcctgagtgagcagatgccacatagctgggtcccaaagccaaggttagagccccttcctgactcctggtgcagctgagtgtccattgtacctttctgtagcacctgcatgacagcagctgcccgctagagggggctcctgtggttacagggagcagtcctttcaggaggaacctggataagggcactgtgcaagctctttcgctcacatgcttgcttgtatatgttgtgtgttcccttcatacgtgatgaaacccaggcatgtaggtgactttctctaggtcattggctccatccctggcggtgagattcgggcgggctgtgtgttttggctagtccccactgctccctgcggggagtgagtgatgtgcatcagactgcatcygactgtttctcttttcaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggtgcagtatttctgggcagttagatctgttctgtacttgaacactattctagaattcaaccacgttaaattgccactgagtcgagctttcctttaagggtgtttgatgaggtgagttctgtctttccaacaagatcatgaatttcttgagattgtgttatttttgcttcagaattaatttaatgctgtttcactatggatactggagtgagatttatggattgtatagaattctcaaggcactactttaagcttctatacttacatattcatttatatatgaaatgtgtcaaaacaaaggggtaaagagagcacagaagtgtccaggaggaaacgggatcacacttatgaagactgtgcatgtgccatgcagacagagatgtggatgccaacaacatagggttgtcccggagggcccagagataggccggaatcaccataaagccacgaggcagacgtgaatcttgataagatgacggggggaggcagaacacacagggtcccataggccagtgcagtaggggaggatgcttcccttgaaggtatccaaagcagaaaggaagagctgtgtactggggagcctgggagacggaaacagggatcagaaagtatagttaggagaggaagggaaggtggatgaaagggcatgaacatggactacttgtgtgcagaatgaggttagggtccagcgacgggttactgtaatcattctgggaaacagcagtgcatgctagacatcctgagagttggaccgcagatgcactgccaatttttggtcaaagctaccatgccacggcggtcctcagttcacaggtagcagcaaatggcacatctgtgtgcggagagagggagatgggtggactcttagggccttcgtgtctgttttatattgcagtgcttgctgctttygttgattggcagtgcccctgatgagcttctcacgcacaagctcagccgccactagggttggcttcatggggtctgagccgtgagaacaagaatgtggttttcactgggagtggccggctcacaggcttcttctcagagctgagctaggagccgctgcctatgctccttcaggtctccacggatgcagtgtgtgtccatgacacgtatctacacagttgtacggtggtggagttattgtcttgctttgaaaaagttgaaaacattttattagtgcttctttttttcttatatgaacgtaaaccctgatcttggttagtgttactcctaagaaaacaatgtggtctgctgtttctggtttgaggttctttaccaggagccaatccaggagctgatgtcgtagcgtggacttcacactgacatccaggcttactccacgttctttttttttttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctccacgttctttttaaagcattcttcaaccctgtcttctgactactcatttcttaaaatgaaaaagaaacattttacttgttaaataaagccttgctttttttggtgctatagtaacctatttcccatttagaaaaaaaaagtgcagcttgctcccatctcagtattcttggggcaaattggaactgggttaacgtattcattaaatatttagtgcatgtctgctgtgtgccagacccattctgggagctaagggcgccacagggagggaagcctgtgttttagtagagggatgaagactcgatgtggaaacaggaatgtcttgccccaagtgagtggtggctgctctgaggaaggaggctgtggggagaggctgggtaggaagattaggggaggcctctgcccagacacagcagggctgactgcaaggaggctggctggggaccctggggactagtgctctgagctgcacaagtgtccgtcggggctgctgtgatagtaacacagccagtgaggctgggagtggacagaggtgaggttgagaagtagcccaacatcagtagatctgactggaatggtgggggcaggagcaggatgggggtgggcactgtaggggtggaatacgttatttaaaaacaagcactttttgtattaaccggatgctttctgttatagctgacttaatgaaacgatgttatattgctcaaaactgaaaagatacttcagtttttgaaaatggtttcccacttacaaatatgtctatgttcttttcagtattttggtgtggaaatggaattgtaaatgattgttattttcttttctctgraatgcagtgatcagttgacagtgctttgctatctgtctgattttcaatttctgtttgcctatgtttaaacaggacaaggtgttgtgttggagcgctccatcttcagtgactttgtgttcctggaggcgatgtacaaccagggattcatccgaaagcagtgtgagtcagcattgcagacccacttctgggtgtgtggtgcgactttgcaagggctgtgatagactcaccttgcacttactgtgtttatgaatgtctgttagatagatgaataaatgccattacttaatcggtctccgctggaaaaaggaacttcctaagtatcttccaycctttctccctcctgaaataggtgtcttttgtgctgtcatgtctccctgtgaaagcagattggagcyctggacctcaaacacacgcagcttaaagtgcagcccccacagcctcccgttagaacctcccccgctcttagcttgccctagcaatacctaggctgtagctctaattgtaacagactttccagtttctagtgtgtgattttgatgaattgggatgttagccctgccagttgccagcatcatcacagtgcttccctctgacacgctgccgtttttcaggacagtagctttgtgttgctgtattggggaaggtctgacaagtggcaaatggaaaggaacaaagaccccctggtttgaagcaggctgaccttgaggagtcagggtggggttggggtgtctgtgactaggactgtgttgggcggtgggttgaataggcctggtggacagtctgactgacggcattttcatctgtagactggggtggctggagccagtggaaagctggaatctgggagctcagaggaagtactgttgattaatgaaagaggaggccraagcaagccaggtgaccattctgtggaggaggcgcctgcttctggctgcttgtgtgtcctggtgttgccggtactccacctgtgagcttgccgcccgcaagagcactgcaagcccgtgcttctgataggggctgatcctccctggacatgctgagcagcgggtcaggtcaccagcaagtgtttctggagtgcctgtggtgtggcaggctctcttaggtgctagggatatgaatatgaagaaacttaagacaaggctcccaygggcccggggttgggggctgttgaaccaatggggatggttcattgtaataaagtgtacttagcactcctgagcattactcctgggtgctttgggggcacataggagaaatgtgtaaccggctgggagatgggatagtgtcagggacagctgttttgatgaatggcctgtcatctgtagcgcagtgggagtgagggacgtgtggggatggtggagaagcctgcgtgtgccacaggctggtggtggtgtcctatagtgagggctgggtgctgggggagaatgatgctggatgaggctgcacgaggaaggagctgcgcctcggcgaggatgcttggcttctgtcctgaaactagtgagggaccactggaggatttttagcatggcagagacatggttagatgtgagtttaaaatggttgcaggccttcatctgaaggatgcatttggtgaggagagacggaaggggaaggagcctatctgggaggaaattggggtgggacaggcgtgcacagcagggaggctgcactgggcagtgggagttgccgctcaggagggacactgggcaggcctgggtgggtggtttcctgtgtgcacagtggggagtggcgtggacctgccctggctagtgggccgctaagggggaaggatgcacaggggcagtggaccgatgtggcttcatgtttgggcgttggattcctgagtgtgaggttcccatggcaaggtggcaggagatacctgtcggcatctgctgagtgtytgctgaagtctgaggactggcctgggctggagtctgcaggcgttgggggtccagcactgaccgtgagcatgctttccttgggaaagcccaaggggtgatgggggagggctgagaccagatcctttggggaccatttctggggtgatgagacccccactgagggattgaagctgaatgatcagaggtgcacaggaggaagcagaggggatgtggggagggttggttgttggtgtcacatgtgctgtgactctgatgggaactgagaagtgactgtcacgtttcacctttcgggggctggtgatgttagccagagtcgtttgagtgctgggctgggggaaagcagatcatgttggctaaaggacaggtggcatagagcaaggtggggaccacctgagaagtgggtgtactgacaggagtaagggtgagggtgggaagcagggtgagagcagactcggtgaagggaggtttcacctcagcagcaggagagaccggcctgctaccggtccagcagtcaggaagcagacccgaggtcccgtgtgctctgcctggctgcgggtttgtgtttgtatgctcaggtgaacggtactccactggcagcctccgtcctttgctttgtcacacctcctcctgggtggtcttccttgttctttagctcgtgccgttcctgaccctgagccaaaggctcatcccacagttgcctctagagtgaggttactaggaatgctcactggaacttttttttttaatttaatttttaaaatttttatttatttattttgagactaggttaggagactggctaatgtttgtatttttggtagacatgggatttcaccatgctgctcaggctggtcctgaactcctgggctccagtgatctgcgcccacctcggcctcccaaagtgccaggatgacaggcgtgagccactgtgcccagcccatttcctttaaagcaaaatagttgtctttctgtggaccctagcatggccatctgtcacttctggaaggttccacacgtgaaaagctgcagaggggatggcttctcagcatggcctctccacatgcactggcgtgcactctctgttggcttctgggaggtcgggtgtgcatgagcatgtgcaggtgcagagtgctctgaagagcggcagggttcccttgggtggcacgggccctgcgggtgccccctggattatgcattctgtgtagtgatcactttaggagaattattcctcagccttagctgctttcaatttcatkttgtcactaaatctgactcagtagatacttctgtgcagctgattatactactgaamcgggataaatgyagcttgatgattttcagctgagttatttgaaaaataaagtatttaaagctgttctttattcttcagagaagaccagactcttgtatctattattactgtgaagaaatatagtagcatgtatactatatacctgcaacatatatactgcaagtatatggaatatatttcagttcaaagatcactgaactgtgacctccatcttgcgtgacctacgtcttgcctcaggagcaaaagtgaacccttaaatgtggctaagatgtgctaaagatctgtcttttaggatgattaaggtcacagtttaaatgctgctrttttactctgtgtaagtagcttaatttctctgggcctcagacctttggtttgtaaatacagtggaggcgacaagccctgttttcagggttgtgggcaccacagctgctgtctgcacatgccccgtggcacctggagcacagtcacatgccatgtgtgtggtcagtgcttagaactgtgaccgagatagggtttgtagattggtacgtggctttgagaattgcgtgtatgtttgcccttttattcaaggaggagtgtgttttggaaacccgtgtggggactggtaggtgacagcgcccctttctcctatgtgccaggtgtggaccactacaacgaggtgaagagcgtcaccatctgcgattacctgcccccccacctggtgatttacatcgatgtgcccgttccagaggtccagaggcggattcagaagaaaggagatgtaatgcagttttcaatcaaaggccaagcatctctattttgaatgyagatcagcactaaaagccctgttttaatagyatttatactaattcctaccagtcctcacgaggagggtgacacacaccctgttcccacttgagagagggcatctkcaggggtggaggggagaccccatggctcggcctggtgccacagcctgcgggcctgccgcccaccagtgctctgcggtcccactgtggtccccgagtcccctcagctgtttaaacttgggaggctggtgagggcctcctggcagagcgtcctccatccctctgtcacgtacctttctgttctctgatgaggtttttgtgtcctatcgttttcttccacattggaagcaatttctaatatccctcatcacttcaatctatttaacgcaaatcgtgcctctccccctttttcttacttaccaattctagaacagtagagcagtgatatccacacacatccatttactctttgtagttttcattggatcttaattaggtggcctcgaagcaacgccttttgaagtgaccctgtggccgttggtagctctgttggcggcttgatggaggatcctgagatgaaacaaagaccgtctttgccctgtggcgagttctttgttttttttttttgagacagagtctcgctctgtcacccaggctggagtgcagtggcacgatctcggctcactgcaagctccgcctcccgggttcacgccattctcctgcctcagcctcccaagtagctgggactacaggyrcacgccaccatgcccggctaatttttttgtatttttagtagagacggggtttcactgcttgtttaatactatgttattttttcctggaggagaatatggtctcctttttgatactgtgatgaaaatgcagggctacctgcctgttcctcactctgatgcccatcctcagtgccggaattcttgtaggtgctcaggaaatacctctctggatggtgggttcttgtcagggcaacagtaaagctctggttattttttgctgctcctgaaagatccatgggactaactttccttctctgttgcaatagtagaaacagcgagatgtctatgtatgcctttctattgccactctggaacttttattgtttaagcatatgcttgtaagtatgttgtatagctagacttctaagaaccttccatcaagtggcaaaaggagggaactgcaagttcaaaatgtttgtttctcagtggactaactggacacctttgcttattatgctgacatttattgagaaaaacaaagtcatacatttaacattctctagataattcttttgttatctgggaaaacagtatttcaaaaataattctgaggtctaaagtagagctgtcaacttcttaatttttccaagtaaagtcttcaatactgtcatcaggtaaaattaccccattttataaaagacatcacattatcagtaagtctgtgttcttattttgatttttatttcaatgcagtctgtgtctcagtattgcaccttttgggaataactgataggaatatccgaaaaccatttctagattctaagaaaacagtcaaagtgatcaataactacatattttatcaagtaacttcaggtcagatttctgagatggttgtgttatgttgcatgttatgggcttatattacactagagtttcttttataatcagttaacatttaatcttattctacttggcacatagctaatgatagagatttagaatcatatcacctcttttatacttttgttgatttcactcactcctctaatacagagcacctcctatatgcaaggcgcctgtgccaggcacctaggaggctgcaaagatgaacaaagatggtctctgcccagacaccaagtccttattggaaaatagaactcccaattactgcctttcccccttttgacagagcaatgaagtgcagcattgcctgtatcatcctttccctgtgccccgtcgcattactggaattaatacatgttcagtaaatattctttgaatgatagggtttttcttattttgaacagctttaatgaggtataatttatgctccataaaattcacccattttaagggtacgactgaatgattttgggtaaatttaccaagttrttgccactcttgccataatccagttttagaatgttttcatcattttgtaggttgaaaccgcaggcctattcatttctttcttccttcctctctctcctgtaagtgttgattgagcatccaccctgtcctagaccctgcttggtgctagggacataccagtgagcagggtggatgaggtcctcacccgtgagctcatatgctgatgggggagacctacagcaagcaaggagataaataaatacatcaaatagaggtaaatgatgtgaagaaaacaaaacgggctgagaagatagtgtgagactgtaaggagttttaaattttaaaacttgctactcataattagatattcaagtttctgaaattcgcatagtgcatttcagatgatgagagaggtgacarccgtagaaagtgggagaagtggttgcggggagatgggtgagcgatggaggtggcgagcaagttggagagatgcagggagagtcaggtgacaagaagagagtgtgctgaggacagatggcggacagacaggccgctgcccccaatttttggtgctctttcattcctgcactcaggcacgaggcagacaggaaagacaggcagtgctgcttcgtaacaggcatctttcttgccctaagtatacatcttagaatgtgtggagaaagtcacgctatgggagcacttgggcaggctcaggtgttcactgtagtagaaggagaatgactctagctgatgttgggaccctttgctgtcaccccgcagtccccacagtgcccggtgtgagttgtaagaaaatggtggtcagtgattgtcttcgcattttatatacgcacaggtcaaagagaatgaactctaaatgtttcccagtttgrtttttctgcttctgtttagccacatgaaatgaagatcacctctgcctatctacaggacattragaatgcctataagaaaacctttctccctgagatgaggtgagccaaacacacgactgatttacagggctaaaacttcttcgccactcgtttcttaggccccaacagcccagggagttttctgtcttatttactgcagtggatattgtctgagatgtttaatctgatgtttataaataagaaaaacaggagacatttcagtttgatttttgtggggtttattggtttatttgttttggtttgcttatcttgtcagtacttttgctctgctatatttctgaagttttttgatgctagaagtaaaccaagctctattccatgacaggttttaccatagagaacttgtgtatttttacttcaggtggcaactaaacattcgtgtttacctagaaggattgattggaagtgtattcatggagaaaattcatgaaagataacactttctctagacattcttaattgatgtccttgagagatgtttggattagatgaaggaaacaccaccagactgtttttctttcttttccccctttctttctttgttgaaagcacatggaaaatgtggtttcactcatcctatggcttgtcattctgcgctccttgggtatattcgtgtgtaaggaatgtctgccacactcattcacgtccagttaaactcagattgtttgaataatgcttgaattgaagatttttatactatttctcatactttttaaaaccctaagcctctttcggtgcctaaaaatctcatgttcttgttgtttaaaatttcaaagtaactgaagttgtgaataaaaacaaaagtatagcaattttagaaaaaaagttttatttttacatttattttagttaaatactgaatatttacaatgaacagccttagaagataatattgttagaccataggtaataataaaatcaaaagtgaataagagaaatgttctattcagggagttttttctgtaccgtaagtattaacgtttatgtcatctctgcttgtttgtggtgagcgtttctttcttaggtggtaagaagactgggtggcctctggcttccttttaacctgttgtactgccctatttccaaggccacaataccaagggaagtatctagagccaacgtgaataaacagcataaacagagatagttgaccctagagtttcaggctcaaaaattactcttggagatcttctggcttcaaaaacatcactgagaaagagctttgtcataatttctcaaatggagtttctagctacaacatcagcaaaataatggctggtttcagcctgtgcacagggcaagagtttcttttactttgccgccctcatagactsgttaagcctcaagcatttatttcttaccacttggtcttgctgtgtttttaactcctgttttaggaacagatacagtctctgttcattgttaaagtagatcttatctgacagctcaagccgtatggattgatgggagccacttgwtgtaggggtcatttgtcacacattgaagaakgagtaccagatgtactctatgcagtatgcattattttaagtgctgaattgtagaccaagatcaaactgcagctttgtgatggacttggatcttaaaagttttctcatagaaattcactatgaaatttggctgaaactattttttgtaaaattgcaagaaacctatgacgagttgtattttaaaatttattggccattagcattttagaattcaggagttattttccaacagaaacaatattaggtttcccgggcttgtatatttaaaccattgtttagttaaatactgaatatttttattgttagatcttaggttagaccttagaagacaatattgttagatcatagataattaataaacagtaaaatcaaaactaaataagagaaatgtttttagttttaatactagtatttgaaataaagcagattgacctgacaagatgatggctccgttgaagttctgtgtctcctgtctttgagcagttcctcctgtgttagcccttctctctgtcacgtgctgatacatggtgatgcttcactgtttttgtatttgttgcttrtgaatgcataaagagcattgcagccttttccaaaatatttgtattgtgggattttaagaggtacaatgagctaactctcataggaatgtgtattttctggctttgtcaatatttatgacccagatcttaggcgtacatgtctttctcctcattaccttaattgtgaatgtgttaatgagtatcaacttagtttcaccaacatttggccattcccgygttcaacatatacttatttactcagctccaacactgctagctcccagtgtcagtgttagctgagacacagaggtacacaagacagrgtagggaaggcctttctgagaaagaatcgtcacctctgagatttcagagacaagaagaggagcactgagtgaccagcctgacatgtagcgagttttgtaactgtctttattgtttcagattgttctaaggtgggtgaggagctggggaggctctggaagtattgaaataacttgggggttcagtaatacagcttgtggctctcctcggccctgagctacctataggaataaccaccattgaggttgcacgtgaactgctggcccagccctttatgggggtttcctccagatccctgactccacacttgataccttcttattttaggcctcctttcacaaggcagtgggaatgagaggcaggtgtgactggacggaggcggttttatttgtctgttgccgaggttgttagcatgctgaatggaggcgcacagaagatagaaaatggactctccaggttgctctcatcaggtagtttggggtctggagctcattaagggcaggagccctgtcttccccaccttccataccccacacagcacctggctcctggtggggcttcagctaatgtctgttcagttatgtgtgttgaacgaaactgtcacatcgtcctgatctctcatgaccactcttgtgcaaatrtgtcaaatagtttgtgacctttcatattgctgtgtgagaacaaataatgtttctgtgccagccctgttcatcagggatgtttaagacctctgtctcctatacacttcagttgaatattcacttaggtgacttgcagagggaattattctcctttgtcactttgtgcctttctcttcgtattaacaatgggtagctgtagaggttcaggaagcaatacagcaagtcctgtaattagtgtggccttttccttgccagccctaatggcaaatgcagtaagttactttcctcactatggatttattgttcattctgcttgcagtttctgaccatttatgttgatcttaagggtgctgtgaggagtgcagtgatctcgttgcagtaagaatctgttatccagttgtatgactctgaattgtgagttatagacttgtgtggaacagatgtgttactgagtgattgtagagcttgaagacttttttctttttcctacactttggaagtgatgtgagtcagtaatgatgagacttaataaaatacaagcactttacctgtactacgtaatttaatcaaccagtggtctgttgaagatggtcagcagagttggtgaagtttgtttggtaccattgtaggggtcagatgctgatttcagtatgagaataaatagcttgtacattcttggagtatttacttaccctgtatgtttacatcctaaatgtgtggagggtgctctggtgtaaagatgccctctgtgcctgtgctcatttaggccctgctgtggagggtgctgtggtgtaaagatgccctctgcctgtgctcggttaggccctgggctgtggagggtgctctggtgtaaagatgccttctgcctgtgctcggttaggccctgggcttcgttgtccttccgtgcagcgggcactgcctttggcgatggtatgtgcagctgctgacrtggctcatgtaccttgctcctgtggacagtgatggctgtggtctgtcaygcccttggcttgggggcagtgtagtcaggagaagggaaacgaggaaatggtcctgctgttgtcactgtcaagccakccatgagaacattctggcttttaacatgtcctcctgaaccagtcaagctctaatgcaccctcacatgcccagcacaatgcccagtgcagagaatgtgaggttttaaatttgagcaggagactttagcggtatgtattcatttgtacatttaacttcagcttggaaaagtttacactgaatttcatcttgtttttycttacagtgaaaaatgtgaggttttacartattctgcaagggaagctcaagattcaaaaaaggtaagaaaatggttgaaaagttgaaagttattcctacatttgattcatgtgtaaggttcttgcaaatcagatcgtcagttagattcccactggtcttaacaaacatcactgttttatcaccygaaagcagtgccagtcaaacccatcatcacactcccctggccatgaggtttygagtttctttcaagtaattcggtttctacgatctgaaaattacagatgtcacagaatcttgggtcatccactctaccatttttattaaagagatggaaaattgaaagttggattagttaatgggaaagatttacatgtaaagataacagttttccttaaattmgtgtgttttgtgaaagtctagtaaatcttggtgtagttttcagggaactttatgaataacagccagacaaacattaaaacatctgaagaagaataacgaaagaacatttgccctctcacatacaaaaacaaactatacgattgtagtaaggagagcattgtggtgttaatgcaagaattaataaagagcttaatggaacaaaacaagagtccagaaacatgtatgcacctgtgtgtaagtatcttcagtttggcaaagttagttccttaaaggataattayaaaaatgaagtagaggaaaattgtttcctaaatggtactgaggcaactgagcatccatttgttaaaaaacaagttttttattttgtattttatatattaagcataaattactaaaaacaaaacgaggtgtaacaattctagaagaaaatacaagtttyaggatctggtcttgaagtgtgagtggtgcccgtgtaacagagaagctttgcatagttggctgctggggtgacaagcgtgcttcagttgcctctcagcattgggagggtgagaagagggaggttgactgagcttttctgcacagagagtagcattctccttgcagagggaagccctgcattctcgcccaggctctcctactaccagttgtaaagttcttttgagaccttggtttattctactcagactgattaaattacatttcattttctcctccgccttctgtttctgtttttagagtatttatatacctttgagagactgtttaggtggcatgtatcttagaagaagaataatacgttttgtctccaatactatgttatttgagttcatttttgaatttactcaaattcccgaaactaaagagggttcatgagtttggcctgttgtgaggagagaatgcgtatggaaagattactcctctggaaagtcagactgtgtagacagccagccttgaggccgggcacctagatcattaggtctctctaggtaatgggtttgtatcttattcttttgtcattttgaggggctaggttttgccttttagaaggaacttacttgggaagaaatgagtagcctgtcctgaaggctgatttttctcccctagtcttcattgttctcacctgtccttttctcccagcctgcagggtaatgtctgtcctacttgatccctgagtgttagctaggcaaggccatactgtgatgcaacactcaaccccaccatttcattaaaggtcagccagcttcacttccattctgactgttacggtgtgattcttcctgccaaatattcatagcttataatgtattaaaatgttacctcttggccagccatggtggctcacgtctataatcccagcactttgggaggctgaggcaggaggatygcttgagcccaggagtttgagaccagcctgggcaacrtggtgagaccccatctctactaaaaatacaaacatcagccaggtgtggtggcatatgcctgtagtcccagcaactcgggaggctgaggtgctgaggtgggaggattgcttgagcccagcaggccaaggctgcagtgtgctgtgattgtgccactactttccagcctggatgatagagccggaccctgtctcaaaaaaaagttatttcatttaaatttctaaaatggggttctctgtttaaattggaatttttcctgtcttaggtggtagaggacattgaatacctgaagttcgataaagggccgtggctcaagcaggacaatcgcactttataccacctgcgattactgtaagtgcatctgtgtgggggctgctgcatgtctggggtctacttgcatgatggggaaacttagggaagtttgaaataattatgtttcaagttaggtgttagcagcaccaacccaatacttagaggtattttttcttccaaacagctcctgaatcccctggtctgatacttaatttattgagtgccattattratttaacaggcattttgcttccactatgtgcaacaccgttccagatttaagagatatagtgtcagataaaattcttgatgtctttgaaaatgtgttttagtaggtgagacagagtaaacaaatagataaaactgcgtcaggtcacaaaggccagggagagaagtaaccctgagtaacagggtggtgagtagctaggggtgacaaagggcctctctcgggatgaggcytaagtgaggccaggattgggtcctgtgggccgtggggtgagcagagggcaggggcttggcaggtgcagaggctcttcaggcaggagtgtggtgggaaggtgcgcccagcagccaagccagtgtggccagaaaaagtgtggggaggggaggccacagcggaatggagcaggactaggagaggaggccatggcggaatggggcaggactaggaggggaggccgcggtggaagagggcaggactaggaagggaggccactgcagaagggggtaggtcttggtgcgtttggtgggttttcttctgatgagatgagatgccgtttgggggtttgaagcagaggagtaatacgatatgacttatatccattcagctattgtgtggattctttggtatctattaaatgaaaaacaaaaaccataccgattaggtaaggttgaaaaaagctgtcttcatctgcaccactctattgaaactgctcctgccaaggagacggcctcgccattccagatgcggcagacccttgtctgtcttcatgctgctccctggccctggaagcagcaccgctgcccctcttctccactcccttctcctggttccatgccctcctcctcccccactctctcactcctccaccagctgctgccttctggggccgggctctctttttctggttccttctgcctgctgctgggctctggcaggcacagtgaccccgggcagtgtctcgtccgttgaattcagtttcttgaggacgtacctagtcacacagctgtggatagcgtggataccaccgtaggtcttggcccagacctttaccctgcacacccagcaaatatccctcggctgcctcttgcagtgtctctgtgcattgaccttcccaccggtgatccccagctctgcctcttctgtcctggctggtgctggccacccgggaatctcatcctgcttgggtctgtcctccaccacccaccccctgctgcttctcatcactgcaacgcccagttcctggtaraggcctcatatccagcgtgcactcaggagatgtatctggagtgagtgactttgatttcttttagggctataaattctacaaaattcagagatgattttgtaatgagaagtgctgttgtatcataattctgattatttataaatcaagattggagtaatttgagggtctttgacttgtgaaaatgcaggaaacatgagtagctatttggggatctgccttttgtgttaagtctygagcccttggcctgagcctgccctgtgctgcttcctgcctctacccaggatgctctgtgcagactgcaccaacactttgcctctcgagggccyggaggcacaaggatggcmggggcactcaacttccctctcctcaacgtttggatgtaaattaggaagttggtgcctacagatggcagctctgttcttggccctgtgatgttggtgttcttaggccgttggtgcttaccttctttctctrcctgatgggatgtgagtgatacagtagtctcctaggatgaccagagggacagctggctcactgcacatgtcactaaaagttcactgatcaaaatgtaaacagaatgtgtaataagtttacttctggccaggcagcgttcacgtctgtaaacccagcacgttgggaagctcaagtgggaggattgctggagccccggagttcgagaccagcctgggcaatatagtgagaccccatctctacaaaaaatttaaaaattatctgggtatggtggtgcatgcctatagtttcagctacttgggaggttaaggtgggagggtcacttgaacctgggaggttgaggctgcartgagctgtgttcacgccacggtactccagcttgggcgacagagactctgtctctcaaaagaagttcacttctgtttgatgtttttagtacagcattaataagcaaaaaataggtttacattaaaaaaaactagtcattctacttagtttgttaattcctgcccccctgttaaaatagtatttgcaaaatcagttttctagttagtggaatggatactgaagggtgagcraggtaggcacactgtggggtcctcatgtcagactgaggagacgggaagggtcaggtcagcccttagctggctgtgtgacttgggacaagtcactttatctgcctgtgcctccatatgtaagattatggcagtgaggtagagtgctaggccatgtgtattgaaggaaaaaacaaatataaatttcatatattatattccatatactgactactgtataaaatggtgttaatctaaaagtagcttactgaaatgattggctctctagaaagtcttttgaaaggaatctagcaaatcttccattagaaagtaaaacaaacaacaaaaccygctttccttgtcttttttttttttttttttttttttttgagtcagagttttgctcttgttgcccagactggagtgcagtggcgcaatctcagctcactgcaacctctgcctcctggttcaggcgattctcctgcctcagcctcctgagtagatgggattataggcatgcaccactatacccggctaattttttgtatttttagtagagacagggtttcgccatgttgggcagactggtcttgaactcctgacctcaggtgatccacctgcctcggcctccagaagtgctgggattacaggcgggagccactgcgccggccttccttgtctttctgagccattactaggagatggaagtaaagcacaaagcactgcttttggcctctgaataaatattctgcatcctggagacaatggccaarggttacagtgcctactccaggtggacaacacatttcaacctgagggccgtgagtttgctgattgacagggcgaccgaccagaaattagaggggtcctctgaggtgtctgaatgtagaagtttctctgagtcattgaagtcagctgattattccctgtgcagccatttttgttgcaaagtcagtgtgtgctttgctgtgaactgtggcaagggccatcaaacattggtttattccgagtaattttaactttaggacagggatgcgtaggtgatggagaccaagaggagaaaataaaagtatatttctgagaagaaaatgattgttgtaataccagagactcaccatttcatamccaggtcagaaggatcccttgagagggactcagccactcacctgtcactgtgcccctgggcaaggggcctaacctctctgagcctctgtctccttgttgtaaagcaggaagaaaatagaagctacctcataggactgttgtggggattaaatgtgggaataatttgaaaggctcagaaccatgtgtatatatcataagtactaaagttttagggactatgttatgatactgtttatggtatattattatactctgattgtagatgcatgatgtgtttacatttctccattaatatttttgttctttaatactaagctttttttcttttactttttaagtagtatttttctgatcttagaaataatttacattaattatcctcaattcacgcttyatggaaatctacagtgaagttgaacgaacccacctcctaaagacaaccgtgttgaagatgctattcatatttttttctgtgcatgccccagtgcagttgattgttgtaagccagattcccagtgtgccctgccccttggtgggagagctgaccttccgagtgatgtgctcaccacccttgcaggattgagcaccacagggcttagcactgctttgtgtatgtagttctgtgttgcttaacgacagggatatgttctaagaaaggtgtcgttaggcgatttcatcatcgtgaaaacatcatagtgtgtgtttacacaagcgtagatgctataacctgcacacytaggtggtgtggtggagcctgttgctcctaggccataaacctgtacagcatggtacagtactgaatactgttggcagttgtaacacgacggtaagtatttgtgtatctaaacataaaaaataatatggtataaaaggtgaaaatggtccacccgtctggggcatgtaccgtgagtggagctgacgggactggcagttgttctgggtgagtcagtgagtgagtggtgggtgaatgtgaaggtctaggacatcaccgtacactgtggtagactttgtaaacaatgtacaattaggctacactaaatttatataaaaagtttttttcttcagtaagagattaaccttagcttactataactttctttataaacttaaatttttttctttctttatatccttattctagaagtattttctgatttttaaaattatttatttttactttttaaacttttgttgttgttgttgttagttaagatacaaacacagtggcctgggcctacctggagtcgggagcatctgtatcactgtcttccacctccacacctttctcactggaaggccttcacgggcagtaacacgcgtggagctgtcacctcctgtgacaatgatgccttcttctggatgccgcctgaaggacctgcctgaggctgttgtacagttacttttttaaataagtaagatgagtactctaaaaatcacgatgaaatgtctagtatagtaaataacctaaagcagtaacatggtcattgatgagaatatcaggtattctgtactgtacataattgtatgtgctggactcttccacgactggcagtgcagtaggtttgtcaatgccacatcaccgcagacacgggagtcatgcgctgagccacggcgctgtgacagctgctgtgataggaagygttcagctccactagaatcttgtaggaccacattgtatatgtgacctgttgtggatggaaacgccatgctgtgcataactggaaaccggcaggaacctgtcacatggtacaaacaacatgggtttcacaggaaagccacgggaaggctctgttgtgcactctccatcagtataactttgtgaatttgccgtaacatttccattttcccaaaattcagctttagctgcagctgtcaggttcctcgtaggaaacagatggcacatttgaccagagaacagaagagagttacgtaaaggaaccattgataaagagcagggcagggttgagggaagcaacaggatggtgagacacccaggccatccacagtgggaaactggcagttgagggcgggggcactgggttttggagtccagagctgctgctgctgctgctatggaagaggctgtccagcatcagatggagcccgagggggatggggaacccgcatgcagggaaccagcagaacaatcatccacccagctgtgcttgaagtcagagggcagtagagcccctcggatgcaaggagccagcctctgggcacagagcaccttggaggaatggtagagaggagatctaaagggccaggtggaaaacagccccagactgtccacccagagaatgcagaggacggtcggcattcaccgttgttccctgtccagaatgaaaacgtgcatccctacgtgaaacaggggcagccaccatgtcattgtgcggtgatgaccattcatagtcttgagttggtcactgcaggtgtttttcatataaagtagagggagaaagaaacaacctgccacagarttcctggagtccccgcttctgtggtgagttcggagacccaagttcactttggtagcttccttggttcccacagcctcctcccctctgccagcagctcagctccatgtggtccttacctggtgcagcatcctgagcctgtgtgctgtgggttggagccttgggggctccctctgtggtagctgcctatctctgttcagaataagatttatcacagtgaatgaggacagatacgcagacagatcaatacraaaaaagacatgttggactctggagaaatccatgcacaggctcttcctcctgtgagggacactgacacattgattgagcaactttctcaagcagtgaaaaatacagtaacatatgggcagtatttctgcctggaaagccctttagacactcactgcccgtaatttttactgggggctggtcacgtaggaatcctctgcttcgcaactactcaggttccagactcccagaaagaaggcaggtgttctccataactcccatcgtaccctggtagggctgagtttgctgcccagcctcattagcatggggcactttttagaagctgagtttccagaagccaacmaagggccagcctcgcaaggaggccctgccacagacagcagcataggcctgctctgtgtgtggcgaaggaaaggctttctgagagcgcaagagctgtgcttttggcagaaaaacttcaggcaggggaggcaaatccgaacctaggagatgtggttttttaccttgggcagagcctgggattttaacaggactgaggttttgtaagagaggggcaagggaactgagcacagacaaaatcgcatgtgagtagtggtgaaccatgacgcttagtctgggtaaggaggaaagtgaaggagggaggggtgaggggactgaaatgacaaagtggatgagaggccaaaggcacaccctcttggaagagaaagtcgggaacaaaggttgaatatagaatcaaatcacctgcgcttctgccaccacagtgccaggattaacagttgaatgcaggttcttccagtctttaaatatttgtgtgtgcatatatttctaaatatatcttgtgtgtatttttgtattctacttccaatattttgagcatgttcctgttttgttaaacattttaaaatttgattttttcatggctccccatatatgctgcacttaccattgattgagatgcaaatcagggcttggcaaactgtttggcctgtgggccagatccagccgtcagctgctaagaatgatccttaacgtttttaaaggattggaaggaaaaggaaggattatgtgatggaaactgtatatagctctcaaagcctggtatttgctatccggccatttacagaaaaagttttgacttctccgacactacataatctgcataatttactgtttctttaaaatagatctcttggattatttcagtttcttcatgttcataatacagtaaagagcatgtagtaccccttcttgttcaatttcaggttacttaaggtataaaagtggtcagagtrtatgaacgcattttacagctattgagtttttgcaaaatgattctccggaatatgtgtaccagwattcatacttggacctggttctctgaatttccctataaagaatataattaaacaaaatgcaaacaaaaactttcgattctgwtacccatacaagtatttgttttactttgcattttataaacactaaacttcaatttatatttttattggctatttatttgctctttgtgaattttcccttcatatttattaactttttcgaagaaccwggtttttgttttgatgatttatccagttgttttctgttttattgatgtataccctagttttattattttttctctgctttctttaggcttcacttgttctttttctatagattcctaagcttattgactttagatcttttttcttttctaatatagtcagccctttgtatccctgggttccgcatccttggattcaaccaaccttggatcaaaaatatttgggaaaaaagccaataaaaataacacagcaataaaaaaataataaaaatgtaaaaatacagtataacaactatttatatagcatttacattgtattagatattataatactatattattgtattacattgcattaggtattatacatactctagagatgatttaaagcaggggtgtccaatcttttggcttccctgggccacattggaagaagaagaattgtcttggaccacacataaaataacactgacgatagctgatgagttaaaaaaaaaaaaaggcaaaaaaactcacaatgttttaagaaagtttatgaatttatgttgggctgcattcaaagctgccctgggctgaatacagccatgggttggacaagcttcatttaaagtgtgtggggagtgtgtgcatagtttatatgcaaatactgtatgattttatgtaagggacttgagcatcctcagattttggtattagtggtggtctgggaaggaagccctggacaacagaagaatggttgcatatgcatcagtgctgtcagtttccctgtaggtgctgcttttgctgtatcacacaaatgtggataagttgtatttttattttcgttcaaaatgttttaaaaaatattttgagactttttctttgacccacatgttatttagaagtgtgttgtttaatctccaggcatgtagggattttctaggtatctttctgttgttgatttctagtttaattctcttgtggtctgagaatacactgtgtatgatttctctccatttacatttattaaggttttctatggccagtgtttcctatcttgattagtgttccaattcagcttgagaagagtgtagattctgctgttgctggagtgttgtataaatgtcagatcgagccgattgacggtggtattcaagtcatcggtatccttactgattttctctctgctgggtccatcggttactcagagttggggtcatcggtatctttactgattttcyctctgctggatctgttggttactcagagttggggtcatcggtctccttacggattttctctctgctggatctgtcggttactgagagttgggtttaaatttccaacagcgctggatttgtctatttctcccttgggttctattagtttttgcatcatatattttgaggtactgttgttaggtacatagtttattatcttaggttattatcttcttgaagaattggccgctttatcgttatgtaatgcccctctttttcgctgatgtttgtccttgtttgaagtcagctctatctgaatttaatatagccactgcagctttcaattagtgtgggcatggtgtgtcttttttcctcttctatctcgagtctttagttttcttgtagatagtaagtagtaattgggtcttgtgttttaatctactctgacagtctctgtcttttaattgctgtatttggaccattcatgttagaagtgagcgtgaagataatcaagttccattttaccatgcttttccctgttttctgtttgctgcatttgttgtttctccctgcctctttttctgccttctctggatttcattgagcattttataagattctcttttatcttttcccttaacatcttgattgtactttaaaaaaatgtttgtagtggttgctgtggagtttccagtatacatttacaacccatctaggtctacttcgtgatggtgctgctgctccatggggctgcaggtaccgacggcacagtcttcttggctcctcctgctgtcactgtgacatggctgccattccttccacttttttttttctttgagacagggtcttgctctgttgcccatcgcccaggctgcagtggcatgatcttggctcactgcagcctccccttcctgggttccagcagttcttatgtatcagcctcccaagtagctgatactacaggcgtgcaccaccacacctggctaatttttgtatttttagtaggaatggggttttgccatgttgcccacctagtcacaaactcctaatctcaagtgatctgcctgccctggcctcccaaagtgctgagattacagacatgagtcgccgcacccggcctcttccactttttataagctataaaatcactcaattcattgttgctgttagtccaggaaaggccattgattttcagttttttcttattggaaggatggaaattacagcttccagccttcaccctttggagctgaagctggaagttccctstttgttttttaaaactctgttaacattttggactagatgcctatatttgtgtgtgtgtttgtaaatttacctaaatgatatactctattattcaaaactttgctttaaaaaacctccaccttctctttaaactgctctattgcagcggtcccaaacctttttggcaccagggaccggtttcatggaaggcagtttttacacagactggggcggggatgggtggatggtttcagcatgattcaagtgcgttacatttattgggtactttatttctcttattattacattcttatatataatgaaataattctacaactcaccatgatgtaaaatcagtgggagccctgagcttgttttcctgcaactagatggtcccatctgggggtgatgggagacagtgacagatcatcaggcattagattctcataaggagtgtgcaaactagatcccttgtatgcacagttcacaatagggtttgtgctcctgtgagaatctcatgctgcsctggtctgacagcaggtggagctcaggcagtaatgcgagcaggggaatcggctataaatacagatgaagcttcactggcttgcttgctcacctcctgctgtgtggccaggttcctaacaggttgcagaggtttgtggcccggaggctggggacaggaccctgctgaaccgtgttttgctgttatgtctgaaatctcatagttaacagtagatgtcaacacagcgtctggaaggtgtttcggaaataatttgtctgttccacagcacttctgtggggcgggactccctcattttacaaggaggagaccatgactcgagagctcgagcctgccaaggttgtgtgactgtgtggggcrtctcacctctcgggctgcaggagctagagctgctgctctctgcatcctctgtgtggtcctgtgccctgggccatcttgccttccctcctgccrtctgttcaggcttgaatcctggtggaacctttgactcctctgtcaaccataatcctagcttgaaccytcctttttccctgctgacccccttatcctccccaaagtcacaccctgcaggtcagtgtgccactttcagtgacttctctcccttgtctctaacactgctgctccccttggtgtgtaatcccctggttcttggtctctgctcctctgcctctttatttcttcatcccactcccaccaggtttatttttttaaaaagtcacagtgaccctgttttctctttacttgaatctttgagtggcctatcttcatttagtcataggtctgaatttcctttcccagaattaattcagaatcccagtctgccctggttctgcgtcttctaccaggataccaggcaatctgccaggcccttcttccaccaccacctgcccagtagttacctagaaatcctagcagtctttaaagcttggacgtaatcacccttttttctccctgacaccttcccttaactcttgtaggctgttacttatatgaatgtatatggtatccttgtttgttagtattagctactgctgggcatcatatgacatctaacaaacttacggagacaagggattgtgtctgacttgacctccctgtggtaacagtgtcattttctaaacacagtgtgaaatgtgtgttggttcgattctgcaccattcatgtagttatttagttatgtgcttatcggagcatagagaaggatcctgtaattcccccatagtgtatcaattatagcattccgttgttttaatctagctcactatgaatggctttgtccttttttctcctggtattttgcctttcttcctccccaaagatgtttcataagtttacaatatcaattgtgtttattttcatttgagtaccatttctcaattgagggactcaagtgataattatgaccaattttctaacataattattgtaaacatgycgcttaccagtgacattcattttatccataacctgaccaaattattggtttagaacatttctgcaccatctcagttacgtgttgccagtgtctaattatgtgtatgtgtatagctatgcttgtgctgagaggcagtaattgtatttttcagtcttgttcatatccacatccctaactgactggcgcctgcttgggctggtttcagtccagtcaggacctccgaggacacgtcaggcctccagctgtgcaagctcctctcagaccatccctgcttctccagagcccagaccttcacacccaccttctttttgcttaattgccaagatttttacatgactcctggagcacgtctttttaacatgaaatttcagtgctacagaaactgtagcatgtgagtttggtttcagaagtacagtgtttcagatagaactttgcaattcaggagaaactgaaaaatagggtttggaaatgttataggacaaagtgttgacattcagttaattgggaaacagcttgagtcataaaacactatttacaattttattcttttttctgtgttcctgccttactcttgttttaaaatacgtgtcccagcacctcatattgtaaccaagctctagtatattttatattcttctttagacagtgacttatgatattaaaaggatatattatcctcaatcagttttgaattcttcttaatgaaactaagtgctttgtgaagagaatattttctttcactgccttttgcttcctgagtcataaaatgattccttgtatctttatttcttacttaaatctaggagtttactggagatataccatggactcttcctagtagtcatcattaagctcatagtaataaattgaaagggtagtttggttaggtataaataaattgtagaatcattgcaacagattctttttttaatcttcaaaaatagtttgaagcctacttgttaaaagattttccgggactacatgtaatgttgccaaattaagcatagatggcgctgttgctctctatactacacatggtccaggccactgattgctttcycattttctagcattttcttaggtttttcaaactgtaaagagaaccatgtcacctccctacattgatatttgttaacatttaaaatatgaacttcatttttagttggaatttcttattgtgagatcacttcaaaaattatccttatatttgtgttaacagtaagaagatacgtacttgtagattattgacacatgcatggaagtgtttagatagaatgcatawggaaagctagcagcagtttcctctggagagggaacttgtagtcttacaattaatgcagtcttacaaaatacagcaactttatgcccttcacaaactttctgttttgcttgcttgagtttttaaaaaatatttgcatatcttttggcaagtaaaaccaacttaatagtaaaactaagaaaacgatcttatctgtaagtatgtacattacagccatttgcctacccatgtggaaacgcacataaatacacttaggaaagcaaacgatcattgttatcctggcagcagtttcttggaggggcatttgcattattggatcactaaccgtgtatgagcgacgcggtttttactaggacgctcctgacgctatacctaccgtccactcatcttcagcttgccgcaggttcgcagctctgtggctgtctgtggaagcatgattcatggatcccgtgagccttgggttctggtcaggttgttctgtttgtgggagagcctacctgggtactgtggggaacaggccgtgggtttgctcagtgggcctggactgtctcacaaagtctggccgagagccagatacactcacataatttccatttgagccattacaaatgagaaacgtctcctgcttttataactcagtaatgggaatgtgactgttgaaaataattattttctttgttttgagcccttaagaaaagagactttattttaatgtttttttttccaaaagctgaaaaaatgctttttaaaaatctttaagtatagtggttatattcagactatatttaatttaaaataagcaaattgtaacaaagtataaatattttaacattcagcaaaatgaaatgataaagctaagagactatcctatgatttgtatatttattggtgccaagaaaagtggagaattagaccttttacaagccgtggtacaacagaccatcctatgttggcctcagcatacagaacagagcagtaagacgctggctgcaaccccagagggactgaagctactcaccgttcctgccccaagatccactcatctggaaaattgttaatgggggcatgctttgtgtgtagcactgtcatgtaaccatttgcttctagctttttgttcctgctattcctgtgtttaaagcacactttgcctcctttttctatgtctccaaaacagcatccattcccagaaggtcgtcctatgtaggtactgaggcttttaaaagatgctacctcaggttctgagagtaatattaaaaagcagctccagatcgaccatgtggtctttgggaggaaggctttgctgctgggatgattgcttggcaacgaatagcatttattgggatatatagattttttatatggatgtttaaaaaaaatcggacttacacttcttttattgtatttattttgatggtttggtgtgatccacatgtgtcttattttttagggttcaggataagtttgaggtgctgaattacacaagcattcctatctttctcccggaagtcaccattggagctcatcagactgaccgtgtcttacatcagttcagagaggtaagactgtggaaatggagaaagctggccrgtggatgagtctgcagcacctggggacaatgcagtcacttctccagaaaggagtttttgttgttgctgtgttttgtttgttttagtgaaggagcctctttttcattgaaataattctcccttttccccgtatttctgtgtggaaagctgatgaagtcctcagatgacagccccagagcagagatgttcttctggaaggttcttcatcaggcatattatcttgataggagaacactctgttcatcagctgttatgtcagtttctttactgtcagatgttacttctggtattttcttactctttgtctgtaaataatgagggttccatttctgcagaaggcccttaggccatatgggaggacatagggagggcaggcagagcttgggacagacagcgagggtggaagttggtaggggcaactgtgtcattgatcttcttatccaattgccataccttcttagtgagttatttgttctggcaagattccattaggttcgaggcgtgtgtaagtttcgctgggaaccagcgggtgagttgcagcctgcactgcaaatcccaatgtcagtggactgggaagagcacgatccatatccgcggcagtggtggctgtggtttgttatgggtaaaagtgaaatagttgtattaaatcagaactccaagctatgccttcaacatgtagatgagttgaaatctaaatctttttgcattactataattgtctgagttgatatgagcaaattgcctgaagcacccactgaaagtctgagtagatccccttgcttgctttcttactctacttggcattttcttttaagtaaattttttggattgttttggaagtggttttattcagtgtgaggatttggggaaaacacataaaaccataaagatatctctcagaggcacctgcggttaataatctgtgttcacctccttctgtctttgtacacgtgtgtgagtgtgtgtgctgtttctccctttgtccttgtatacttgtgtgagtgcgcgtgctgtttctcccttatctgtccttgtacacgtgtgtgagtgtgtgctgtttctccctttctgtccttgtacacttgtgtgtgtgtgctgtttctccctttctgtccttgtacacgtgtgtgagtgtgtgtgctgtgtctccctttctgtccttgtacacgtgtgtgagtgtgtgtgctgtgtctccctttctgtccttgtacacgtgtgtgagtgcatgtgctgtttctccctctttgagtggggctctgcggatttgctgcttccctggcatcaacgctgtagctggtgctttgcttgctgctcttgtgtaggccagaaaacccacacttggtgttcgttccctgtctctgcttttgtgagtggccaggtcctgttgcgtctgtttcacaagtggcttcgcttcttcctgttgacctccaggctgccatcattcccacctgagcttgttcggcggcttcctcttggtctccttgggtttagtctctgccctcagtccttctccagtaaggcagaagcagccgtgatctcaatgcagaacccaccatctcagtcctgtgcctgaagtccttcctttcctgtaggaggtgtgttaaagtctgccactctttgtggatttgtgccccctttccgttttgtgagattttgtctcatgtatgttttagggccgtatgattagatgcgtaccaatttagaattgccttgttaggagggtcacccttttcatgatgatgttttcctctttacctttagtggtgcttcttactgtaaagtttattcaatatttatgtagcatctgaaactttcttttggttagtatatgcatgatgtaactttttctatgtcctttaatttcaagctttctgtgtctttatattcaatatggataccttgtaatttgcagttatttttaaattttttattctgaatatttaggatatttatctgttcacatttaatgcaattactgatatatttgtaaatagttatcttactgttttatattttttctacctgttctatgtattttttcttcttttttttctttattccatttaccccacctatttccctactactagttatcattcttttaatagctttttgttactaaactgataattaaaatatttatctttggtttaatgatgttgaagatcaattagctttccagttccagagcagagtacccactcgcatgttttgcatgatctcggtcgtcttaattctccatacgtgttagtcccacaggcatctgcgactgttcggagctgtgctcggcagctctgcctgcgcattcgccccacggctgcccaccccttccctgggcgctgcgcctgcatgtagcatccttggccttctgcctgaagaattttttgctaatactaaattctcacacttattttttaaaatggtctttatttgatcatcatttttacctatttgtttttttttagtttgggtagtttgggatgttccaaactaaaaaaagaaaaataacttttcctgaaccatttaaggtaagttattaacatgatggtctgttatcttcaaactcttgaatgtgatggttcgccgagtgtggtctcggtgtcaggatcatttgaactgctgttgggaatgtaagttctcaggcttcagtccaggcctcctggactagacacgcaggggatggggcccagacacgcattcgagcgagtcctcctgtcgatgcacagcgcctggtttgagaatcgtggcttgaatgtgtaattctcacaaacaagggtgttctcctccacaaccccaggacagctgtcagagtcaggaaatgagcatcacgcgttactgctgtccagtccacaggccctcttcatgagcatcacacgttactgctgtccaatccataggccctcttcatgagcagtcatttatcctagccatgttcttctgagcaagaatagccaatccagggtgatggcctgcattgaattgtttcctctgctacatctctttgaatctggatcagttcctcaggcttttcttggcattcaagaccttgacatttttgaagactacagaacasttaccttgctgaatatccctcaatgtggttttgagggatatttggcatatggttcccatttgtcccatcactgcttttgttacctttattgcttgttaaggtggtgtcttcactataaagttatcttttactcttaatatttagtcagtattttgagggggacatactttgagaatatgtacatgtcctcttcctcatcaaactttcactcagtagttttagcatccattgattttcttggctaaattattactatgatgattgccaaattataattttctgtttctatcgttctttctgtatgaccaggtagtgtcctactagaagcaagtagtttcccttctccccatttatttattcattgatttccatatatcactatggactcccagattcctgtttattcagatacatctatacttgtttctgtgtttctatttgttgaaaactgtgaatacacaccagtgtcttcagttccagtgcaacacatcaaggttcattttagtgctctcgtggtccatatccttctcagatgatgagaaagccagcccctgtcatctaagtgtatttacctgccggaatcccacggggcgtagctagtctcctgtctctgctaccatggcgtccctaatccctgccacccaggcaggtgcaggcaggcattctccagtcccgcagaacagctttccatttgaacttgaaggaaggaaggctgtcttcattcctgcaggttattttcattgggtattgagttttaaattgccaatattttctttcagtgcttccaaacttcactgttttttatacttctggcttttgtgtttctaatggtagttcctcttcggaagatatttcttatttctctggcaggttttttccccttctttttaaaagagatttttctgacttggttttatgcatttatactctctggggtgtgtgttgtgtaagtaggtgtgcatgtgcgtctgtactcacttggcctgaggttcataacactctttgagcctttggctggtgttcattgtctgtagcacttttttttttttttttttttttgagacagaatctcactcttgtcacccaggctggagtgcagtggtgtgatctcagctcattgcaacctctgcctcccaggttcaagcgattctgctgcctcagcctcccgagtagttgggactacaggcatgcgccaccatgcccagctaattttttgtatttttagtagagacaagttttcaccatgttggccaggctagtctcaaactcctgatctcaggtgatctgcctgccttggcctcccaaagtgtgtctgtatcgctcttgccacattttctgtctgccttggcgtcccacagtgtgtctgtattactcttgccatattttctctctgctctctttcggttccagttggtcatatgttggaccttttcaccatgcaccatattcttcgtgtgtctgctcctttctgtatatcttgtcttttttttttttttgagtgtgcatcagcctagatgtgttcttctaaactgcctttcaagttactaatcatcctttcagctcgttctaatctgttgttagacctgtatttcttatatttgagttttgaattttcatcctggtttgtttttgattctagagttttcattgttataatttcaagtttactgctgatattattttgtcatctaatttcttaaacatattcatcacaaagttacacagaattatctgataattgcagtatctgtgtcttttgtaggcctgtgtgagtggtctggtccctaacgtttggtttggggttgtttaatcttggcgtttggtggcctcatcattggtgttttgttgttttccaatggcagtcattttttgtggagactttgcctggagtcatctcaccctggagaggatgcgctttaccgtcttctggcaggcatggaggtcagggcaggtcccctgagagcgctcaggaagcaagctggtgacgctgggcttccgttttgtgaggtctggagtgtttctagcttgcgcttactgagaggccatttttgccagggtcccttctttttgttgggtcctgaactgcatgtttggccccacagtgcactcctgctgctgaaagctctgccgggcttctcagccccccggctctgctggtgggaccagggagcgcctcagggacgggaacgtgcagcccagctgtgtttgcttcttctctggaccttggcatccagggccctccctgccctgttgcctttacagcctgatgttgcctttgtagaattcttttctacattgtcccctgtttggttgttcaggaggggacagatgtgttagccgttttaacagttacatggtgagctcacctagcagtttttcaatcactgtgttttatgtggttttgtctgcttttcagtttgtgagcattaaagagaatctaagagaatatatgatattgggcttgtggtttgaattaaatgtttagaaatgttaaaattttgaatcgtatttaaatgactgggaaaatccgatttttaaatttctaagcatttcaaaaagtaaacttgaatgtttagaacagttttagatttacagaaaaaccgtgacggtagtagtgagctctcatatctcacatccagtttccattttattaacttcttctgtgagtatggtacacttgttataattaatgaattaataatacttactgkgtttttgttttttgttttttttttttggaaaccgattgtcactctatcgcccaggctggagtgcaatggcatgatcttgactcactgtaacctccacctcccgggtttaagcgattcttgtgcctcagcctcctaagtagctggtattataggtgcctgctaccatgcccagctaatttttgtatttttagtagagatggggttgcaccatcatggccaggctggtctcaaactcctgacctcaagtgatctggccacctcagcctcccaaagtgctgggattacaggtgtgagccaccaaattcggcccttattgttaactaaagcccacactttgaattattcagattaccttagtttttccctaatgtcctttttctgttccaataccccgtctagaatatcacatgacattgggtmctcatgtctccttaggtacctcttggttgtaacattttctcagactttgtttttaataaggagtgctggtgaggtattttgtagactctccctcagttgagggttgcccrrtgtttctctagcgattagattggactgtgtgttttggggaggaatccacagaggtgaagcatcaggggcacttgctgtcagtgcagcctggcaccrtggccctgaccgtgggctcctggctgaggtcgtgcttgctgggtctccactggaagctgctcttcctctttccagaaagccccatgcacaccacagcctttatgttcctttgttgagtaagaattgtctgactgtttagaggattttgtttaaggaaattcggttgcttgatattaaaaaatgatcagttgaaattaaatagtaataaataataatgaccatttctgkaaattcatagaattccttttgtccatcagagacatcagcagcagttctcattgcatttccttctggaaacagcattgtggggatacctggaggtgaatgaacaaagcccctctgggtttcatgtgcagctgtttcagatctgggaaggtttgtggcttctcacaaaaggctctctgcatgggttgcagagctgctttctagattggcttctctgggtactggggaaagctccctcccctccggtagtcccctccctcctgagcctgtgctcagggggcccctcagggagcttcattctgacctgagtgacttcggtagagcccttagcagacaaggaagcgaatactgaaatgtcttgtgtgaagccttctgtaactccttgcacacacccctgagagagtgcaggccttccccaggagtaggaggagatggagggtttttattwmtaacaaaaggccccaccctggtgagagtggcttccttttatctggccacccgacagacagcttgtgctagcagcaatttccatcagatgctgagcggaaaaaacaactgttgctctaaaaacacgttaaaaatcaaaccctaactataaaacccattttctccaactcttttccttcttttgaaaacaaatactaatggtgtaataggaaggcaaatgttcatgaaaatgtagtttctcttggatcatttgtgtttcaggttgccttcatctcatttctgtctagttcagctggagacaacaggcatagctagaaaaatggaaagtgtataggaagagatagggcctggagacaggaatgtgtgcaggtggaggtatgtctgatctcatcagaacagatggagaacatgccagagcccaaggagccatcagtctctgacacctcaactcgcagaggccaccaggcaaagacagttgaagttgtttttagttgggtcacagttagaggttctgaggtttagcaagaattattgtgatgtttgaattgctaacaaaattaaatgctgttttctataattacacgttagaagaaacagtaaatacaatcaagacaagaatctttttagaaaagagttcaggttttgctttatgaaaattgcaaaagacaagtaactaaagaaaagtaaagtcggcctttgtcagaggcgaggtgaacagaattgtttcgtctaaccttgtagctggggatcccctacccgcagcgggctgtgcagagtacaagagagggtcctgaagtgcttctcactggtctttggaggtgggaagaccttctcatcggtcttcaggtacacgtgtcaggtcactggtttgctgcaggggagcaaacagcatttgaggacattccacagaacgtrtgactattagagcagaaggtagttggcagccggttatttcctggagcaagtggaggccatggatgccttttcatggcagtggttcttagaagcccattaccctgctaggcaatttctcgctttctgggagacttttttttttttaatgttgaaaatatgtgttttagccaaattctgccattaacatgagaatttctataatcccaattaattttctaaaaataataaaattactaaaactatgccttataatttcatgagaaacttaaaatatacttgcactgtgcttctgtaaataggtggtctgtgtattgtaacatgcccaggacgttgcatgcatgttttatgatgggtattgtccttgttgatacctggaggttaggagttattaggtagcacttctgattcttggaaaacgagtaatgctttgacctttattctttagattaaggattatagtcttcgtttttcttccaggattttcctgatttttctgactttagtgtttttgtagttttgtgagatgggtctagatttgaatttttctttatgccagtgctatttgcatcttgttggtaggatcttattccttgttggtaattcccccattgcttctctctgtagacattttaaacctagttattttatgctctgtctctggagcgctgctctggacgctgtctgatcttgttcgttgtttcttctttttctcacccatggtggcttcttttcttgactgtgttggagactttgggtacagagcttctgccctgtggggctccatccatgggcatttgrtgagagtgggtccctcctgagtcaggttgccagatgaagtacaggatgccaaggtaagcttgaactgagagcagctagtattttagtataagtatgtcccaaggtttttaaccgggtatcctatatgatttctcagtcctggcagccctactcctgaaaggaccctttgctgctgccaggcctcagattcctgaggagcagggagggattgatggcacctttgttgcttgtggtattccaggccctggaggtaatgcaaatttcaaccctcgaacctgtgtggagagaagctctggttacgaattcccagtggagaatggtttcaccactgggtgccagctggggtctccttgctggcaggaggccttctcccygcactgaggtgtggcccttcaggagtcacctcacagggacaccaggccgtgtcttgtggctctctgcagctcttgggcgtcccgagggcascgcggcttcagctcaccactctggcttttccactcactcttccttcttagccctttgtgatttcttgcggagctcagctgtacatgtagaagcatttccagaggtttttatatcaagaagcttttctgcatattagggctgctgttttgctagaaatggaaggctcccctatttttctttataactggaaaccctgttttggtgctggttctttctgtagccattctgtggaggacctgtctgaattagaaagtctacattttatatactcaataggtatttacccartgaacagtcccccagaatgcagaattgattaaatccccaaccccgaaggcacagaagggaaacctggctgatcaaagaattcttgccttttaatttaatctgagttctatcccagagatagagtcaggcatcttgggagtgctaaggtagtaggaatgacagtttatcccaatacctgctgccaagcctgacatttcagaccccctgcccgacagtgtcatcccagtgtcctaccacttctgcacttagccctgattagatctttatcgtgccaggcactgttgtaagcattggggccacacccgagagtgaagccaagccctgccctcatgcagctcacctcctagtgggcagggagaacagatgatagacaggtaacagggtgccagggtcttggagaaagcacagcgaggaggctgccatgtggagagaggtctcaggcacctgacgcaggggactgagggatgtgggggtgtaggggagcaggcgccacaggggagtgagggatgtgggggtgtaggggagcaggcaccccccggaaggcaggaacaggtggacatggtctggagctagagaagagcccgtcatggtgaggtgtgatgcgggtggggtgagcttgagcagggagtgagctgaaaaggcagcaggccaaggtcagccggggtccgcagctgccacggggacctcagttcagcggtactcctggtgaggtggtggcgttggtgcgccagagagtggcatcatctgggtctcaggtttaaagggttgctctgcttgccacgtcgagtatcaactgtgggggcaaaggcagagggccaaggcggtcagggagggtcctggtggtgcaggtgagagtgctggtgctatgggcgggggcgctgagagtaggcactgtctcttttcccgagagcccccacttaacaggggcattgttgcccctccttgcccagccaagttgcttcttgctttttaggttttcaaaattaagcagactattgctgaaggattccagcagagggagtcagggaagaggtgcagggtggggagcgggctgctgagggcctggtggtggcctttcctcaccggacggtggagccctgggcctctgctgtgttgcctctcctgcagagttgtgtgtgtgactggaggagaggggtggagcsagttcagccagcactggggtctaactataaagcacaatagagacaggtagtggcagctgggtggggtgggctgtggggtggggttctaagataggaatttgccgtttgtaacaaaggaactttggtgtaaaggctttaatttaggaatcccaggcatacttcctcatggatcttttcctgacccttatgtttaatttaatttactgatggatggatgagcccagaaagggttacacaggagcrcacytctcagggagtggtgtgacgctggggaggctcgcccaccctgtgtctgagctaatttctgaaatctgtttggagcttatatattgaaacaaagccgttattctaactttcacatgaaaagagctccatgtcttttaagatacttttttattagagctcaagttcttttataagcagaaactccttttttaggtttctaaaaagcatacaaacggtgggaagacagaattcttccccaaatcacctacaggtggttcgcccacacctatttcaatagaccttattttagcgactcaccttcatcaaatggttccaaagtgtttcagcctagttttaacagaacagcagctcttccttttcagacgcgtagttttcataacatttaattaaattttgcaattgcaatgacaagtacaactggcgtcgctgctgggaaacagaccactgactcataccacttggtgggagggacagaagtgcctgtgggccagtgggagcaggtcctgccacttggtgtcctgtgtaggctggcttgtgagtgatccaatcggggttggtcagaagagctttctgctgaaaggaagaagagctggtgaagaggaccaagctcgccagagtattaggaggcaggccagactgtgtgggccctgggcgccagcagaggagcctgtagaggagcttcagtgtctgtcagaggccgcaggaaggtcaggggtggtgaaggttgaccatgcccaggatactgcgttgatgaccaggtcataggtgaaccttgagagaagtgtcaggagactggtgggaattagagattccatcttctatagcttgttattttgtcttgtttttaagggctaaggcattctcagtgtgtttataggcaaaagggtaagtgcttgtggaaagagggaaaagatgcaagagaggaatgggaccgttgatggagcagggatcccagaggcaggggggcctcttggctcctcagagatcccrgttcaccaagcagggatcccagaggcagggaggcctctcagctcatcagagatcccagttcaccaagcaggcgtggccaggccagatcactgtttgtttcataggaccccaacctagtctgctgaggggaggctggaggggtgggtgagggctctttcctcccatggggagacactctgttggattggccatgtgtggagtggaggcacagaacctacatccagggtgctgcgagcgtagctgagaaagccagctgacccatgctgggtggttgaccaggcccagtgaccacgttggccattgtcattgaagcatctcattccttgattaaaatccactggtgctcttcacatcacagggccagttccagacagtagattacagccatttgatgtgtcatatttacgttctcctagcgtgaaagcagcagtttgtgtgcttaacattataaatatacatggttgaacatcctggatgtgatggctaatgagtctctctggaacagattggttttggagatgtcttgactggcctttaaggggcacggtcgtccagctgtggagcactcgtggagtcagatctccacacagtggttcaggtccctgtgaatcctctcacctgcrtgaagggcctggctgcctcttctaggtgtctgggaagcmtgctctttcccatcaactgcacccttaaatggggactccagaaacaggagcagtgtcaggggcgagttagagggcctagcacgccatactcagggacagtggcgggacgctggcaggagcagtggcagctcatggggctccggatcccaggtgcctgtgctcgcccacctgcacctgccaatggatgggtgactttgaacaacacgagaagacggcagttggggtccagtggccttcgttactgttaggaagaaggtccagttgcccattctagacttgctgtctctcttgtctgtgtttccttatccctgaacctggcttccagtctgagtttagggagatctgcttggcgggggaaggtttcccagctcttcctgtggctggatggagtcaaaggcaccaagacctgagtctgggaggggtccagccaactcgtttttcttcttggggttctgtaatttttgctttgcttgcccttgtgtaattctaagaggtgcacagctgctgtttgggttgcagttgtctaaatcagtggtgccccagaagttgccagtgttctgggagctgctcttactgagagaatcatgtctttttactggaactccttcctagggccactctgagcgctctcagcctctgccacagctcatagtttctggctccgcatggtggagtcgcctcgccttctgctgtggctcctccttgtcactcttcagtacactcaaggctgttcagcctgtcggcgggagctccaccttccctgtgcattcgtctggcccccatttcaccgcactcagtgccagacactgcaccagggctggagacacaacccagtttccacaccctggagactcggcagagacacgtgcgcagatgatgcgatggaatcccagaggctgtggggacccgtgagagggtagggatgtgcggtaggttgctgtgtctggggtctcaagactcgcacctcacaggatgggtatgagtttgccaagtagagtcttggggggggcagttgagggagaaggaggatggctgtgaaggccggaggctgcagggcatggccggcaagggccatgatgtgaagggaaaggagacagaacaggtggggagggtggcgagtggggcgagatcgcacagggtctcagggtggaccgtggagcttactttccatcctaagccacgtgggggttacagcaggcatgagattaacccgaggagttcaaatatagcagagtcagagggcattgcacattgttatgtaaccaagtcttgaattgcagtgtgaagaacttctcatcagcgttgatgggatgattaagaaaggtggtcagagatgttggaatttgaaccagaatttaagattcatagatactgaggatttatgggctttatttagagtaacttcttgactattagaaaccctatcagataaattttaaaacagagacccagagctcaaggtaggactactaaatggatgatgtggagtgatggttaagatgacattttcctggctggtgctgtggctttggttgggaacagcragagatacagaaccgacggtctgggatccaggagggtggctggcaatagggaggaagtgtggacgcttgatccaggaggcacttaggattaatctggcagccatggcctgcgaggtggggagaggctggtggaaggaaggattatgggctgggggctggagtgtcatgggctgaataggacctgacaagaaggggaaagagcagagagactgaggctgaagagggcaccacttctgctgctgatcgcagtggtaacaataccaggtcaccccgagcaccttctgtgtgctgggcactatgctgttgccacaagaagacactattattcttattcccatttgcaaatgagcagttkgacacagtggctttctgaggtcctgcagcttctgggagggcaggactcacatttgggcaagtgtggccgggcggccatgctgcttcccatttccctgcttcttgcagggcccctggggtgagcaccatgcacagactaaggtgtgggggttgtattaggctgttctcgcattgctataaataaatgtctgagactggataatttatttaagagggttttattggctcacggttctgcaggctgtacaggaagcatagcaacttctgcttctggggaggcctcaggaaacttacaatcatggtagacggtaaaggggaagcaggtacatcctaataaggcaggagcaagagaatggggcagcagagtgtcacatatttttaaatgaccagatctttggtggcagagtgtcacatatttttaaatgaccagatctttggtggcrgagtgtcacatatttttaaatgaccagatctttggtggcggagtgtctgtcacatatttttaaatgaccagmtctttggtggcggaggagtgtcacatgtttttaaatgaccagctctttggtggcggaggagtgtcacatgtttttaaatgaccagctctttggtggcggagtgtcacatatttttaaatgaccagctctttggtggtagagtgtcacatagttttaaatgaccagctctttggtggcagagtgtcacatatttttaaatgaccagatctttggtggcagagtgtcacatatttttaaatgaccagatctttggtggcrgagtgtcacatatttttaaatgaccagctctttggtggcggagtgtcacgtatttttaaatgaccagatctttggtggtagagtgtcacrtatttttaaatgaccaggtcttgtgtgaactcagagtaagagcctactcatcaccaaggagatggcccaagccattcatgagggatcmgcccgcatgatccaaacacttcccaccaggccccacctctgacactgtgagttacakctcagcatgagatttggaggggacatccacactctcatttgatgaacatgctggtgayatgggtacacagacgagtaaagaaagaccttttcacagcagagtggatcttagattttcatatgaatagaagggtttatgatttttggttttgttgatcctgtgaccttggagtgtttgtcttgtcacttgtctggctagtgtcctgatggctctcaggcacctgtccacactctaggcgacacccagcgctagggcactgatgcctcaggaatccaagttttcatctaaaacagcgttttcattgggtgcagtggctcacgcctgtaatcccagcactttgggaggttgaggcgggcggatgacttgaggtcaggagttggagatcagcctggccaacatggagaaaccctgtctcttcctaaaaaacacaagaattagccaggcgtggtggcgagcacctgtaatcccacctactcgggaggctgaggcatgagaatcacttgaatccaggaggcgggggttgcagtgggccagaattgccactgtgttctagcctgggcaacagagtgagactccatctcaaaaaaactaaaattaaataaaaataaataagtaaagcagcattttcagtggggcatgtgtacctggggtctgagcaatatatatgaacatgtttttccttagcgaccctcctcattttgtgcccggaattgaccctgtgtaagttcatgaaaatactgaatgtgtgcaggacaggctgctgattttttaaagtcacgttttaaacattgtatcaggtcactttttatttctgtacagcccttctttggattagacaaactgtgatttggtttctattttaccagttcagtctcttcaatggaaggaagccagatgctgttaagatactgtgctccctccttgaagctgatcgttccctccttgaagctgatcgttccctccttgaagctgatcgtgtccaagatagttgctaggacaacagaatcttctgttttctcgcctgctatttttgtttcttttactatctcaagttgttttcattttcagtattgagttctcccttaccattttttaaaacagagatgtttttattaactttaatatgttaatactgtatgttcttgcctttatgaaattcaccttacagaaaggcactaggatcagtttacctaaacatgcgggagacggaaggccagacgtgactgctttagrttcctcatgacattcagaccttacttggaactcagtttggtatctagttgtgttaaaatacaaattttcagtttataagttacttaattaagtttgaaagtaaatgcgtaatgccttcagtgttctctccactttgtgccctgccacctgcactgtggaaattaatcatagaaactcggcgttaatctgtatgcccgagttatttacatctctgtgtatggaaaattatcagcatgtgtccctcgaagaagatgatgagcataaaaggtgatctttaccaggtccattggtttgtatgtgattgctgtggtatgtggtatctgcctgtctactgatggaaagtggtaagatactgtcttacatgcaatctggaaaatcaagtgccctgactttacagtgtgttacatatgattgtatttactttagaatttttagaaagcataccattttcaggtttaaaacaagcacttaggttaggagcttttctattattcacagctaataagagttaaggaggattaagacatttgaactattgttaatactcattgcaacaaatatgacagctaaataatgatatatttgtaggaagctatagttttatgtgttaaaaaatagaacacacattttcaaaataaaaatatggtttttgaaagttgactgttaaaagattttttgaaaatttatgccaattttgttacattcgatttgtgttctacagtaatggaaattaagggaaattgtgtatcagagaagtgtctttaatatctatagtgctcttctttaaaattaatgaaaaactccaagcagaattgattagcatttatatgttataatggaaaataggagttggaaactggaatttccaaatcaccccagaactgtgcagtattttgaagctccttagtgcatctagagagaggggagccagtcatgcttggcataacccattgcttgccccagcagagtgaagcccacccggtacacaggccctcactcaatcgtttttttgtttaatttatatatttacagtaatacaataaagggtttgttgctggaatatacacatatttatttatatgtataatatttatcaatatatttacaaatatatgtatacatgtacacacacacacacacacacacacatccttcatgaaaactctttcagctgggaaactgagcatccttgaatgtccctgaggtgactactaggatataaacatcccccaagagaagtgctttgagttacatacgaaaggacctgcagaaagattggagtcacctttatctgggtagagtggattgtggaccataacctaacagacacccaagaaatctcatagctgagaccttgagcaacatacctttactatatatatgctgattgacagataaatggaaaattggagggaatgaggggaattcagtaaaacctcgtataagtagtatgtgattgaggaaagagcttattgtgttatttttaagagttagcacactaaaagttacaatttaattcaacgaatatttacatgctgtagtgggaaaaagatcctggacttgatcattaaaagatcggggctccactttcagcctgccaccagctagccacgtgaccgtaggcaagtcaagtctctgaacaccctgtctcttttaaaacagagactgtgccttcctttacctcatgctgtcagggtcacaggaaataacactagtaaaaaggtttctacttagaggctgcccactaatatcagtaagtgtatcaatgattgcattggacataactttgtgatgagtaccaaagaaaagtcaaaggatgaagggagctctgagaaggaaggggcattatttcatggcaggattcgaggaggcagaggtggctcaggacagcacttcaaaaagagtgagtggcataggtgttcagtagagaaaagccatggccttggccaggaatagcaagtcagctgccacactcaaggaagacctacttggagacccttgcgatgtacctgggcggggaggtgcttgttcaggaggtttctttggctttctcctgaatgacatttcctgagatatatctactatcaagttaatcacattcactcaccaaataagttcttttctgctttcttcttacaaagtagcatttgagaatgtttttrtgtggcacttctttcattactgtagttctctgataagtaactgcctagagcagtagtagggctgttaagtgttagaggctgtctttgcaaaaactgaaataatgacacagagaagcttgtccataaaaatgaatgattcagtgacatctgttgttattagccaaaccctggataggaactttcttagagggaggtgaggtgccctctctggctgaactacctgctcattcttaccttacatttcaaccatatataatagcaggtgagattcacatttacatcttttcctaagttctttttagaatggttatgtactgtaattccatcttatttcctttgtggccttacgagctacccctctttatttcatttctgatgattgcygtagggtttcaccacgggcaactctaacttgtcacagtcaatccacaccttgtcagcatttaaccgcctcacacagaatgcaggtatctggcccgaggccacagctgttcctgccctctgtgttctttgtgctgttattctcatatactttcacagaaaccacacaatggactgttgtgattttggctttaaacagtaagttatcttttaaagagattgaaacaattttttagtcttttagtcttttatccttccctctaccatttctgatgtgcttcattcctttgtgtggacctgagtttccacccggcatcatctttctcctgtgtgaataacttcctttagcagttgttatagaacagatctgggagcagtgaattctattagctgttgcttttctgaaaatatatagttcaacttcattttgttgagtattttcttttgatatagaattctaggttgacagtttttttttcccctccaacacataaaagatattccattgcctcttggcttgcatagtttctaatgagaagactgcagttcttcctagctttggttcttgtccctgatgaaccttttttccctttggttgtttgtaagattttctcgtgatctttttcttactagtttttcataatttaattatggcatgcatctgcgtggttttcttggtatttatcctgcctggggtttattgagtttcttgggtggcaggattatcattttcagaacacatggaaagtgtttggttatcatttcttcagatttttttctatcctcccccttttggggactcttatgtatccatgcattaggtgacttgctattttccacaggtccctgtgactctgtccatttgtttttggcctttttctttctgtgcctaattttggatagtttctgctgctctgccttcaagctcacttatcttctgtgggtgtatgatatgctgttaattgcattgtgttggtttaggtcttccaagaatcagaagccaagagattagatgtcgaagaggtctgttggaagaaaacacctttgaaggatcggggagaggaagtctgagatggcaggagagcctttgctcttccttgcgggactgtgacaagagacaggaagaaagaatccaggaaagatttggccaggctgatgagtgtcctagagccaaagatgcctgtcagggagtcccatgtccacaggaacagctggcaccagaagctcttctgtgctccatcactgaccaggcacattctgtaacgtgcgtggccgtggcatgaacaggcagcagatcctgagggtcaggagcakcaggagcgttgcagaggagcacactttcctccctgcagtaggagctyggcagagcacattttcatggccaccacacttatccaatagaattgtgttttaggaatcctgttttttagctctagaaattctgtttggtgctttttatgttttccagttctctccttatgtttttcatttaattcttagagcatactgaacatttttataacagctgttgtaatgtctttgtttcctaattcatcgtctttgtcagttctgagttggcttgatattttccccttgttatgggttacattttcctgtttcatacgccgagagatgtctcattgctttgccatacgttgcaaattttacgtttttgagtgctagatcttgttctattcctttgaactgtgttagaactttttttctgacagcagttaaggtacttgcaagtcagtgtaaaccttttgaggcttgatgtttcagctttctggtgagcctgcaatgggctttcttcaggaagggcttagcccagtatcaaggcatggccatggggtccctgttgaatgctgcatgcgtgcagcgagaggcccctctgctctggccagtgggagctcgccgactctcagcyctaagtgaactctgggagtcatctgcttgcaactccctggaaactgttctttcccagaagtcgactttgtccagcttcatggagttttaccccctgcacacactgatggctactcagccagagaccgagtgggtcccctgtgcagatttctggagctctttttctgcctaggccccacccctttagtgctctactccgtaaaatctagtcactgtgtcctgcccagagtcagatgcaaccaccagactcrgtttctccagtttctaaatgtatctggctgggaggcaagtacagaccctgttactgcctcatgaaaggaaactgttgactactacttggcctggtgcctctcacttaggccctaacagtataactgattgcccaggagctgcatagttcacgttaactgaagtctgaagtgtatttcgggagggggcatttttccatgtcagggcttctttaagaccacaaagctgaagtctgtgctcgctgctcagcggaggccgtgctctgcgcattgygtgcatttgctgcctcctccctcctcctgaatggccacctcttccctgctgatccgcatgctgtctgcacctgaagcctctytccgtgttggtcaggtaggatttctccacccttttcgccctccatcaccttccatcttctactttgggcttctcccacattccaactcatttctaggtttttctagccagagaagagaggactggcttcgttcatctctctcaaagtagttaggacacagcgtttcaccagtagaaggagtttcctccattagaatgagtgactgtgtgtgtgtgtgtgtgtgtgtgtgtgtgkatatttttttccttgactgatttctgtgcgaacagctggcatttgaagcactatatagggcatgtctaaattgtgcacccaagagaagagcctgggagaarcctcattgtgcggccttggccctcatggcacagatcccaggttggctgtagcatttagaagtggacacttttctaacatcagaactcatccagtccttacgttgaatcacacaaactcagtggcgtcactttggatcaaagaacagcacgtttcagctgcctctgcgacctcacctggagctggagaatcaccctgttccccgctgttgccaggcgcaggacctggcacctgtaggcacttagccggcacaggacctcgtacctgtgggcacttaggaagtaattgtgggctaagtgaacttaaaccacrtcgtggactcagctttactgtcttgttgttaccttcctgtactttcttaggccagtgatcagcaaaggtttcctttaaagagccagagagtaaaggttcccagctctgcgggccacacagcctctcacagccgctcagctctgtgctgtgtgaaagcaccaccagccagtgtgtaaatgcatgggccaggttgtgccagtgaggcctcatttacagaagcagtcagyggcgagatttgatctgtgggctacagtttgccgacccatgcatgaggcagtaaaaggccaagagcctggtataaattcataacgagaaaccaaggctctgaatcagccccgaagtgtaagcagcagcataatgatctggagcagcatcttggcgttattaaattcaacccattccgatggctgcrtcagcatctattgctctgtttattgtttttccttaagcaagcagttccatttctagaaatttatctcaagcacataaatctagagggggcacatcggtgttatttatgacgggaaaactgggaacagacacagccctaggctggaagaggcacagagtgatgtacagcatgggccagtggttaggagcagactcaggagccaggggacacggctccaattctagctctgtgaacacactggccgtgtgccaccctcagcaagttacttaatctctctctcttaggaaaaaaaaaaaaaaaaaaaagaaatccttgcacatgctgtaaaattcaaaagatgagagatgttccttctttgttccccagccgcccagggcccctccctcaggcagcctggttcaggtttctttgtagccttccggttggtgggggagagggtagcacctgtgtgtgtgtgccattcacyctcttaactgtgagggtcaggaaaatcatcatgttagtttacattaagcatggacttctgacacacagatttgcacrcagatatttgggggaaatcacgagtgggtttgatgagcgtgtccaatactgtctcttctccagtctttcctgtatatgaatcaggatgcacgggtgggaacaagtccggtcctgtggggttttccgggagaagaaagtacagatccacattcccaaacaggctgggccacatccccaagcaggctgggctgcagtgtgcacaccctcatgtgtcattttgtatctgctagtacaaatgtgcacaccctctgcagcctggaatggaagcccaccctgctcatcctccatgtctgggctccatcgggggccagggggagttgtcatttccagcccagccccctgtgaccagcagcccttagggaaaggaacttggtttgtacactgagtcagcccaggttgtcggtgactgggcagggtgcctcccagtgcactgtctaaaatcccttcccagctccaggcctcgccctggaacactccsggtgggccaccagggactgacacacgccagggtcatgggtggagggcagcttagctgcttggctctggaagaggacttggaatgtttggctttgtaatttattgaggttttttttcccttcagtaaacttcctttttgatttctaatggaaaatggaatacagggaaagagcctcctgaaagtgttaaacttatcagagccctgtgaatgtaatgagtccaaaatgccttgaatttagagatccagygagggaaactccgttcgcattgtacagtagaggggattgcagaggatgagcattggaggggtttgttcctttttctgttaggcgctctttcttcttttgctccttaaggattcttggtttgctcacccggtgtatactcggcagaagccctgacttctgacaggaggaaaatgattttcttttcattttaaagtgggtgtacggccttgatagttcacctgagatagttcaccgcatgccctttgcatctcaacctttggacgcacagccacacacatgggtgtcacgcacccgggcaccgtgaacgagcagatccgggaaagcgtggctcgggaggaaggtctgacgaggcccgttgcggctcccggagtgaggctgccctgcgagggaacgggctttgctgctttcctccctgaggcgttatcatgcgcgttttctcatgtgatgaatgagcactgggttttgggggtggaaggcttattttaaattagcagatacagacgtgaagtagacatgtaaacaaagtggatgattttgcattttcctggtgtgagatgctgcaaatgaacccctccccccccgcatggttctctgttggcctaaaacactgaaaagagaccccaggatctgagaaccctcctgggtatcaaaggccagttaactgctgcctgagaagtccagacacaaactttccgagacaattaatggccactggctggacttagcaggtttggtattctgctagtttctattatctgctctgatttaaaattctatttgcaaagatgaaaatggagccagactgtcccaaacccagcccttcctctgtcagtactgctgtgaacagacctgcgtggctggtcctgtgtttgggtaaaacattaaatgacaactttaattgaaaaaccctggggaagctgacccagggcgtcttaagagaggcgcctgctggccgtcgtgtgggtttgcagcaggttggttaaacgggaaaacctttcggtgatcttttgttcaggtgtcaactttctgttctttgggcttaattctgcagttggtcctttagggaaaaagaaatgaatttctggcaggaccacctctcagatgtggaaccaactacagcgttaccgtttcctggctgcggcagtcgtgtttgagtgtggttctgctggaggtgtcctcgccggcagtgttcctggagggccttgctgctttcacagctctctggcctgcccctccctccgggtttgtgttcttggggttgacccacactctcctgcatcctcgacctgttcccctgcacagtttttttcttcctggtgtacagatgtgacccggtatctcccatcataaaaagcagacacccggcaggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccccgctagtgtggtcttttcccaccccgctcctcctgtcttcgtgcagagctagtggccatctggtgaccgtgacgcgaggccccgtatgtcacgcgtggtcacacccagctcctccggtggcctgtgcgcctcactcctcagtccctctgcagcctcaggcctcagccatgcagtgctgctctttggcctcttctcttgtccagcaccctggatggtcggctcacatggcgctgcctccctcagttactgggaggtggctgcacagccctgtcttctaagccacagacgcaggtttccaactgcccacgggtcatctctatggggcaacccgccatgtagcccccacaccctgcacatattctataagcagaccggacacttaccttccctggggctgaccagctctttctctctstcacccaggccttcctgaccccgtcaggccctttgaggccagccccaggtgcccgtcactgctccccggtctagaaatagcacctacagcccgtctgacacaggtcacaacttaggccaaaggtcttgtcagactgtgaagccagaaagtcacgtccctctcttgcggtcttcctgccacttgtagacacctgtagttcgagcagcagtgttgggggatccccctggccctggagggtccctcactctcctgacgcctccctggactctgccagactagctgcctgcgccccctcctgggatcccacaataccaaaccccctgggctgtcttggcatcactggctgaatgacctgggctttcatctcagtctctcttcagatttcaaactcctgaaggagctgggtttttcttttttyktgtgtgtcccagaattctcctggcacccaaacaaaaccgtctgtatccacactgtatcctgggccagaaagctggaggctggctgtgccaccctcccccccgcctttagatgggcattgatgtagttaggatgtctgtccctccagatctcatgtagaaatctgatcccctgttggaggtggggtctggtgggtggtgtttaggtcatgggagtagatccttcatgaatggcttggtgccctcctggaggtaattagtatgttctcacagagtgcrcgtcgacctctcattttaaagtatatggcagctcccacccsctacccgcctcatgctcttgctcttgctcctactcccactatgtggcgtacctgcccctgctttgctttccactatgattggaagcttcctgaggccttcccagaagcagatgctggcaccatgcttcccacacagcctgcagaaccatgagccaattagacctcttttctctctgcatttctcagccccgggtatgtctttatagcagtgcaagaatgaactaacagagcaccggcccctccacttccaggtcccacttcacagctgtgcacctaggagaggagaggctttctggggaggaggaagggtggctcctgggccttgaagatcctagagctttgcctgtcctgtgtgtgagatggctggtcttggggcgacctgtctgctgcttcataggatgcrttgtgtgttcgtctgtcactgcgtggccactgtggcagaggccaggcaaggcacatttcagtgatttgtgatccaggcagccatggctgtgtggatggctgtgaatgcctgctgctgattaggataaaggaaaagctgattcttttaaaaatggttttagtacctgttcttaagggcagaatttggaaggggtgtgtgtgtgtgtgtgtgtgtgtgtgtgtacacaaattgactgtgtgcccatgctgatttgaaaatatgaaaaaactcatcattttcccacctgccatcgctgggcgacacacaccgtgctgagcgctttctcctggctccgcaacgaggtggtcctgcggagcaacactcctctttccgtctcagccagccctgtgctggccgcctaccctcatgaacaggcgtctttgtgctggcaggggctcttgttgccccccagatctccctgtgccctgtgaggttggcctytgtggaccgccacctgagcccctgatctctcccagatggtgggagaagtggggsctgtaacatcctttctgcagctccrtcactgccaagctcagccccccrctggcctctctggcagcatccgctcctcctgggctctgtcgtcctgtcgctcctggatgttcagtggctcccgctagggtcagtcctgcagtgcttccccctcctttgctggttttcctgaaccctgcccatgtctacttaaaaggcctggatgaaactcactttcctactccgccaagggccccttacagccagcggcccggcctctgcaggccctcttcagagggaatttcacgcggggctttttcagagagaactcggtgtttcagttggtgaactgtggttcctgggtcccagccccacccctgtgtctgcgtggstgtccctgctcagggcctcccctaagtgccacccattgctctctgtccccctcctgtggctcttgtcaccctcctgacattaatgagaacactcagtagttcgtttccatttgtggctcccagccctaggacagaagcttctggcaggcagrgctgggttgtggtttgtgtacctgtggcatccttgcactcacaggagacacctgccacagatcatgtgctcaccagcattgctgaaggaactcatgaagtacasgcatctgccgggtagacattgaactatgagctggggaaacattcattcacgttaaacagaatgcaccaatgcctttttcccccacagctgccgggccgcaagtacagccctgggtacaacaccgaggtgggagacaagtggatctggctgaagtgaacgggccgccttctgctccagctgcatcacagtgatggccaagctgcatcagccgcactctcctggacgccrtatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgcygctctgtgtcattcaggttgtgcacattgtttttcttctgacttccagaaataaaagtgtttccatgggaatttccccatcgtacgtctatgtgcgtgcgggcacrtcgaaactgcacacgtgcacacacgctgctctgggccctgtttggtgtggtgtggtttaattgaggcttacattatgctgaagagtttttctaaaggcctactgtatttattttagtaatgtgctacattagagtagaaaaaataagaacgtgaagaagaaatagcaaaaggagaaaattaccacagatttacagaacaatatgttttaagagagaygttgagaaagattcacgtggccgtcctcagcgtctcaaactcctttgaagggagatttgagcttaggctgttgatgacataagatgcaaaagcaaaataatatactctctttattacccagaaaatcaagttgccagtcaaaactgagaaatgagaaagaaaatcagatttctttattcatctctgttgaagcctagaaaaccaaaacaagctggttgtggttcagcatcatggtttaggaatcaagctgtcagttgtgagtcctactgaactgtgggttttccactgtaaagctccactgtgtccattaggaatcaggctgccagttgtgagtcctactgaactgtgggttttccactgtaaagctccactgtgtccaatatggtagctcctagccacatgtgggtattgaaatttaaatgagctaaaatgtaatagagtttaaaattgggttccttggttgcactggccatagttcaggcactccacagccgcctgtgggcagtagttccagtgctggtgcagaggacgatgctctgctccccgcggaagctctaccaggcctcgctgctgcggagcatgcgaagaagatgcacactccttccctccttgcgtccgcctgcctttttccctctccccttccttccctccttctttcctcctccttccctcccttcctttcttccttccatctgtccttgttttcctcccttcccttcctccctgcctctttccttccctccttctcttccttccttccgtctgtccttgttttcctccctgcctctttccttccctccttctcttccttccttccttccgtctgtccttgttttcctcccttcccttcctccctgcctccttccttgttttaagaatttgaaaataaagtttcccaggagttttgaattggagtcgagatttaagtggctgaagttttgcatttcactaggaaaccaacagctttaatcatgaaatgaaagcacagctgggcattgggccagtcacagagtgtcttttgctctgagcacttcacaaacccattgtggaggggaggaaagaaaaagaaagccatctttaattatcttagctgttcctaatgtctttggctgcaaagagctagctgtttccttcaaccttggtggttgcacgggtagtgtcctcagcagtgagagggcaggtctgccctgtggtcaggattgcccttgtgaggggcagagctctccaaccatgcagggctccgtgtcggcatggtgtggactcgggtgctctgatcatcccctgtgtttgcgtctgaccctgtgtggttgcattcccttgatggartgggaagtatgtaatttgtagtgctgaggacattcgtctgtttgattttctggtgttttcaatgacatgcatgttcagcagagaaagatgaataaacactgtccaattcttctctccacatagaagcctcaagaagaggtgaggagatgccccgatttccttatttcagagcagtacatgcgttcgtctcacgaaagctcttacaactaaaacaacagcaccaacaaaccaggatcaaaataatcgtgcattttccaggattccatgttggacttctcagtgctttggagatcaggaaataatcatgctgttgcagcagtatggttttgtgtctggattttattcatacaggcatgtgtttacaggcatgagaattctgtattgaaaagaaagtccttgtttttttctaacgtatctttctgttccatcaactgttaaaaccaaattgttaagaacattgagcttcttaggagagattacatgcagctacttaggaccacctcagcaaaatggagttgcctgggtagatagcagcagcagctcaccagccccacgctgccaggctgctggctgctgtccaccaggcagctgtggaacctccatgttctgcctaggtgttgtggcaagaacagcagggaaacaggcggccgcctccaggccacaggtggacccagggaccttcagttacgccgcttcaattgaattcgtggtggtttctctgctacagcagaagtggaagaagctcttgtcttgtttggcatttgtcccattttttggctaataattggctttgaatttctctgtgccctgcttaccaattatagctttctggattggctgttcttagcagtgcaaatgtcaatgcaaagaagcaagcaggcggctactttctgggaagaagcatagtccgtgctcacactggatataaatctgcaagatttgggggtttggcaaaataggggtggagggaaagctgccatggctgtcagaaattggggctttttgaagaaaagcttgtgtaggcatcagccactggctggccagaattccatgaatggaagcaggtgcccgagtgatctggggctttacatgtggatataaatagaagccgggagcctgaggctttgctttaggaaaatcatgagccagaaaacagaggaggtgattgtcagtagtcacctcacgccgctagtgttttctaatactctctcgaattgtcaaagcaaaggaccttataacagcaacacgtgtgtgactcgaagcagcgagcttcccttgggaaaaggagcctcttctcagcagagggtcccagcctttctgtccttccccatcggaatgccaggctctgtgagtttggatgttggacattgccacctgaattccaggaggccggggagctccagtgatggacttgtccccaaaagagtggtgctgttctcagagccataaatgttccactgaaagtgtctgtcccctggctcacgctggctgcgcttgcttgaaggaggctgatttaagggttctaataggaagacaaatgaaactgtcaaattttatctttaagcatgtgagtaagtttgctcattcgcttttactattgatgtatagttttaaaattcttaatttaaaaattattttaatagtaaatttttcacaagtgaacactttttatctttaaattaaaattctgaagctccctagttagttagatccaattgctggttacattttgggaagctctcattttagtgctatgtagtttcattgaataaacatgtttttaatgagactatacctggtgattatattaaaaatcccagcttttaatttgtaaaaagctgtttcctctggcatgttacgcgtggtcatgtgggttttcttacagtgaacgttgatggggcctcctgcatcccgggcagcatctcagcgctggacacgtggcagtgagagcagaaatgctagcagtggctgaggggcgaggcccaggtggaagcccctgatgcagggttgtgcatgtgcagaatctgaaagctgtgagacttggcgagcccgcagtggaggggggtgtctgagccgcaaggagggtctggcctgagctgcagggcaccccccagagcccactgtaggtgttggagggctgaggagagtgcagagggcctgggaggcgagggaaggagtgaggcggccaggctgggtcaggtgctccacacgcgtcagggagaggaggacctgcagtgactgtcgacatgactttggcaagctctgtgtccgcagagctggagctgagctggctggggcaggagtcacagtgtgggaattaaggaaaaaacaagcaggtagggtagagagccggactaccatcaaagcatgagttttctgctgcccggctccgccgtgacgccactcctcccaccagaacgagcgcgtttgtctccacactctcccctgcttgtcattgagctttgttcggtttaggaagcacgaacagaaaggtggctgtgacaggcagtgggctggaaagtgcatttccactggtctgccctctcctgggacaaggtgagcttggtgcttagcactgggccgtcccgactccaggagcaacgccagtcctccaagcacgggaggcttttcctcctctcagtattgcagcaggcagcgcacagcccttctgtccaaatctgggaacctgaaagaccttcggaatcttgctgttttagacgttgtaagaggagcgggtaggaccccacgtgctcaggccccacgctttggatctaccccctctgcagccagagggacaagcagctgctgtgctggtcatggcctcatcccgtgtgtgacgatggccactcacgtcttctcattcaacagaagttatcaccgtgcgtcagacttttatttggattttgtgcgtcttgcatgtatggtggggatgaccggccccacctccaagtgtaggcgctggagcccctggggacgcagcgctgcttgttcctgacagatgggttgcacccgtgggaggggtccagatgtgctagctcttgggagtcagtgatgggtgtaccgggaatggcctggcgtgcatttccattcagaaactcccagtccctgcctggaacctggctccttttgctgtttttttccccctttcctgtccctttcctgggtggctggtccctgctgtcgcccctgcctccctggctgcagagctttcctctggaggactcgacacagagcctgcgccgtctctgactccgggctctgctgccctgccccactttggtctctcaggttggagttgaggttgcatctgctgagagccgtgcccacaggtgaggtagtatcagggtcctgagccagagtccactgtcccctggccgtgggtttggagctgccagccatccttccctgagaacccagcctatgactcggctccccttgggcctgccctatctttccttcctgccctggtctgtcctgcggccccctcagtcctcatggccaagtcagccaacagcaacccacacacagaggccacttctggatgggtgtctggcaaggtgtgggtctgaattcagccttttgcctcgcgtgccaacccccgtgtcctgggctctccaagagccaccttaggaagatggggagtgggtctggaccactgagcaactggtcattctgcatcagctcctgaaagtcccttgtggaccaggtccctgatgaggacaagctcttagctcagaacaacacagaatccagcgctgaccataggacggctgtctaatggtccttctctagaaacctctctgtgccattctgaaagtggaaaatgccggcattggtcatgcgaccttgcatagctgactattttcatggtctctccacccactctggccccttcatgttttgtggagagaatagcagacctcgccccccgccccagtgttaagaggtgacttagacaccctcaccttgaagttttcacatattttctatccatagtatttgtatacttcacacgaagacttattagtggataaatataataaactccttcctattgaaataaaatttgagaagaacatggtatgtgccagccaaagcccaaattcaaatgaacccttctgtgaaggggaagaatcagtcttgttgagagaaagtaatttagatgcagaaggaatcccagctgcctagaaatccccgttgccaacagcaggcgaaaggaaccacccatgggagggaatgtcgcagggcagcggcaggtcgggcggcagtgcagcagccgtgagaacgcaggactcacacttccgggctgtgtcgccaacattggcaaccagtcgtcacctgccaacagcgccacccacttgggggagcatggatggtattggtcgggctctatccagctgtttgttagcagtgagtacaaaaaaataaaaaaatgctattttttagctggtcagaaatgacttgaaagacctcagactgttgagttaacttaaaacagcccctcctttgcatctaacaaagtaataaaattgtgtgtgttcatccaatgggtaaatatgcagcctctgctgtttcaaggaaagtgaaaggctcagcagtatgtgttatcttgccctccttaaggcatgcttttcctctgaatgtccttggctcagaaagctggttgtcagggagcttcactggggtctctgaggggacttctccagaggagctggtgaaggagcgcgtgaggacacaggagagcagcatctctggctggcactctgcccagccgggcaggttgagcccactttcacaaccctgaggcggtcacagcccgaccgtcagggggaacccactctcacggtcctggggtggtcactcagctggcctggcaggtggcacccagtctcacagccctgaggcagtcacagcctgaccgtcagggggaacccactctcacagtcctggggtggtcactcagcggtcccggcagggggaacccactttcacagccccgaggcggtcggtcactcagcctagcccagcccagcaggtggaacccactccccactgtcacagccctgaggcggcgggggcgtcctccacctcgctcttcctggagagacgccagtgtgtgggtttggaagcggagtctattttaagtttgcagttcctgaaggagcctgtgttggctgtgctgtctccacatggtcacagccttgaagcctccagccttttaaggacaagcctctgcctggctgcctgtggttggggcaagccgctacttacgttcgcggtgcctgttgcgttttcccacctaagagggcacaggaggtggtggaaggggagtggaactaaggtgggggacttgagagcaaactgtgagtgtccagagctgtaggaggttcggagaagacaccgagtgctcctcctgcagggtgagaaaccctcctgtttctgattgcctcatgcaccaccatgctcaggtcacccggcaggcacccctccctggggctgagcccagatcaacgcggagcagtttcctagggctgcggtaagcagctgccttgcactttgcggctaaagcagcacagatctattatcctaagttctggaggccaggaggcctccaatcaaggtgtcagcagggctggtccctcctgcaggctcctggccttcccagctttcctggtttcctggccttcccagcttctagaggctgcctgcgtatatggtcttgtgacccctcctctagtcacctctcctctctgctggcccctgctgcctcccttgtgcaagaacccctgtgatgacattgggccactcagtccaggaaaccccccatcaagatcttcaaccccatttgctcagcccctttgccacccgaggtcccatgtcccaggagctggggatcaggatgcggctgtccttggggccctgttctgtgcaccacagtccccaccttgggccgacaagaaggccctgtggagactggcagccacaggccctgctctgggtggcccttcagcttcttcttacctcccacgtggctggagaggagggtctcacccaccacagagatg

SEQ ID NO: 12540 - DNA, 13614 bp, Homo sapiens
cacttgatcgtggtgtatgatccttttaatgtgctgttgaattcagtttgctggtattttgttgagaatgtttgcatctgtgatcactggggatattggcctgtaattttcttttcttatatttttcttatctggctttggtgtgagggtaatgctgctcttgtaaaaggagtttggaagtgctccatctccttcaattttttggaagagtttgagaaaaacagatgttatttcttctttaaatgtcttgtagaatttactgatgaagccatctgaccctggccttttcttcctgaggagatttttgattgttgattcaatctcctttctcactaattgtctattctggttttctttcttcatgatgcagtcttgataggttatgtttctagcaatttatccatttcttctaggttacccaatttgtgggtgcacaattgtttatagtagtctctcatgatcttttgtctttctgtgatatcaattgtgatgtctttcatttataattttaatcatttgagtcttctctgtttttcttcattagtctacgtttgtcaattttatctttcataaaaccaactcttagtttcgtttatctcatctattgtttttctagtctcaaattcatcgattatttctgctttaatttttattatttccttccttctgctgactatcaacttagtttgctttttttttttctagttccttgggatttaaagttacattatttgagatcttccttttttcttttgttattatttatttattagacttaatgttctgctgaatcttttttaatctaggcatttattgccgtaaatacctgtcttagtctgttttgtgctggtataacaaatacctgagattgggtcatttataaataccataaatttattttctcacaattctagaaactgagaagtttaagatcaaggcactggcatttggtgtctagtgatggccttcttgctgcatccccacatggtggaaggcagaaggacaagctagccaaatggcacatgaaacctcttttataagagtagtaatcccatcgaggtgggaggagccctcgtgacctaatcaactcttaaaggcccacctcttaacactatcacagtggtaacacctgaattttggagagaacacatctagacaatagcaacatccttcttagaactgcttttgctgcattacataagtgttagcatgttgtggttccattttgtttgtctcaagatactttttgctcacctggctttgtatcctctataaactgatgatcctgccttctatgtcttcatccaagaaatccatgtaaaatatggactatgagaaggccaaggtgagagccttgagacacttcattaaaggcttatgccaacattgatatcaattcattaatttgaatcctctaactatgattattaggttattttattttaatttttttttgagatggagtttcgctcttgttgcctaggtgtacaatggcataatctcatctcacagcaacctccgcctcccgggttcaagcaattctcctgctttagcctccccaaagtagctgggattacagacatgcgccactatgccaggctaattttgtatttttagtagagacagggttctccatgttggtcaggctggtctcaaactcccgacctcaggtgatccgcccgcctcggcctcccagagtgctgggattacaggcatgagtcaccgtgcccggcgattattagtttattaatccacccagttgcccttatccagcccatgtatttccatcttctccacaaacatatgcaaaattgttgaaaatcttggagttgaggttattgtattctcatacttgccaatttataacagcaatttaaaaaataaaaatataccggggaatttagtaagcaatttaaggttctgatgagcatcgttttttttgtcagaattttccaaataggccctcaaaaactgttgctagaatcttgtacaggattgatattggactggtatcgtctttgcaaaataaactatactcccctcttgacgtttgttatcttttgcccatttctgtagtctagacacctttgataatgtccataatctctcaaaggtcacaaacaatggtccagtcctctcatttgcaaattggtatctgggactgtcattcatgtagatcaggaaacctgggctcaccgagagcagttaggactccctgatgttcgttcctcccctaactagtgtttgttctccctggttagtctgaaaatcattccctttgccaaaaaagaaatactcaatgcccaagcacctaagtttccatggcacctataaaatactggaagctgacagtatttctgattgaataggtgataggaaaggggtaggggccagacactggagaggactggagagaaagaaagaaaactgtttctcttttcagatgacatgaatgactgtgcacgtagtaaagctttgtctgctatatccaacatctggattagttcagagtttgtttttattgactgcttttttttcttgagcaacattttcttgctactttgcaggttgcactgatgatttttgctttttaaagaaaacaaaactaaaacaaccattccaaagattaatagtttaaaacaacaaccgttttatgggttcttatagattctgtgggtcaggaaatttggagagggcacaataactattgtctgtctctgttccatggctggaaagaccagaaagtggtgactcagttcttggtggaatgacatggagattcctttactagcatgtctgatgcctgggttaagatgatttgatgtctaggcccactgactttactacccacatgtggcttggctttctcacaccattggcctgagtggtctgacctaaacatcttccaaaaggcctcacatcccaacactgttgcattgcggattaagtttctgacacatgaattttgggggacacattcagactatagcacccaccgagaatcaaggggaaaaggcagagattctacctcttgatgggaagtgtgtcaaagaattggcagccattttacaaaaccaccatactgtccagagatttttcattattatatcttgactattattgatgacacgttgtagaaactctggattctgttgttttcctctgaactgtgttgatttttgttccagtaggcaattcaatgacctgttaaccatcttgaactttagaaggcttggttttatgctctattaggtagatctgtggaaagtccacgcagttcctatgaccttctaaatgcaacttcaaaactctgtctcccctgctcatcttgacagggattgattttaagctttgttgggtagatctcactctgggacgtgacccttatttctaagctatggccttaggatgttcatggtgttaataaagtattaacaacatctctcctctctggctgggctggcccccaatgtcctgcaacatgtctctgcctctactatctctgtttcaaccccatagcagtggttctctggcaaacttcaggaggtctcactctgagcaagcactactcggccaaggactccccccacagacttctgcccctcctctccacttggcaatcccctctttggtgacctgtcctgcaaattccagtcactttagctgccccaatctctgatctctgccttctatgctagtgaggcccctgtgctgtgtttggacttcagctcatagcaccatggggaactgtccccggcagacagttgtagggctcaccatgggaatgtcccctctctcaaggatagcagtcttgcactgtctgttgtccactgcctgacaatagctgcctattttctttattcctgggatgcaaggtggtttaacatatgcaaagtaataaatatgattcaccacatcagcagaattgaaagcaaaaaccatatgatcatctcagtagatgcagaaaaagctttcaataaaatccaacataccttcatggcaaaaactctcaacaaactagtcactgaaggaacatacctcaaaataataagagctgtctgtgacaaacccacagccaacatcatactgaatgggcaaaagctggaaacattccccttaagaacagcaacaagacaaggatgcccactctcaccacttctattcaacatagtactggcagtcccagccacagcagtcaggcaagagaaacaaagaaaagacatccaaataggaaaagaagtcaagctgtcactcttcactgtcgacatgatagtaactagaaaaccttaaagactctgccacgaggctcctagaactggtaaatgatttcagtaaagtttcaggatacaaaatcaatgtatacaaattagttattccatacaccaataatgtccaagctgagagccaaatcaagaatgcagtcccatttacaacacacacacacagacacacgcacacacacacccctagaagtatatctaaccaaggagatgaaagatctctacagggataactacaaaatcctgctgaaagaaatcatagatgacacaagcaaatggaagaacgttccatgctcacaggttggaagaatcagtaccattaaaatggccatactgcccgaagcaatctacagattcaatgctattcctatcaaacttccaatgttatttttcacacaattagaaaaaactattctaaaattcatatggaactgaaaaacagccccattagccaaagcaatcctaagccaaaaaaaaaaaaaaaaaaaaaaaagggagaggcatcacatcacctgacttcaatcacatcacctgacttcaagctatcctataaggctacagtaaccaaaacaacatggtactagtacatagtgagaacatgaagtatttggttttctgttcctgcataattcacttaggataatggctggaacagaaaacccagaaataaagctgcacatctgcagccatctgatctttgacaaaactgacacaaataagcaatgggaaaaggtattccctattcaataaatggtgctgggatagctggctatttatatgcagaaaaatgaaactggacccttaactttcactatatacaaaaatcaactcaagatggattgaatatttatttattttttattttttgagaaggagtctcgctcttgtcacccaggctggagtgcagtggcatgatctcagctcactgcaacctctgcctcctgggttcaagcgattctcctgcctcagtctctcgagtagctgggattacagttacctgccaccacacccaactaatttttgtatttttagtagagactgggtttcaccatgttgcccaggctggtctcgaacacctgacctcaggggatccacctgcctcagcctcctaaagtactgggattgcagttgagggtcaccacacccagccagattgaagatttaaatatatgacctcaaactataagaatcctaaaagaaattttcagaaataccattctggacattggccttgggaaacaatttataacaagtcctcaaaagcaattgcgacaaaaccaaaagttgaaaagtgagacctaattaaactaaagagcttctgcaggggaaaaaaaaaaaaaaaaaaaaaaactatcaacagagtaaacaggcagcctacagaatgggagaaaatatttgcaaactatgcagccaacaaaggtctaatatccagaatctgtaagaaacttaaacaattcaacaagcaaaaaccaaataaccccatgaaaaagtgggcaaagaacaggaacagacacttctcaaaagaagacatactaagtgtccaacaaacatgaaaaaattctcagcatcactaatcatcagagaaatgcaaaacaaaactacagtgagataccatctcacaccagcctgaatggtgattattaaaaagtcaaaaattaggtggattgctgggcggacccgtcacggagaagagaggagagtcgcgggccactgaataagcttccaaaatgatgcccacactagttatcctgttgaaagaggggactgatagctcccaagrcatcccccagcttgtgaataacctcagtrcctgccaggtgattgccaaggctgtaagagccaccctgggtgcctgtggcatggacaagcttattgtggatggcggaggcaaagcaacaatatctaacgatgtggccacaattctgaaacttcttcatgttgtccatcttgcagcaaagacgttagtagacattgccaaatcccaagacactgaggtcggtgatggcaccatctcagtgaccttgctggctgcagagtttctgaagcaggtgaaactgcaggtgaaggatggtttacaccctcagctcaacattcgagctgtctgcacagccacccagttggtagttaacacgatcaaagagattgctgtgactgtgaagaaggcagataaagtggagtagaggaagctgctggagtagtgtgccaggaccactctgagctccaactgatctcacagcagaaagctttctttgctaagatggtggtggatgcagtgatgacgtgtgatgatttgctgcagcttaaaatgattggaatcaagaaggtacaggatggagcccagctggtgttgcatttaagaagactttctcttatgctgggtttaaaatgcaaccctcccaaaaataccaaaatccctagattgcccttttgaatgttgagctygagttgaaagctgagaaagataatgcttagataaaagtccacacggttgaggattatcaggcgattgttgatgccgagtggaacattctctatgacaagttagagaggatctatcattttggagccaaagttgtcttgtctgaactccccactggagatgtggccgcccagtactttgctgacaggaacatgttctgtgctggccaagtacctgaggagamtctgaagaggacaatgatggcctgtggaggctcaatccagaccagtacgaatgctttcttagcagatgtgctgggtcgacgccaggtgtttgaagagaccctgattaaaggtgagaggtacaacttttttactggctgcctcaaagccaagacaggcaccttcatcctccatggtggtagtgagcagtttattgaggagacagagcggtccctgtgtgatgccatcatgatcatcaggagggccatcgggaatgagtcagtggtggctggtggcagggccattgagagggagttctccaagtacctccaggattcctcaaagactattccaggaaaacaacagctgttgattggggcatatgccaaggccttggagattgtctcattccagctgtacaataatgctggctttggggccacagagattctcaacaagctgcaggcatggcattcccaggggcacgtgatatgaggtggacatcaacaacgaggacattgctgacaactttgaggccttcgtgtgggagccagctttggtatggatcaatgccctggcagtggcctcttaggctgtgtgcctgattgtgtctgtggatgaaaccatcaagaaycygattgactgtggatgctcccccagcagctagctggggccgtggtcgtggccgcccccattgagaggcaccccgcctatcacatgactggctggcaggctggctgcagggtgtgcttactctccttggtttggttaatagactttacaaggaaggggtagtcactggcccactctgttctcactggaggctatttaaataaaacttgagactttggggggaaaaagtaaaaaaatagcatatgggtgatgaggctatagagaaaagggaacactttacactgctggtgaaaatgtgaaatagtttagccactgcagaaagcagttcagaggtttctcaaagaacttaaaacagaactgccatttgaccagcaatttcactactgggcatatacccaaaggaaaagaaatcattctagcgaaaagacacacatgctcacatgttcattgcagcactattcacaacagcagacgtagaatcaacctaggtgcccatcaattgtggattggataagggaaatgtggcacatatacaccatggaataccatgcagccataaaaaagaacaaaattgtgtcctttggatcaacatggatgcaactggaggccattatcctaagtgaattaatataggaacagaaaaccaaatactgcatgttctcattcttaagtgggagctaagctttgggtacacatggacataaagatgggaagagtagacactggggactatgaggaggggagagatggaggggcgaggactaaaaactgccattgagtactgtgctgctgctcactacatgagatcattcatatctcaaacctcagtgtcacacaatatatccatgtaacaaaactgcacatgtactccctgaatctaaaatgttaaaattataaaaaagagaaaaccaaaattacattaacatgtttctcttacaatcctgttttaaatataactagaattttctgttactgcatagcttttttcctagtttgaaaatataaaataataatgataataaagaggccaggcacagaggcttatgcctgtaatcctagcgatttgggaggctgaggcaggggatcacctgagcccaggtgtttgagaccagcctaggcaacatagtgaaacgcccatatctataaaaaaaatctgaaaattagctgggtgggatggctcatgcctgtggtcccagcagtatgggaggctgaagcaggaggatcgtttcagcttaggagttcaaggctgtagtgggctgcgttcacacctctgtactccagcctggacaacagagcaagaccctgactcaaaaaaaaaaagacccacaaaaaaagcccccaccaaatctattgcaacatcagtcaaaattttagttctacttattaaatacaattttattcttatagcaagtattttaaaattgttatctgtttttttaaatatgtaaaatatcttcttgtcgaagcgacaggtgctttgaattgttacctttatgtttgttgaaactatgaagaagagattaggaagactttaggtttaaaatggaagacagattacatatattatattcttgtaaaactatgaaaataaaaataaaggagtaaaagtcaaaaaaatagctacctatttaattcagtttcatgatcataatagaagggatagtctgaaaacagagttgcaaataagtttataatttgtaaagatctgataaaaattatcagatgataagaatttacaaccatatcatcactgagaatggaggagaaaaagaaagatttccatattacatttatttagaaacatgtttggtgtgtctattttaaagtaaaattaaaaaaagtacacacacaattttttttttttttttgcattcagtgttaaagtgtttatcagaaagaactacttgtgtctgggctcagtggctcatgctataatcccagcactttgagaggctgaggggggcagatcacctgaggtccgtagttcgagaccagcctggccaacagggtgaaaccccgtctctactaaaaatacaaaaattagccgggcgtggtggctcatgcctgtaatcccagctactcaggaggctgaggcaggggaatcgcttgagcctgggagatcgaggttgcagtgagccgggatcgcaccactacactccagcctgggagatagagtgagactctgtctcaaaaaaacaaacaaacaaacaaagaattacttgcactgtgctcacataatttatacagtcagttctgctatatcaggttgtttgaaaaccgtactttattccaatgcaaatgatgtattagggaagaatttcagtgtaatgtgaattgcacgtttgcttatgagtaacttagtctgtgagaaatggtgaatgcagaaaactgcctcacaaatgattatactacctctcaaataatttccaacaactcttcttcctccactgcgtagtaatccacaagctgctactcttctaactcccggggatccatgccctcccctctgtttaattcccccaatttcctcttattttccatttttcctctctgttctttgcttatctctcttttctccctcacttttcttctctccctctcacacatagaggagggggtgttagaaccaggtgggctggtggtaggatcataggtccacaatctcacgagcaaaggctcactgcagcttcagattcctgggctcaagtgatcctcctgcctaggcctcccaaagtgttgggattatagatgtgagctgctgtgcccagccctatcttttaaaaaatatgtactgaaaaaaaattttttttttttgagacggagtcttgctctgttgccaagactggaatgcagaggcgcgatctccgctcattgcaggctccgcctccacttgactcagggaacacacagcagtgggagccaaggctgtcagcgatcgaggaccacaggtgaacaactctgcgccgccgtggtatcacctctaggtggatcttctgcctttaggaaggagacaaaagagtgcagaaccctgggtcagatcagctcaggattgacccctccgtgatctctcaggactcagatcccacctctctctcagggagagatcagccgctattgttcacattctgcctctctgtcatctagtttatgattgttcactttccgttacttcatcattagttagacccagaccccagcagagattttaggggttcagagccaaggaaggcaaagtatcagtgggaacacagtgggaaggcccacagcgggggcaagagtcttccagctgtgggcaagggtatccctgcggcaggtccagagcactgagggtggggcttggcacgacgccatttgccaggattcctgtgtcaggggtgaaccagaaacccaggtgtcaaaggaatcccaccttctagtccttgctgtcctcacagagtgtctagggttcactttcagccttcccttctgctcacaatcccctctcccacggtctgtgtggccctgcctccagcctgctttgttggagcccaggcagccttcttcattatgtcctcctaggaattaaacctagagacccctcaacctttggcatgtgatatactttcccatggtcagatggtcagatcatcaagctgctgccccacccaaaattgtgtcttgcccaccctctgtgtttctgtccatcagaccacccatcacataggcaacccctggagagtgaccctggtttaaagcccgactttgccaaaccgctgtggatgcattaatttggaaaggtccctgttcacctcagggcccacttgcaaagcagagacagtccccgagactcattcagcctttgcctttctcctgttggccagggacagagagggctcaacttgacccagagctaagcctctcaggtcgtgaatgcccaggcgataaatgaaattcacctcatcttatgtctatggtgagatttggcaggggtcttggggagacttagcaacctcatttctccctgtcctcatacaggacaagccctgcccctaatccagaggccagttggccccatctcatactctgttttgctcacagtatacctgatgccctccctcctgacctgtgattgggattgagctgaagatagtcactgacatgattcaaaggattagcacttggtacaggtaggatggtggagatgtggttggggacatggatggttgaggtgaaatggaacagaagagtgcaggttcttgtccaagctccatacccaggagatgacccttacctccgctgccactcaagtcctcacatgtcctgagcgtctactatatagcagccatgatagattctcaggttacaaaagtaatgtcctcaagtaagcgcatcaatttactgacatacacccaatcataaaacaatgtgataatttttctgtggtcagagtttctgagctacgagtgggggtagttaattctatccaggaagaatggtgacttcttagaggaggtgacagttaaactggacttggatagctgtctggaattcggtcaggtaagaaagaaaattccaggcagagatgagcatgagcaaaaaatttggcagcaatgatgcacggtgattcagagatcaaaaagttcagtgtggatgcctctagacattttcttatctgtgtctgatagattttgatattttgtattatcattttcattcatttcaaaatactttctagttttccttgtactttttaatttgatatatagttatttggaagcatattatttgatatccaaacatttgaggatttttccagatagcttcctgctgttgatttctagtttatttccattgtgcttggacaagatgcttcgcatgattttaaccctttacatatgttgagatttatttatttatttatttattgagatggaatctcactctgtcacccaggctggagtgcaatggcgcaatatcagctcactgcaaactccgcctcctgagttcaagcgattctcctgtctcagcctcccgagtagctgggattacaggcccatgccaccacacccggctaatttttgtatttttagtagagacagggtttcgccatgttggccaggctggtctcgaactcctgacctcaaatgatccacccaacttggcctcccaaagtgctgggattacaggagtgagctatcacgcccagatgagatttattttatgatccaaaaatggcccttcttggtgaatgtccctgtgtatttgaaaagacactccctgtcaacccctttgctctgtcatttagctttgatcagctttttctctcttctgtcacttcagcagaaacaatgcccagaaatgccagagacaacaaaataggaatgtgtcatgggcacacaaagctctttttccctgggtgctgctcttccccgtgacagagaaatccatgcgacacagtggggaggccctccccaaagggtggcagatatatttttttccccttgaattgtaatacacctttccccaggcccactctgcctcccacttctgttcagctcagctgtgggcactgacctccaccggcgcttgatccctgcctgctcctgcccagacaggaagcccttcagcagccgactcggttaccaggatgaggctagaggccaggaactcccaggtgtctatggaggtcccacctcctttaaatccctactgttcagacccagcttctaaaactgttcttttgcctcccttcctactcaccaatccccttcactattgtcaatggcactgaagtcccagcctgcttggttggggcagttaagtccttctcagtcaccttccaccagggattaaggtgggacccctttgcctgcagctctgtgggtgggaccccttcctatctcagcatattcactccctgggttcctgctgccatcacaccacccaccacacgagccccttctggaccagtggcccttatctgactcaagccatatcttgccaagcctgttgtgacaccgatcttggcaaactcacttttcatgtcagggcccctgcaaaacagacacatatctgagtcatg

SEQ ID NO: 12541 - DNA, 18693 bp, Homo sapiens
aatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtattgacacccatggatccacctacacctgggcctgggttgttcctgttggagggaagtatcagagctagcagctgctgaggtgggctggacgttggagctgatctgggaatgggaaggtcccaagtcctgtgaactacatcctggttttgcatcctgtacccagaaaggggagaaggtgggcatttcccattcgaatacttaggagtaggggctccaagttggaatagacgccaagcagggcacaaggaaccaagctccagaacaggctgcatggacagcagggcaaatgggaagcctggcaataagcacttttcctcacacttcaggtaatgctgcttgagcacacacccccaggcagtgccattctctccgtctctgccactgatcgggactcaggtgccaacggtcacatttcctaccacctggcttcccctgccgatggcttcagtgttgaccccaacaatggtgcgtctttcccaggatctgccccttgcctttgactgtgttgggctgtaatctgacctcattccttgaatttgttactcaaactctttaactcctggatctctggcctagggaggacatttcctcccctctgtcttcattataagccccttgttgactgcatgtctagaagctgttccctaagctgtgaatccttgaggccatccccttgtctcccagcagataggccattccctgagtctgacttccaaaaccatttcctagatcctgaagggtcactcttctgttcactcacagcctttgctgaatatatttctttcccttccgttctcatctcagggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtctccagctttgttctatagggatgactggaagacacctggcagagtattgtggatacctcaggaggcacagaggggtggtggggtggggatggcactgggagctcaggagcctagcctgaggctgatgatcacatctctctgcagctattcttttccctctaatatgggcaaagaggccagcagggccttgagagggatcagttgggtgggagaggggatcttggggatgagcagctctgggcccgaagttcttaaaataagttggggtgggtacaagagcagtcaagtggtttatttgttcttcttgggggccactaaaaatccacattgtaaaaagagctcaatttgttgagcctttgtcatgtcaggctctctgcaggtggctgccttgcttaatctcagtgtaaattttcacagtcatacaaagggatttgggaaccactggtgttgcctgttctttggggagccaggctgtgagggaaaggcaattggccagtgtttgagaagttcatgagattgaggaaattagaaaaaaaaaaaaaagttgtggtcaaagggaaatgtttctgagcatgatgctagtaaatacagctctaggatccacgcttagtgggaaactggagggatcaatggacagagagaagtcagattaataggagtgaggaaaaacaatggcttgaaaaaacagaaggttatagtctaagaaagcattctataattataatttcaaaggtagagcagttttgagagatagcaagcccaatgcagccatgggactggtttgcttaagtgaagtgaaggtaatgctcactgggtttaatgagatgaagaaatggaaggttagggtgttgaatgggtcttttacctagatattttgatcatctaggtcaaatgatcgcaggagttgggatggacagaaaggtgaagtgccataatcttcagtgtgggaatataatctataggttaatggaagccagtggcctgtaggacaacagcaggagtagagggatctatctaaaaagtattgaggtcagaacaagggatttcacatgagtattggattaatggttttggaagttaaaatgacactgctgacaccatcttccatatggatttttggggggaaaaaaaggaagactggaagggaattgaatcctcagggttttaactctcattgaaaatcctcttgtaatgaccccagttggaagtagtaaactcagacctccttgtgggctttgagttaccattagaagaagcaaaggtccgtttccattttatccacctgagcccactaaacaagatgcaagattcctccatggcccttagaacaaagttgatttccttgaaaaccttgggaacccataataaacaggaccccagctgattgtagatctcctgggaagctacttaaaactggaaactgatttgaataaaaggatcctggtcttgcaaaagctttactctgttcataaatgtagtcgtaaaatgaagacaaaattgataatatggggacataaaggataaaagaggaaaaaaattttttcactgcaatctttcgaggcagatcacttttatataagtctccatattgtaaatgcagaaacctaggctctgagaggttattttgctgatgtcatacagctaggaagaaccccagtctgtgggtctctacagcccactcacttgtggtgattcccaggggaccaggctcaggacgcaggtggggagccctgggcttactcagtgcttgactggccagaggggagaatccgggtggcggccccacccttgcctagcatttgggaccacccatgcaagggaggagccagtaccgtcactagttactaggcagaggggtagtggtggtggaatatagagctcatgtgatccgtcacatgacagcagatccgcggaagggcagaatgggactccaagcctggtgagaaattgagagggctcgggagaaagggatcacgttggagggagcacacattgggagggtgggaacacaaggacaacgtagctcccactgaaacccacctgctgcccctacagcctcctagggctctttgccctcatmctctctggcaaatgcagttacagcccggagcccgaccagcggaggacgtgagttgacttagcacagactgcccccttccccataccctgttctgcctcccactgtcctggtcctagcttctctcacccccgtgccagctcctagtacgcactccatagcttcatctctatgttcctagcctcagtcccctatcattcacctcatgtgatctgtatctgctcctaggatcctccccaaggtctcagctcctaatctggaaccttccatgaccaatattttccatctccaccctaaccaaagccatgtccctgacccctgaccctacaggctgcccccaggctgggtgtccctgggccgtgcggaccctgaggaagagctgagtctcacctttgccctgagacagcagaatgtggaaagactctyggagctggtgcaggctgtgtcggatcccagctctcctcaatacrgtgccttttgggactgaggacaggatgtgggatgcggtggagggacacagggctgggttgggcatggratggcgatcatgtcagagcctgccaagacacttgtgttcctcaggctagaaacctaaaaggggatgtggttcagtatacaggctttatgatcaaatacgaactcaaattctgactctgctacttactagctaccaggcatctagtacaacttacgttcyttcccctaccctcaaatccattctaatttcctcttttgttcacatactaaggctgccagttctaactcccaaagagcctttggattaatctccttcttgccgtcttttgttacgaccaactccgttatttattcccactcctggactactgcccagctccccagctgatctgcagtctcctccctccaccccacccctcactgtactcccccactctgcttcaaaacagtctctccaacagtcaaaatggattggttccttctcctggttaaagcccttcacagcagggggagtgtgtgcttgtgaactgcagaggctggggacggggcagtgtgacactagtgtgcatggcaggaaacagtgactcaccatcgtgttaagcttaaaatcaamaagtatgcaaatttgagctaaactgaataactggtrccgaaagatttgaaaacatttaccggacataagcttaaaattaaaatggaaaatttatatgtattaacctcattcattttcatgatcatggcaatacatgctgtggtgcgacatttgcaacttactggcctttagggtaaatccatattattggccatggcatttcaagtctctccagccttttcttcctctgcttcccaagtacaccctacacctgcacacatagccctcctttaccctgttccaggstttgggaagtcctgatgtctcatagttgaggtccaaaagggggagtttgggaaagcaatgaatgagggcaagtgcctcttctgaatccctgcaggaaaatacctgaccctagagaatgtggctgatctggtgaggccatccccactgaccctccacacggtgcraaaatggctcttggcagccggagcccagaagtgccattctgtgatcacacaggactttctgacttgctggctgagcatcyrgtgagaggaaatgattgctccatggagggcaccagtcatcccatcagtgagatggatgggagggagttgagagcttgctggggcttgtgggtgggagctaatgcatggggagacagtgactgactgcccagggatgctcagaggtagcttcttctgttccgttttgagctttctgacctctgttctctgacctccagacaagcagagctgctgctccctggggctgagtttcatcactatgtgggaggacctacggaracccatgttgtaaggyccccacatccctaccagcttccacaggccttggccccccatgtggactttggtaacacctatggggtgaatgggggwtgggrcacacagatccaggggctgaggaagtttagatgccattggggactgggggtggggtgagttgtaaggtgggcattacagtctataagatctcctcaagcctgacttctccctacagtggggggactgcaccgttttcccccaacatcatccctgaggcaaygtcctgagccgcaggtgacagggactgtaggcctgcatctgggggtaacccyctctgtgatcygtaagygatacaacttgacctcacaagacgtgggctctggcaccagcaataacagccaagcctgtgcccaggtgagccaagcaaagagccccagggtcctcayagcctccccacagtgtcctcaattccttaccaccctgggactcaccctcggacccacgatctctgctctgactccctccatagttcctggagcagtatttccatgactcagacctggctcagttcatgcgcctcttcggtggcaactttgcacatcaggcatcagtagcccgtgtggttggacaacagggccggggccgggccgggattgaggccagtctagatrtgcmgtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccctcaaaaaaaaaaaaaaaaaaatccaggccggcatgagggacaggagcccttcctgcagtggctcatgctgctcagtaatgagtcagccctgccacatgtgcatactgtgagctatggagatgatgaggactccctcagcagcgcctacatccagcgggtcaacactragctcatgaaggctgcygctcggggtctcaccctgctcttcgcctcaggtgacctcctaccctaaacttagacaaygcttacacctctgyagcctgggwgctttgactccacagtgatccctgagcctggtctctgactcataatctgaactcagaccttccagtagggaccactgacctgacctctacactctgacctcctacagtaacaaatttcccctctgacatccgaacccacatactaagccctaaccaattaatatgaatgctrcacttggtctctctcaggtgacagtggggccgggyrttggtctgtctctggaagacaccagttccgccctaccttccctgcctccaggtaagtactctagcctaccactcaggtataaccaccacctttcacttgtgatctcatgatgtagaacctttgtcttgaccccaccatgtgctcctgtggttcagccttaagctttgcctgccctggttgctgtactcctgtctcttcttcctgcaggtcccaggccccaaatctcttgtgtgggatacagctcccattgttccttttcgtcagttcccaggcatttkagtggaagatttggtgggtgttctgtasagaaaagtgtgcacagtcacctcrggccatgccttgaaggctcaaaatctcttagtcaatcccatatacatgcttccccasagagtctagttcctccagcaagacctgggctatactcacccctccccacatatcttggaggtccccttgggtcccctactatccaaatgctgtcttctcccctcagcccctatgwcaccacagtggraggcacatccttccaggaacctttcctcatcacaaatgaaattgttgactatatcagtggtggtggcttcagcaatgtgttcccacggccttcataccasgtasrtgtgtttgtgtggatggatgcagggtaagagtgaggatgggggatcctcagttcagctgactgctgggcaggccacatgccaatactcactcaaaaatgcctttcaggaggaagctgtaacgaakttcctgagctctagcccccacctgccaccatccagttacttcaatgccagtggccrtgcctacccagatgtggctgmactttctgatggctactrggtggtcagcaacagagtgcccattccatgggtgtccrgaacctyggtgagaatcagcccatctccaaactctcactcaggaactacccttaccccctaacaccttgaacaccttgcacctagaacccctgactccttagagatgtcygatactttaaagcrtcactcccaaaaagtccaatcactcagaacccctgacctctacttgcaccttcactcttgtaggcctctactccagtgtktggggggatcctatccttgatcaatgagcacaggatccttagtggccgcccccctcttggctttctcaacccaaggctctaccagcagcatggggcaggwctctttgatgtaagtatggaagggaagggtgtggacgttttcaaacaactatggggagtgctaagggggacttgggggcagttagggtggtgtggaatagcctttgaaatgtgagtacagggtgaggagatayactctttaagtactggtactagtaggcccagatctgatgccagcctcctccctaggtaacccgtggctgccatgagtcctgtctggatgaagaggtagagggccagggtttctgctctggtcctggctgggatyctgtaacaggctggggaacacccaacttcccagctttgctgaagactctactcaacccctgaccctttcctatcaggagagatggcttgtcccctgccctgaagctggcagttcagtcccttattctgccctrttggaagccctgctgaaccctcaactattgactgctgcagacagcttatctccctaacccygaaatgckgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgtccaccttcccaaccccaaacaattccatctcgtttcttcttggtaaatgatgctatgctttttccaaccaagccagaaacctgtgtcatcttttcaccccaccttcaatcaacaagtcctcaatcaacaagtcctactgactgcacatcttaaatatatctttatcagtccacaagtccttccaattatatttcccaagtatatctagaacttatccacttatatccccactgctactaccttagtttagggctatattctcttgaaaaaaagtgtccttacttcctgccaatccccaagtyatcttccagagtaaaatgcaaatcccatcaggccacttggatgaaaacccttcaaggattactggatagaattcaggctttcccctccascccccaatcatagctcacaaaccttccttgctatttgttcttaagtaaaaaatcatttttccwcctccctccccaaaccccaaggaactctcactcttgctcaagctgttccgtccccttaccacccctgatamaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcaytgcgccccctgtgcctacctctagcattgtaacgaccacrtagtattgaaatggccagtttacttgtctgccttcctttccaagaccgttggtgcctaraggactagaatcgtgtcctatttaactttgtgttmccaggtcctagctcaggagttggcaaataagaattaaatgtctgctacaccgaaaacctcacgcctctcattcgttgtgatttttgcatatgttgttgactcaggctgaaactcctcctcctcctacagcagcactgtgtgccgccccactgctgcccccacctctcggggcagctggcggagaagagagggggctttccaaatccactatgaatccttaaaaggctgaataagggaacttgaaacgatgcagacaggcaggcaacccgtagtcgagggacatagggccataaacgtcgaagccaggtcttgagcgtcagacagaatgaggtgtcccagagcggcggaggagagccagacgcacgctggttccggtctggacggaatcgccgcggagcacggcagaggctagggcggaatggctacggcagcgcagttcgccaaggctcggtctccgccctgcagcctatttcctctaacccgcagatccactatgggaggaggcggggagcgggctggagagcactaacagagacaggcggggcgagtcgtgggcgcgtgacgtcaccccggggtgtgcgcggcgcgagcggaagcggaagcggctctgttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcgggtgagggccgggacgggtgagggcgagggaagcgtcttgggctgggtccagcggcgggtgagggcagagggtatagacagacctagctggggccctgcgcctcccacctctgtgtctcattttgctggttctcctccagctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcggggctgatccctcccatgttgggagacaccatgtggcaagtgacaaagctctgagcccgcccctcttggggccacagtggtagggatgggggaaggggatggaccccatggctggggtagtaccatgactggaggcgggggaggcaaccagaggcctgctgctttggggaggtgcattcccccaaccatgtcccgacacctctggagttcaggcaaggaccttccagtcctacttgtcctgcatcttctcaaggataggcacaatcatgtcaaatttgggtcgctttgcagggtcttcattcatgcagatcttcatgagcttacacacatgaggggaaatacctggtgggatggtaggccgaaggccttccaatgccacctgcgaatacaagaaaaaaagcagcctcacaatttgagtctgtcatgtagagagaagccactggcccttgggacaggattactgtatatccgaacaaatatgtgaggagccaaggcccactacagttattttcaccatcaccaaccactcccgcaacacaaatgtatgctgttgtgctctcaccttcattccaatctccatattggagaggtcagcaaagggtacctcccgtgtcaccagttcccacagaagcactgcaaaactccacatgtctgctgagcgtctgtttgtgtcttcaggcttcttctgcagagctggagagatagggcttgtctgttctggcccccttgcctgtcctgtctctgcccccttccactacttctgaggtggtccttttttacctcccgacatgatgacttcactcaccttcgggggctacccaggcaggtgcatacatgcgaccaggacattggaaagagaacttgacatcagccatgctaattcgggcagtcatgtcctcatcaatctgaggaagagaaaacagatagaaggaggtaagtcatagataggcaaagggcttttggggcctgggccaggagtgagcttgtggcctcaccattacactacggctattgagtgcatgtcgtgggatgaggggctctagtgtgtgtaggaaggccatgccccttgccatgtccaaagcaaacttcacagcctggctctggtccacgacgaaatctgagaggaggcaaaagtcaaatagttcagagaggctccctctctgccatttcctccccaaggaaattcaacatccctactcactggtgccttcatgtagtacattgtagagggatccatacggcatccagtgtgtgatgagagtaggatgaggagcaggtggagactggcaggcacctagcactgggagcacatttggatgcgagaaaatcctagaagagggagggagtggttgagacccagtacaaaagatctctttcagtgctattcagggttccttggaactagcagcttccaggttacgccttgcactacctgagccggggacactcttcattgaagtccctgctcttccttgtactccagtctcgaaccttcagcaccttcacgacaatgtcattgccctgccagcggcccttccatagctgcaggacaggtaggggttaggaggcttgaaatgttgctgccacttccttgcccactaactggaggaaaaacttaaaacaggtacaaagcaagtaatttatgggggtttagtgagggaagggcaagaagggcaggggtcacctctccagagtgattctcgttgagcttcgtcaggaagttaagctgtttgaagtcaatgccagagtgtttgttcagggttccatttcctaagagtgtgggcaggtcaggtacccagcttcaccctaacccagccccaagaggccaggattatttccttttacaacccttcttcccacagtggtgactcacggggccgagtgcgggtggtccccttccagaatgtgtccttgtatggaatacggttgagattctggcccatcttctctgcccgctctagggaagaaaaacaacctaagctgtggtacagagggagaagacaggtgggaagggacgagaggacacaagctaggggatggggagatggacctcggagaagctctctcaggggtgccttggctttgtccacaggcatctctccatacttgttacagatgctgacaagggccccatttgccaccaggtcctggaatgaaaaggccattatgatgagagccactgctacctcgctggcagtcactgaaccaaccatgaatgcacaaatgtagaacttaatcctgtaagtgtcacacagtagtactgacagaatgggttgagggttccaaaatctcccaccaaggctcagactttacttcctacccatctcaggaattaagggctgagtactcacctctgccacttgatcttggccccaaaaacaggcatagtgcaggggcacattcccgtgttcattcactgcattgatgtctgccttgtactgcaatagctggaccccatggccagacaaaaagaagaggcagaaagtacagtcagttccaaatgagatactggtgtcagggcatgggaaaagggggaagagcacacatgctttctactgtatgttacagtgcctgtgactgaccctcatggcatgtatgtgatgtggatgacgaaggagtttgtacgtaccttctgtacaatatcacggtgtccatgactggctgccagatgcaggggggtgtcatccccacggttcattacattgatccgtgccccccgcatgatcaacatctcaaccacagcagagcggccctctcggcaggcccagtgcaagggggagaagccatgatcgtccctttgaggaaggggcaatggtcattgagctggaggtgggatggggcaaaggttttgattcctgaaaaactgataattacatactctctgggaaggcttacctctctaggactttgattctcattcatgccagcaactcccaaagctgtccatttcagaccttcccctgagcttcaaaccaaaccaaccacctagatatctcaacaacctctataaaaaaatgtgttatcttcaccatatcccacatctcatttccttaggtggtagtgctcttcccctggtttctcttgcaccccttctgcaacatctattggtcctttctgttttccaccacatcttatatgtccccctacttcagcacttgttgcactggattgtaaaaatctgttaatggactgtcttgtctgttagacctttaagtttcttgagggaatggattgacagcagctgttcagtgcatgttagtgggggagaagggtgtcttggagaaggcaggccacaacttatagaagagggaacaaacttactatttggctctggtactgaaactaacatctaaaaatggaatggaatttaaatgatgttttggaagggtttatgttgaaaaggagaaatgcttttgactactgatgaggtagataacaaaccaccatgcaaagcaggattcccctacttagcaatcctgtgcatagaaaacagaagaaaatgagaatggctgttttgggattaaaactatacctgatttttttcttttccaagaaatatgtattttataaagtaaagtatacaaacaaaacaaaacaattggtttggagctgggcctgcctgacagcctggggccataaaaggaaattccctccagttcggggctgcagattcaaggggcggagcagggggcggtccgtggtctgggccagcagcctccggatgccttagtgttgtggtcacttcctgtgtgcgactctaggcaaggcctggagctgatcaggggtctggccatccagatgcccgtacagctgaaggggttggggggtgtggcctttaagttaatcattttcctccacaacttgctcgcatctgctaacacagaaatagccaaaagcttttccttgagatgggattatccccaggaagcattacgccccctgtttatcagttggtcttgcctcctagacctttaatttgtgccctgacttatcagcttccagtactgcctgtggcgccagggcaggccaaactcggggggcaaaagtatgggcacaagggttctgttcactatcaggctgcgtgccacctc

SEQ ID NO: 12542 - DNA, 17012 bp, Homo sapiens
gtgaactcccattcacaattgctacaaacagaataaaatacctaggaatccaacttacaagggatgtgaaggacctcttcaaggagaactatgaaccactgctcaactaaataaaagaggacacaaacaaatggaagaacattccatactcatagataggaaattgtgaaaatggccatactccccaaggtaatttatagattcaatgctatccccatcaagctaccactgactttcttcacagaattggaaaaactactttaaacttcatatggaaccaaaagaaagcctgcagagccaagacaatcctaagccaaaagaacaaagctggaggcatcactctacctgacttcaaactatactacaaggctacagtaaccaaacagcatggtactggtaccaaaacagatatatagaccaatggaacagaacaggggcctcagaaataacactacacaactacaaccatctggtctttgatctgacaaaaacaagcaatggggaaaggattccctatttaataaatggtgctgagaaaactggctggtcatatgtagaaagctgaaactggatcccttccttataccttatacaaaaattaactcaagatggattaaagacttaaatgttagacctaacaccataaaaaccctagaagaaaacctaggcaataccattcaggacataggcatgggcaaagacttcatgactaaaacactaaaagcaatggcagtaaaaggcaaagtacacaaatgggatctgattaaactgaagagcttctgcacagcaaaagaaactatcatcagagtgaacaggcaacctacagaataggagaaaatctttgcaatctacccatctgacaaagggctaacatccagaatctacagagaacttaaacaaatttacaagaaaaaaaaaacaaccccatcaaaaagtgggcaaaggatatgaacagacacttctcaaaagaagacatttatgccgccaacagacatacgaaaaaatggtcatcatcactggccatcagagaaatgcatatgaaaaccgcaatgagataccatctcacaccagttagaatggtaatcattaaaaagtcaggaaacaacagatgctggagaggatgtggagaaagaggaacgctttcacactgttggtgggagtgtaaattagttaaaccattgtggaagacagtgtggtgattcctcaaggatctagaattagaaataccatttgacccagcaatcccattactgggtatatacccaaaggattataaatcatgctactgtaaagacacatgcacatatatgtttattgtggcactattcacaatagcaaagagttgtccatcaatgatagactggattaagaaaatgtggcacatatacaacacagactactatgcagccataaaaaaggatgagttcatgtcctttgcagggacatggattaagctggaaacgatcattctaagcaaactatcacaaggacagaaaaccaaacaccacatgttctcactcataggtgggagttgaacaatgagaacacatggacacagggcggggaacatcacacactgggccctattgggaggtgaggggctgggggagggatagcattaggagaaatacctaatgtaaatgacgagttgatgggtgcagcaaccgaacatggcacaagtatacctacgtaacaaacctgcacgttgtgcacatgtaccctagaacttaaagtataatttttaaaaattatttaaaaattaaaaaataaataaataaataaattttaaaaaataaaataaaaatcatatatcaggtaagggactggtattctgaatatataatattgcaacaaaatataattgcaattatatattatatataatatataatgttgcaactcaacattataaagtgaaataacccaatttaaatatatgcaaggaatttgaatagacatttctccaaagtaagacaggtatactacacggtggtctcaaaagaatagaaaattttgggcagcagtttcaggtgactagcaaaaggaatctgttgaaatatgtgcagaggctctgggctgataagatgctgaaaaacagcatgtggaccaagctggctaagaatgactggacccaacaaggccctgcatttgacctaggtttcacctaggacctcattacatgctgattaacatactaaacacacaccagccagctcctgagcagttctgagaacacttatatttagtgtaaaaatgcgcggcaccacagttctgagaaatctctaccttcttccaggaattttcatgaatattccactccttggttaaagaaacccagaaaggtggcagccccaaacttgcacctgcttctctctcgagttcccctgcactccctttacttgactgtgtactttgccttttacaataaatctccgtcctttctctatttcctactggtccttgaattaatttccccggcaatatcaagaatctggacactggctggagtcgaggtcccaccggcgtttggggacctccccttgcccgctggcatcagaagaagaatgcaaatcgcagtgagcccaggaaaaggtgttcagtgttcacagccctcagggaaatgccaatcgcacccacaaggggacgcctcaccccgctgaaatggctgatcccaaacacagtgagggtggagggggtggggcctgtgttccttactgggcagagagcaggagacggagagtcggtggagtgtgggggctgtgcgcgtgtccccctctccccattttcgtggtgggggtttctcattgttctccggccctgtttccttcctctccctttctgccgccctccctccaatccttcttttccacctatcccaaggttttctccgcctcacgacgtccatgctagggcctcccagaccagcggagaaaccagcagccctggaccgcaagcggcggggtcagggaggcgacaacgggaagcccctgccggaccctggacactcaggacctagtgctgcccgggcgccctcccgcagcagccccagggcgaggaggatggggggggtcctcgcaggggccacactgtcggagccccacggatccgggcgggacggtgaggcctccacactgagccggtggcaaagtccccgcgaggatgaaggaggaaccccgtgctcctcaccccaccaggccccgcatttcctggctcctcctgtctcaggaaccgcctgtcccttgccgcgaccggcgagtccttccgggtcttcctgaaacagtttcgtcccgaggctctggatctggaagcccaggggcatcgtccgggagcggggcacccactgtgggtctccgccagccagcactcaggcccggagctcggggacagcgggcgccctgggaggagcacacagaaccatatcaaggcttaggtcctgtcgagctctagagggtttagcaaattcaggtctgtttcagactgtgtctctggtcataaggaacccccacggtgcgtggtgtgcagacagcaggagctcaggcatgtgcggtcctcacatttgagtggggcagcagattggtggctccagatgctgtgtgtcaaggagaaggagattccatccactggagaagagcagaggaactgggtgtaaccccaggaaggagaggctgccaaggactgtgtcgacccagaggacaatgctggagttaattcccagggaaggtgcctgggtcacagcctttaaggcagacgctgactgaaaagactgtatacaagtaggaggtcaggtctctgggaaccctcagaatacggctcagtcctggggcaatgcccctgccatccggcctcctgcacactccagattctggccctgcctggagcagagctgactcggagacaggggtactgagctgctcctggagttccaaggtcactgctgagctggaccaggagtggatggggcggggcagggacagtctcattcagagctttgggtacagccctagggtgagaagaggctgagagagaaggggaaaagaggatattgcctgagtggctgggggcagaatgggacccaggggctctgtccagtcctcaccctaagctaagccctccacagctgccaggaaccactgggaccctcacctgtctctggtttctgccaccacttccagatgccctcatgataattaagacaaggatacaattggggtttccttttgaggatggctgcagggaccgtccagggactgagcagaggtgtgggtgcagccatggatccaggcatcaatggttggccacagatgggtgtactgcaaagtgagctccacgcacgcacagacccctcccttgcctcctgctcccatgggaaacacaattgatcacattccaattgagcaacagtaggccactagggcttttttccctcaaaagctgtacacagatctagtatagtctcaaagacctcatgcttctagtagagaagcaaagaaatgtgtgagcatttgtcacacagggagatccggatacgctccatcactgtggatccaggcctcagggagcaggagggtgttccttcatgtgggaagatgagggacacacatgggagggggtatttgtgcgcggcttggaaggatggctggtccttgcccagggggaacaggcccaaagcaagcgctggcagttagtagctatggggagctttcatttgaacctgctctgctgagtcccctgggccatccccacacctggtggggcactgttctaaggggagctcagggtcaatctctctgatgtgctttctaaatcagcaaggtgcctcacaggttgtgattttagagacaaggttttcaatgctttgcattaaaatgcaaagattttaatgagcagagtctttttgccaatccgaattgggcagatcccagcaagacacatatttttaagacaatttttaaagctgtttaattttggtaaaaaagtagaacataaaatttactatcttaaccaattgtttagtgtacaatatcttctttgaagcctctgaagacctggtgcttctgtaataaaatctagccccgggccaggcgtggtggctcacccttgtgatctcagcactttgagaggccgtgtcgggctgatcacttgagcccaggagtccaaagccagcctgggcaacatggtgaaaccccgtctccaccaaaatacaaaacttaaccgggcttggtggcgcgcacctgtggtcccagctacttgggaggctgaagcaggagaatcgtttgaattcgcgaggcagaggttgcagcgaacccagatcgcgccgctgcactccagcctgggcggcagagcgagactctgtcacgaagaaaaaaaagaaaagaaagaaaaaccaaccaaccaaacaaacaaacctagcccaggctataaccacgtccactcgggatttgggatgaggccgcggggatgggactgggcttggatctgcgcacaggacggtgggttgggagcactctgcaacgcagggagagggaaggcgggtgtcgcaggtacaggcgaggacagggagaccctgtcgcggctgaacacttctgtgcattttcttcacctttctgtgcatcggtatccacattggattaatacaaaatgaaaaaattgcggtgatgattacatgagggggtcatggaaagaagcctttggcaggactggtcccgggcaggcagccagcaaagtctgactggctgaagcagggggaagtgcgcgagcgctgcagtagaaagtggggtagacttggatgagcaacttggctgagagacacctgattggctagcggctcagcaaagggggtgtgtttcctccgaggggcggggcagaaggagtgctagagtttagggcttactggagtttagggctgcattcagacgggctgcattcagacagcctgcgagccgccaggtgatccacgggctgggcttcgcttctgctgtcccctgcgatccaactccccaatggcagcggccgccagccccgcgttccttctacgcctcccgcttctgctcctgctgtccagctggtgcaggaccgggctggccggtgagttcggggatggagcctaagcggggcggaggccaaccgtggggggctgtggactgtgggcttcagaggaggggaggcttctggaaggacccgtgcgatcaccccggactgcgcccccgctcagtttccctccgcgtctccttcccgccgggtccgttcccagaggctacttatcctccgaggggaggagctggtcagagaggaggctggaaaggaacccccggagagtggaggggccagagggctgcagagggcgacgtggagcggggatccctagtgcagcccggcagtcccacccgccctcgggaaggagaaaccagagcccccagaatccgagctggggtcaggacaggggtgaagtggggttgcacagggacacaatcacagacactcccaccagccaccagcctgctctgttctcacccgctctcaaccacacaaaccytccagcacccccagggctgcgtgcccttgaatttttccctgcactttcctgtagacactcacctgcacccagcggctcagcagacacttcccaccctcccctcaccatccactgccaccacccaggtaacatcctcttactccccacctcagcccagctggtcaccccagaggtctccccatccatgaaggggccctcgcgacctcttacaccacgtgacaccttctgcctcttgcctgaggacacaccccagcaaacacaccccaagctccccwcagaacctgtgcaggggggatgggaagcaccatttcctccaggatgaccctgggaactctggtgagtagaggcacccacttctgcccttggggcccagacctgcctgttcttcctactggggcgccagcgtcatagagaatagtcagtgtgtagacaggggtcagcaaaccctttctagaaagggaggaaggatgccctgtgatctttgcaggccttgggttctctgtctcagtgtccagtcctgtccctttgcagagcaacagcaggcaatggcaaccttcaaataggggggaccagatttggaccctgtcctaggttgctgaccctagatgaggggattacagtgtaccagcaaatagtaccccatcccctatggtgtcatctccaagtggtgtctcaggtgtcagttggagagtagaaggtggtcctaccttgcctgtggcttctgggtggtgtggatgtgatgggagtgggggtcccatggttcagggtctactctcccctcctttgctgctgagtggcatctatggtccacgggggccatcagtgaccttccctgaaacctgaggtgtaagctgagggtaagggggtgcagccacgtggtgtcctgggaatcggggccaactgcttgtgcagcttcccggttccctgtggccctacttctgcccatcccaggagaaccacctgtgtcttctcactgccagacctctcttcctaatgacctagagggtgaggagcccacccgtaatgggcakctctgaggctggatggtcacggcccttccatggctaaaggccccatctctgccaaggcccagtactctacaggagacactttttaatgttgagatttccttgctgtgagtggcgttgccttgcctctgaacattcacatggaatctatgttgtgattctccaattagacattggaaccacatgcacctctaggatcttagggggtcttgggtcattgggcacttaaggcaggtccagcctcgctcattcatggattgcctgtggctgcctttgcgcttcaacagcagagctgagtagttacaatggagaatatattccctgcacacctttacatgtttacaaaattgcccttcatagcaaactctagtggccataaatacgtttggagaagcccacaaagaatcattgcacttgttgyggggttaaagggtccttcctcactggaaactggtgtcttcttctagtcatgggttcacggtctgagaagtggctttattctgcaaattaggcaaagcagccttgttcttgaaggactggctactttcagcctcctggtcmtccatcatttgttttatctctgtttcttgtaattatttaaatccagcactattcaggttgggtttccatctcttctggatcttggacccctttgttctatgagccatgggcatagctttgtatgactgaggtctccagctggcattgtgacttctctaatcatttccatcattgcaccctccttgttcctgacagttgacaacctccacctggaatctgttatttcgggatttttcatcccattactactgggagcccatttcaggaagagcatctcctacccccaaccctggccttcagcaataggcatccctgagcttcatcccattctggtgccttctcatggggccttctttatatgccaggtaaacaggagtcctccaggcttcccatgagcacagcagatggacattgttctggattttcacactcagacccctccagcctgggcacttctctgagcctgtgatccctccgtctactgcctgccttagattttcagatttttctatttcttgctgtgtggaccatccctttgtccaaggtttcaggaaggcatcctcatagtagatgagcaccaccaccaggggctttgccaacgtgttaaatcctgtgaccatgataattaactcttctttatccaactgggttccatcctcactccgtcccaccatgcaccagtatcctcaggtgcagctcccacaccctgtcccacctcccacagtccacgtgggctactgctgaagatcctctgtcatccaggcccttcctcctctagcactcctggcacctctctagcaaggtcctgtgttgaccgatgtggacagaggggcagtgggacatgtctggggacatgtggtttctcagcaggcagggacctcctcctcctctttgccctcatggaagtggggagcactcgccttaatcttgyggacaccacagttctggaggaggcactccttgctgggccagcccagccctccagaggcttcctcttattgtcacagtgtggaggaggggtatctaggggtcttttcctccccacccacccctcacctgcctttctccacagaccctcactctctttgctatgacatcaccgtcatccctaagttcagacctggaccacggtggtgtgcggttcaaggccaggtggatgaaaagacttttcttcactatgactgtggcagcaagacagtcacacccgtcagtcccctggggaagaaactaaatgtcacaacggcctggaaagcacagaacccagtactgagagaggtggtggacatacttacagagcaactgcttgacattcagctggagaattacatacccaagggtaagtttcagatggcccaggacagcagggagcagatacagtggtaggttagaggcatttatagttttcatgtaaaaatacaaataggaaggtcatctcaccccgcaagacgtctagaggcaaggccaggatgtggcagagcaagtaagaccaggaaattgcaagtggaagaggatgggggctcaatatctgtcaaggccagagctgatctctctttgatgggggcagaacccctcaccctgcaggccaggatgtcttgtgagcagaaagccgaaggacacggcagtggatcttggcagctcagtttcgatggacagatcttcctcctctttgactcagaaaacagaatgtggacaacggttcatcctggagccagaaagatgaaagaaaagtgggagaatgacaaggatatgaccatgtccttccattacatctcaatgggagactgcacaggatggcttgaggacttcttgatgggcatggacagcaccctggagccaagtgcaggaggtaacaggagaaaaagaaatggggatctccaatgagatcagaaatggggatctcaagaaactaattcttgagttcagcttcaatcatcccagtgtacacgtttatgttaaaatgacctcctcgtggggtgctcctcctgggggtgctggcgtgcctgtgctctcccaccctcctcttccttctccctcctgactcctcttcctcactgcacttgcttctgttccccacactgtggatttctcaccagcctcgaaactgcaggtgtcactattttcaggcctttctccttagtgttccctcttgagaatcacttttcctttcctcctctggtctgtttctggaaatccatcaaaacctcctccaaggccagcctcgtgaccctcccctcccgcaccctggagcatcacctcctcttccgccacagcaggagggtgggctttgctgtcaccttgcttccctcagcagctctgtgagctccctgaggccaagggacaccccctctcccttcctaccccaggaactctcccaggggctgccccatagcagaggggacaaaacctctgccttccaggatgacctgggtcagcaggagctgaggaggcatctcctcagatttggggcctggacaagggttgtcactcttgtgcttccatttcagcaccacccaccatgtcctcaggcacagcccaacccarggccacggccaccaccctcatcctttgctgcctcctcatcatgtgtctcctcatatgctccaggcacagtctgacccaaagccatggccaccaccctcagtccctgcagcctcctcctcatcctcccctgcttcatcctacctggctgctgagragagtcctttggagtgacaggtatgggggcagaattgggagtggagcaaagggcaggtgggtgaggagggaggacagggatggagaattcccagagtcccactccctatggctgggaccttctcatcctaacatgagacaggtgaatgagaccttgtgttgcttgttggaaatgacctgggcagctctgccctgagttctgatggattctcaccatcaaaggccagagggaaaggcgcagtggtgccataccaaggctcagggtctgttgagcttgagagggtttagcaagttcaggcctgattcagagcaggtttctgttcaggaagggtgtgtggcctgcaggcagcaggaattcagacatgggcagtcctcttaattgggttaggtgcatcagggtagctttacatgaggtatgacaagggaagggggattccatctctgaggctaagagagagatatgtgtgggcggcaagccacccaggtgccaaggcaagagactgaaggcacaagctgttccagtataataaagaaaatacttaaaataagaatagttgtattagacgtagaatacagacatgattatctatgaatattatcaatcattagtctgtagtgttactcttttttccaatgttataataatctctgttccacaattataacccaggaaaaaccaggccatgcagagacaggagctgaagggacacggtgagaagtgaccagaagacaagagtgtgagccctctgtcatgcccagacagggccagtagtgggctcctcagtctagcagtagcgccagtgcctgggaaggcacttgttacttagcagaccgggaaaaggagtttccctttccccgggggagttagagaagactctgctccaccacctcttgtggaaggcctgacatcagtcaagcctgcccgcagccatccggaggcctaaacgtctccctgtgatgctgtgcttcagggtcacgctcctggtccactttcatgttccgccctgtacacctggctccgccttctagatagcggtagcagaattagtgaaagtattgaagtccgagaaatacatagaagaaacaatgacgtaagctgtcctctctctctccgcctcagctaccaaatagcgaagcgccccttgtctggtggacacgtgactcgcgtgactttacctatcattggagacgactcacactccttaccctgccctcttgccttgtatacaataaataacggcgcagccaggtattcggagccactacaggtctccatatcttgatggttccctgggcccagctgtcttttcttccgtctctttgtcttgtgtctttatttctacgatctctcatctccgcacacgaagagaaaaacccacaggccctgtagggctggtccctacaactatgagtgtaatcccagaaggagggggctgggagagccttggtacacctaattgaaaaggagggggcgcagggctgccttcccacagaaagtggcttgggttccaggaattaaggtggaaggcgaagagtagaggctgcacatgaaaaaaatttttaaaaagtcagtcccatggacccatggggttcgagtccagaccttgaggcagctcccttgccatcaccttcctgcacaccccagatcctgagcccgctcatggccctgccaggagcagagtggactcagacacgggggacctgagctgctgcttaagtccatgggcaccactgggctggaccaggaatgaataaggtggaacagggacagtcacctgcagagctatgggtgctgattgcagtgtgaggagaggctgaggaagaaggggaaggaggaatatttgcctgcaggcccacccaatgccaaggacacaggaatacagagccctctctttggatgggctccccctaccccttgccatgttttaggccttctcatcagatggtagagagggccttgagtgagggagcaggcccatcactaccagcttcagtcttgcaggcccctccactccatcccctggtcaggtgcagggcctgggctgacactgtgatttgacaaaggaggaaagaggctgctccaagctgcaggtgccagggttggggctcaagggaaaaacgggtcctttagtgcagtgggctctgagacgtggagtgcctagggaaagattgccctgcaaaagtgatccaggttctccttcatctcttaaaccaacatttgtgtcctttttgaaagttaaagatgataccaaaaagcccctgtgagcagggtcttgatcaaactcgcccttctgtctggccacctgcccaccacctactgtgtatgtccagtggcctccagcagatcatgatgacaccatggacccaatagctcattcactgccttgattccttttgtcaataattttaccagcggttattcctaacatcttatgttattttttattggtgctacctgatggaattcctgcaattaaagttctggctgactaaacaagatatgtcaacattttctttcttctgcttttgtttgaaaaatcaagtactttttgaatgatgacctctttcttccaaatgatacagtcagtaaaacaatcatgttagatttcagacctccaaggtttctttccgcgtcctgaaggataattctttatttaataagaaaaaattacattaatgatatttcctcagtaatttattgctctgtactaatatttccacaaagagttctatttcccaaaaacctactgagtttagaattttcttgtattacccagtagagaattaatgttatttcatttttcctccatggtgtgagtaataaatgagtgattctgctagattttgtgtggaaacagaatctacaaaacgtggctgaaaaaaatcagggacaatacaaatacatggaaaaataatttatgctcatgggttagaagatacaatatagctaaaatggccatacttccaaaagcaatttatagatgcaacactatccctatcgaaccaacatcatttttcacaacattagaaaaatctaatctaaaagttatttggaattaaaacagagcccaaatagccaaaacaatcatacgcaaaaaaaaaaaaaaaaaaaaaaagccaggggcatctcactgccagacttcaaactataatataaggctacagtgatcaaaacagaatggtactggtacaaaaatagacacttagatcagtggaacacaatagagaactcagaaagaatccttcacacctacagccgtctaaccttcaacaaaatcaacaaatagtgctgggataactggctagccatgtgtggaagaatgaaactgaagccctgcctttcaccatataagtaaaataactcgacatggactaaagatttaaatgtaagtcctaatactataaaaatcctggaagataaccttggaaataccactctggacatagggcctggcgaagatttcatgatgaagacacccaaagcaattgcaaccaaaactgaaaattgccaaatgggacttcattaaactaaagagcttctgcagagcaaaggaaactagcaacgcagtaaacagcctatagaatgggagaaatagctgaaaactatgcatctggcaaagctctaatatccagaatctacaaggaacttaaacaactcaacaagcaagaacaaaaaaacccagttaaaaaataagcaaagaatatgaacagacacttttcaaaagaagacctgcaagtggccgacaaacatgaaaaaatgctctttcggaggccaaggtgggcagatcatgagctcaggagtttgagaccagcctgatcaacatggtaaaacaccgtgtctgctaaaaatggtaaaattagcctgacactgctcatctttcaaatatttcaataaacccagagggtttgctcacagtgagtttgcaccatgagctccttggcacacagcttgggatccacagtcaagggctacagagaagacaaaagagacgttgacatcatgtcgaatgaggaatccataaagagttcatttttgaggattggggaagttcctcccaccatgcagatcaagatgccctgagggcaaagagcagagcggtgcgctctggtggcccagcagttctgccccacgggagaggtttctcttctgatgcagtgaaaactagcaggacactgtttcatcccagagccaaggaaaccaggaaggaaggtcagagtgaggaggtgtctgagtgtttcagatcacacagtgacatcctgcttgatggcttcaggaatccttcatgagctgggagacagcccccgaggtgacaagtgagggggcaggatgggcccaacacgacaactcttgagatgacacccagtttctcccatgtgtttatgtgtgtctttgtgtgtgcatgtgcgtgtctgtgtctgtatttctgcatgcatttgtgtatgtgtgtgtgtgtgaatgtgtaaacacctgtgtggtgtgagtgtgtgtgagagagactgtgtgtgcatgtctgtgtgtctgtgtgtgtgtgataacatgcatgtatgaatggtgaattgatttcctggttgatttgctgtggagagagaagggactccagggtggttcctgccctcccctccttccctgtcttccctcctgacatttcctcctccctgtggaaagagtctaccctagtaactgagggttcattactacagacttctcagagctccccaaagttctatgatatttgcacccccaggcctcctcttcatgcttgtccctctgctgggtgccctatcttctcctcccacctggccacgctgtattcttcctattcctacaagaacagtctgaaatgccacctcccaagaagcctccatgcaaatccccaggcagaatgagtcaccccctcttctgtcctctgatagccccaaccaccacaaggacatcacatcagcagtagcagccatgtgggtgtttgtttctgtccctggactctaagttcctggaggactggacacatcagtcaccacctgtaaacccagcacctagcacagtggctgccatatgatagggtttaagacacgtgggaggaatccaatcatcagactaccccagggctactagaactcagaaaaggatctccataacttgggagaattggacaaaggtcttcatttctgttctttccagcaccaacctccatggctccactcatccctactcattcctcctgttaagattggccggtaaggagaggggtaggggcaggagcagctacatctggtctcctccaccacccacggtggggagcacccttggtgggacctggtgagcatgacagcccctgagccatggggacctggagcctctgcagccccatagagaccaggaggagctgttcagccacttgcagagacagccagagagtgcttcaaggactgcatgaagctctggagaagcggggagttcagggccctcttttgtagggcatgagaaatttaggcaggatcatgtctacaaaagaggctgtcactttggcttatcaatgctttcacctccttaccccttccagatcagagtgggcactttacttgtttttatggattattgtgtcaaccaaaatgagaggtcagaatcaccctaaacatttgaaacttcttcaagatttgacaaatgcacattttaataccacttctatttttaggaagctgtggctgtagaaaacattttctaatacagtattgtctaaattatttatacagaattttaaaagtctacataatgtcatacaaccatgtgaaaagtaacttgttattttcagagttggagataagccatggcaacatggtgagaccctgtctcttcagaaaattttgaaaattgaccaagtgtagtagcatgtgcctgtagtcccagcccctcaggaggctaaggtgggaggatcacttgagcctgggagtctgaggttgcaggcagttgaggtggtgccactgcactccagactgggtgcagagtgagagcctgtctcaaagaaaacaacaacaacaacagaaataagaaaaaataaataaacattgataagctatgttgacataagaattgtggaacccaaatgaccaaatcatgcaatttcttaccttttttttttttttttttgagacagagtctcactctgtcacccaggctggagtgcagtggcacgatctca

SEQ ID NO: 12543 - DNA, 75159 bp, Homo sapiens
cactgaatccatgccaagagggaaataattgatttaactgatctaaaagtgtgtttgagctttttttcagacaaactgtcaacacacacatgaaagcaagattctaaaagtgctgtcagatccataatgtttatacagcaaagcaaacaacctttgttattccaattaatgcatttgctcatgaaggaagtctgatccaaaacgttttattttttctcagctgcactgaaaattataatgttgactcatattgaagcaatttagaaatgtactcagccacaaaatgaaaatggattaagtataatatttgttactagggtacctgctaaaaataacatctcaaaattatttattacatttcctttaaagggtttcaagtattgtcacgtgtatctacttatctctttgaagggggctaggcccataatagtattctcttaaacttacaaaccaatgatgataaatattaggagataaactgtgtatagggaaaataatgtggcaagatcagtttgttgagataccttggatggtgacctacaatactttacagtaattactctatctttttccctctattgtttaactctaaaacagggagtggagtttgggagttgaatgtcccaacacctgacaggtactttagtactttatagtctagttcaacactattagttttaccaataagaagtgaaatgatctgtttaaggacacattgctaagaggctaagatggaacatgaactcaggatatatatgtacatgtacatatacaaatatatacacatagataatatatagagagagtatatgtacgtatatatacacatatatacgtacatatatacatacatacatacatatatgtatatacatgtatacacacatatttaattatacatataattttgagacaaggtcttgctcagttgcccaggctgaaatgcagtgctgtgatcttggcttactgcaatctctgcctcccaggctcaggtgatcctcccacctcagcctccctagtagctgggactacaggcgcactccaccagtccagttatttttttgtacagacacattttcaccatgttgctcaggcgggtttcgaactcctggactcaagagatccacctgcctcggcctcccaaagtgttgggatttcaggtgtgagccattgcaccaggccatgattttttattccaaatactgagctttctctactacctcttgtgatcatgaataattattgagataaatccaacaagatcgggatattcaacagttaaaataattcaatgtttcaactaatagatgacatttttaaaaaagagtgggaagggaaaacactacatattaaaacagatgtattgacaaaatggtaagtgtgacttttttgatcctgatgagcataaaccaactgtaaaactacattcctgagacaatcaagggatattcaccacagagtgggtatttcataacagtaaggaattagtgctaattttgttagatatgttagtagtagtatggttgtgttaaaaagaagtgcttatctgttagacctatatactgaagtatttgccagtgaaataatctgcttatttactttaacatactcctgaaaataaattttaaaagtgcagagatagatgggtaaatgatgacaattgttgatcatcacagatgctaaggttatttatgttactctacttttgtgtatgtttgaagtttttcacacaaaattttaaaaatgtaattattgagcttgtacttcctataaaataccataaacatcctttattattcattgagtgtccaaattttttattttaaattggagacagccatagaagccctatatcatgaatctatagacttcaaaggtgctaactcatgcctctctaacctcactaatgactgctgtgctgagatgtaaaattatgctttgcctttaatatgtgtatacataaaataaaactgcactcttccctgtattgttgttacttgattctctagcttagtaactaaccctttctaaaattcaatttagcaaatatttttggaatgatataccaggttccactaggccccagaaacagcaagtggggtatgaacatatcatttgcatatataatatgtaaatataaatacatatatgtatctatctatatgtatgtataatgtatatgataatagaattgataaattctatattagctatattaaacatgtacaatggaaaacctaaaaagaaacatgtgatgaaaaacttaatgaatcatgcttaatgtcagaattatctttctattctatttaaaaatttacaaaatataaagaggtaatcaaagagtatacagccagaaaatgtagaaaacaggtattatagaggtatgttagataattaatttataaaaatattgttatttgtctggatttggggatgtttgtggcatttgtcagcttttataaatttgtagagagttgtttttcacttcaaattctcactttcatacccaattttgcatttttttttcccttaaagagattcccccacactgaataaacttcaggtgccacattctgaatctgcttggatatctatattttgtcaggcattgtcccgggagctaaggatacatcagtgaacaaaatagagaaaaaaggcctctcttcttttgtgaagtttagattctaattgggagaaacagacaaaaatataataagcacataaattaaatagtatgttacatggctagtgctatgtaaaaaagttgaggagggtcaggggatgagagtgcagggcagagagcatgagtgagataaaactgcaatttaggcctggtgcggtggctcacgcccataatctcagtactttgagaggctgaggcaggacaatcacttgagtccaggagtttgagaccagcctgggtaacatggcgagaccctgcttctaaaaaaaaaaaaaaaaaaaaaaaaaaatttaaaaaaaattacaaaaaaaaaaaaaaaaaagaaactgcaacttaaatagggtggccagggtagggttcaccaagaaggtgactgtgagcaaagacttgaaataattggttactgataataccaatggtgtctagtacagtatattagtttagtggtcttgcattaatgtcctactcaggacttattttagaatatttgaaggtaaaacaaccccaaagtttcagaagcaggagggtaaagcagcaatagttggaccagcgctaagaactgaacacctccctggggcactggtcttagagattggtactaaacaatagcggcgtgaaaccttcattggaagataataaaatgggaacattgcatttaccaggtcatctttaggggtgagacctccaagaggcatgacccttaaggagatctactctgattaactgtcgagttttctactgctgagtaggaagaggcaaatatggaaccttatcttgaagtgtccaggacaacagagggctgagtactgccaccaagagttgtccttcttacccacttaccattcaacctttcctctaaataaaagtcagaaaaacaacaaaaagtagtttaaatacttacaaatttataggatatattattggactgcccaagaaataataaaaatatgaaaatggaaccacaactgtgacaatttttaactttcttagagcaccatactttcttttggcataggcagctgcggtatagtaggcagactgaaggacaagtcagaactggatatgagttctgactctgccactttttagccctgggcaaatcagaaagggaaaaactaagttttatcatctataaaatgggaatgataatctttcttttatgacaattaaataattgtgtttaaatgaacttcttaatcaacaaagtatcatagatgtttcacatagtaacaaaactataaggtagtccacagtagctatgtaagaatcatagttatgaagtatataataatttaacttacagtatttatcaacaaatagttaagacagtacgaaatgctttgaaatctcaatttacagttagtctttatgtagcttcaagaaagcaatcatctaacttcaagtgaagacttttcaacatcttttaacgggatattagagcagaagacatatacatctcatacctcaaaagcagaataggtcttttcttactcacttgaatactgaaggaatgacccttaaccagatgaaagttcagcacaaaaataactggctattttctcaaaattgccagcgaggtagagtgattcctagatgatacttgtcagcaagaaagatgatctgaagaatgaacaaaaatagcctctgtttaacagctgtgatatctataatttataagctgtgatcatctctcatcagattgtcttgatgtttggatgagaatgaatgtttgaaatttctatatttagtacttatcagaaaacaaagttttgttgtgtcctattctttttgatcaatacatttcaatttacatataaacagtgttcaagagacttcatgtttgaggaatgtgaccttgaaactctactggcatgcagtgctataaatgtttgactaatccttaattacttatccccaaacagaatttttttttactgttttaaaattttttatttcattggcaaataaaaattgtatatatttagtatgtatatgttttgaaatatattgattgtggaatggctataagtcaagctaattaacaaacatattgtatacgaatctttttgtgtgtgtggtgagaagcaaataaactttaatcactgaaagacagaacaacattaaagaatgagacaacattaaaggaaggaaggaaggagggaaggaagggcgggagagaaggaagagaggcagagataatcgctttattacctaattctttgccagtcttttttctttttttttgtggggggagggtggggaggtcagtctttgaacacgctgcctaggcatcatgcttctaatttcctcttaccactcttttcacttctatatcacatttattcttcctttaatatgtgaccttatactggcctcgcccttcacaattcctctgtcgcttacgtattttactttctgtgggcagaacattgtttccctttccacgtctttcccatttccttcttgtacagctgtatcacatttcggtactatatgtttatataagcgcgtggtaaaactacatatttatataagcatgtgctaaaaaacactcgagcaaataccgtgactgagattttttggaaaactgtgggcaaattagttaaaattgagagctctggcggagagggtctcttccatctataggacaaaataattgggaattacagaataagtagaggaggacaattcaagagagcacagagctgcgtgcattctccctgtgccgcgacctgtatccaaaagcctcagacgagacttgaggagcttcctagaggctctcctgccactgcccctttggccagggcccttcccgcagtctcccctcccgattcttcccttttacagcccctcgctcccgacatgcgaggcccgtctcttcttccagtttgacttccaagtctttccattccctaggatcgggccccagtctcaccccctattttcacccccttcggttttcctcagaaagggcctcctgcctccctcggcaccctcgcctacccccctcgcagcacctgtcgcctccgcccctcactcggaccccgcgcatctggcgcagcccctcccgcactcccgcccagcgccccgcgtccccggcccccgctgtcgctgcttcgggttccgccgcaggagcctctcactcccgggagcgggcgcctcgcgctccctccctcggccccgccccgcccgccgctcgcccgttgcttcccacctgggcccgaagcgcccagcgccctctcccgggaccccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcacttctgtgttctctggacctcagtgtcctcctctgcaaaatcgggagaactggactcgttctgcgaggcgccttccagctctgagcctgtaggcttagggcggggatcatccacgctactgaggactgaggcgccgtttcgtgccgggtgccctgttaggtgctttacatggaatctcattgaatcctcacagtgacttggtcaacatgttgtcctcaccctaaaggtgagaaaactaggacccctagagatgtagtaacaagcccaaggtcacacagaaatggtcagtaccagagtgaagtctaagatgtcctccaattctggtcttgctgggaggtccctgccatccccagattccttcacgttccaggactctcggttgttgggggtgactgtttgggggatgctccaggggccagaggttgtgagtctttcttcctggggtgttgtttaacgctggaatgcagctggattgggtcagaggttaattaaaacagagaggtctgaaggtgtttgtgtttgtaaaatggctatgggaagacttctagggtaagggagagaaaaagtttccttggtgtttggaggatttgaggctgaggaggtcaggactgctaaggcatattctgctaaggtctgtcttcatggagataggatccccttttgratgtagaaaaacaggctgcttttgaaatgttatactttattcgagttaagtaactagtaagaatagttaagtatggaactttcatttgttttcttttttgttaattagtcacatgkgatttaattaacctgccttctctccagaatagagacagttgtttattaaaaatactttgttgcaaatccagaattataagtgaaatattgacctttattttttctctttgctgaagaaatgctgggtaggcagtctggaaattttattctgaggtctctatttccttgtaaaattcatattttaaccccaagtcaaggctgttgaatgagtagaagagactcatttttcattcctttggtaagaatcagctcctgttttcttgcacatatttaatactcattcatgtgttcaaaaaacgctgagcacctgcaacgtggtaggcactgttctaggcaatgaggatacagcaaggaaaaaacagatctttttgtttagctttctagtaggagaaggcagacagtaatcagawtatatatgtaaaaggtatgtttaattttattgagaaaaacgaatcagggaagggaagatagagagtcttgtgaggttggcagttttcaataaggtggtcagacaaggtggtatttttgcaaagacctaaaaagtttgtaaaattctttgctgtcctgtgagggttataaagtcctgggttatttttgaaagaccttataagtagagtggatagttagaatgtatttaagatgaatacaggacaatccagggattggattaatgcctgtaatgttacttgtcatttagtattattattaaggactattgtgttacaacattatacagttgctcaagcaaacagcgcctttgacatttggacatgtacacrcaaagttatataacttaaccctatgtcctttcatattgtgttaaaagtttttgcttgtctttttaagttcatatactgtaatctgaatgtagagtagaatactcatcagatcaatcagtccattgccaaagacaacttaaatctcttgtatgtacttttgaattgtttccaggcactggcttcttaaaatataaacagaaagaactttgatttatgagaaattcttttcctggagaacctctgtccaatgaacaaccagttgaaggagttttcctaacactgtgttagatcctctcaaaagtgataccatggtttcctatccaagattaggattagtacaattgttactcatataattcttcaagggacaagcgaaacaaaaagtcatgttttttttttttgttagaaaacagctttatggttgggcactgtggctcacacctgtaatcccagcactttgggaggctgaggcgggcggttcaattgaggtcaggagtttgagaccagcctggccaacatggcgaaaccccatgtctactaaaaatacaaaaattagccaggcgtggtggtaggcgcctgtaatcccagctactgaggagtctgaggcaggagaatcacttggacccgagaggcagaggttgcagtgagccaagattgcatcactgcactccagcttgggcggcagagcaagactccatctcaaaaaaaaaaaaagaaaagaaaagaaaacaacttatttaggtatattttatatatgaaattcatccattctaagtgtacaattcagtgatttttactaattttgccraatgttgcaaccatcattatagataggttttaggacatttgaggacaccacagtaagattctttatacccattcacagttaatctcatttctaccctcagtcccaggaaatcactaatctgttttctgcctgtataaatttgctttttctaggctcttcttcataaacgtgatcgttcaatatgtcatcttttgtgtmgagcttctttaacaatgcttttgagattcatgcatgacatagcatgtgccattaatttgttcctttttatagttgaataatattccattgtgtggatatgccacattttgtctatacaaaaccagttgatggtcatggtttcaagttttgggctattataaataatggcactacgaatattcacatgtaagtctttgtgtggacatatgttttcatacaccttgggtaaataactagaagtagaattgctgggtcatatcgtagttttatgttttactttttgagaaactgcaacactttcccaaaatggtcacaccattttataacattcccatcaaagatgtatgaaagttcccttttctgagtatctttgccaacatttgttattgtctgcctgatttattatagccattctagtgggtgcgaaatagtatctcattgaggcattaattttgygtttccctaaggactaatgatgttgaacattgtctcacrtaattactagtcatttatgtattttcattgatggaatgtctgtttatatctcttgcttattttctaattgggttacttgtcatcttataagttgagttgtgaggattctttgtaaattgtggatacagatcctttaatggatatattttgcaaatattttcttccagtytgttgtgtcttttcattttcttgtgtcttttgaagtataaaagttttgaattttcatgaggtccaatttattagtttttaaaattattttatggactatgctcttgatgtcataggcaagaaatctttgcctagcccaagtctcaaagattttcttttatgttttcttgtaaatattttattattttagccctgatgtttaactatgtgatctattttgagttaattcttatgtatggtgtgagatgaggttgtaaggttaactttttccatgtggataaccaattgtctcagcagtttttgttgaatgcaggtgcatttttaattgttgtagattttagacattgcaaaatgaatttctactaaaaaagctaataggagatgatgtaattttaaaagcttggccaggtgtggtggtccatgcctgtaatcctagcactttgggtgaccaaggcaggaggatcccttgagcccaggggttcaagaccagcctgggcagcatagggagaccctgtctttgattgattgattgattgatagaaagatagatagatagatagatagttagataaatggttataaaaacatggaaatggagaagtaaggaacattttatgtgctttctctcttgacttttttcctttttcttatttgtttattaattagttttttttagggactatgttgaccaggctgttctcaaacttgtggccttaagcagtctatctgcctcagcctcacagtgttgggattacaaatgtgtcccaccatgcccaactttgactgttatgctaattatagatttagaaattttaggccaggcacggcggctcacgcctgtaatcccagcactttgggaggccgaggtaggtggatcacttgaggtcaggagtttgagaacaacctggctaacatggtgaaacctcatctctactaaaaatacaaaaattagccagctgtgatggtgcgcgcctgtaatcccagctacttgggaagctgaggcaggagaatcacttggacccgggaggcggaagttgcagtgggccgagattgtgccactgcactccagcctgggtgacagagcgagactccgtcttaaaaaaaaaaagaaataaagaaattttaacttcagttgttgatatatcaatttatggaccaaagttagggacaaaaagcaaaaattgaaaatggaatagttttaacagcagtagttttaatttgttttttaaaagtatatggaaatctttgtatttgttaataaagccttatttaaaatgttttaaattttgtccttcattagtctattgtattatcaggttgmtgagggactgtttttggaaacagattatatgggctgacagagtttaaaagtaatgctttttatctatttaaaatttttctctatattgactgttcaggctctcactctgggtagggtaaaactgttagagagttcttgtaattagacttgttcatttcttatctaacttctctaaaggtgatagaaattctagaagaatggtcctgttgtttgtgttatataaagactgattgaagaaacaaaattatagtgctaattatttatttaaaaagaagcctgcattttcaagatgagtagtagtatatatgtggtttatgatttaaacaaatttttttcaacattttactccagaaatatgtttacccatatgtggtttatgaaataaatattcttcattggaattgtacaccaagggatacttaggttctttcttgtcggcaaagtctcacgaagaagttaccctttccatttttcaaatagttacatgactggcctacagactgctttcaagaaattaagtaaatattttactaattccccacttgtttttgagataacaggaaggataaaccaaaacttaaacaaacaaacaaaaagtgttaccttattttgaaatgtaaatatcaagtcctaaatgataaatcaaatttcacacaactctcccatcaattgatggagctaaaagttatgtctgtggtattttggtcccttgcttgacttgtgtgctagtgtggaagccctgaacaatttaactccctgggccttgttttcttcccctcctaaaggataacactggagtagcgaatctgtgaggtcctttacaatgctatcattaaaccgatttttaaaagatttaactccaaaaaaatgggtatatttaattattcatcctggttaatgaaaatttgagttcctgaatctgaaatgtagatgtaatgtagaacaggggaaaaggaaacatattttcaatacttcagtgataaaaggtacaatttgattaagttgttactatattctaatcactgtatgatatatgcacttgatttttttttattcccagagtaatcctctaagtttggtattatctccatttaacaaatgaagaaattgagaatcagatactttragtaacttgtccaaagttccagtgctattaagtggtagagctagcaatcaaattcagggttctcagactgcaaagtctctgctctatggactgtaaagtcaaaatgcctagtatgttctgagtttcaaacytacaaggatataattttctatgtctgctcatatttatcagaattgagaaaataagatttaaatgtctttcagtccatatttagagataaataacgttttttgaaatgccatatatagatgattaaaatttatatttttacttttccaacatttacttggatgcctcaatctttcatttcttattataaaatgtgctgaattctaccagttttaacccatgtttattagaaatactagtgatttcagtgtgtttactgatatgaaagtaatcttttttttttttttgagactagtctggctctgtcgcccaggctggagtgcagtggtgctatctcagctcactgcaagctccgcctcctgggttcacgccattctcttgcctcagcctccccagtagctgagactacaggcgcctgccaccacgcctggctaattttttttttttttttttttttggagacagaatcttgctctgtcaccagtctggagtgcagtggcgcgatctcggctcactacaacctctgcctcctgggttcaagcgattccactgcctcggcctcccgactagctgggactacaggcgtgcaccaccacgccctgctaattttttgtattgtagtagagatggggtttcaccatgttggccaggatggtctcgatctcctgacctcgtaatacgcccgcctcagcttcccaaagtgctgggagtaaaggcgtgagccattgcgcccggcctcacccggmtaattttctgtatttttggtagagacagggtttcaccgtgttagccaggatggtcttgctctcttgacctcgtgatccacctgcctcggcctcccaaagtgctgggattacaggctataaaggtaatcttgactagtgattgccagtaacctttagtaaccagactaaagagaacttgtacaaatgatttgatgttctagaagaaaacattggtataagaaggtattagctctggaattaattccatttctactaccagttgtctcacctttgggaaaaaccattagatgctgagcctttgtttcctccttcgtaatatggcaatgatcatacttgtcctgcctaccttctggaatagttatgaagatcaaatgagttgaggtatataaaatggctttggaaaagataaaatgctatacagatagatgacacttgtggagatggtgagatgcatggcaattgtaggtaaattctgcaccctgtgttagaaagtacttactttccattgaaatgccttcagttctcacaccaacattgagatagagctgtagtaatctgcccctattttgtggttgcctaggttgaagaaagctcttaatgactactttatctgtgctttatgatacttattaatgtttatattaaaaacaatatcctgtatgactaagtcatgtaatttgctttttcccaaatatggaagatgaatgaaacaagaatgaaatggaagtaatagttaaataaaagtgaatgtacacacattcacagtaaattgattttacttttgaaattatgcaaattctaaacaagtgttaaatwttggttccaaataatgaaattatgtttcttctcaaatactagattagtgattgaattaaaatcagttgaattattctcacaattaggtaaatacgtgctatttaggtttctcttgctgatatatatagatatatataatatatatataatttatatgatttttgaattgtgtccttaatatctgaatggattttgttcatttggtgtagccagttgattgactttcaaagggtattttaaataggaaacaatgttataaatggtagctattttcatagtatgtccacaaaggcagcctgatgtagtataaatactctctgtagtatgttgaacttagaagacctggtgtggaacctttgttttgtcataaaccagctatgtggtcaaactcaatctgtaaaaatgggaataataccatatgttctcttctagtgttgtgagaagtacatgagaaaatgtacatagatgaaaaagcactcagaagtacttatgtacttttgtgtatgtagacaccattatgtacttaaacccacaattagctgaactatgagaataatctgtgatctggttctgagaccagaaatttattgatgagagagagggaagaattcactacctcctgtcttgttttactctggtcttatttctgcaaatgaatgtgttcagaaacctgtaattctctagaagctgctcacttttcaccatcttctgtgcatcacttggaaggcacaaacacattatatatattttgtatacatacatatatatgtatgtatgtattccagatcccatggtatccatcatagaaactcttggaggaaagaggcataagctgggaagggggaaagtgtgggcagcagatggcatttagtatgaatgggtcattttaaagtcctggtccacttgtagtagaaccaaaatgaggctatacatatattttcagtwcagataatacactctgagctaaaaatgcttttctaccaaactttatcttaacatatccatataaattagaaaggattttgtagtttggtcatatattgaggtaattacctcagttccatgagctttctccctttttcatgctgacacaaccatgctttatcttgcttctttttgtaaaaacatcccaaaatgtccacttaccttgtggtccatgttagctttcttgaaagcatttggtactgctttgtaataataataccaccccatttattcttctgagattcctgtggtttcctaaatgatagagaaaatattttgtagaggaagtattaataatktttgaagccaagcagataatttaatttgacctagcaggaagatctaatctcaaatcctttaagaaataatgagtaagtggctggcacaagacccttaaagcattaaatatgttataaaaatgagagcaaatctacctagtgtatttatcaactacaaatataagagaaatgtaaaccttaaatcaggcttttatttttatctgttattgaagtgattgaaatgcgtatgaaaagcaatgtgtttattttgaaatatgatgaacctttttatttttagtatggtgttattaaggaaagaatttcaggcagttatctctgctaataatagaagccttcttcaccccttcaagggaacagtattcttgcttaagtggtgtcttatgtttggcagtgtttgcctctgataaattttatgtatttctttgggtggtacctttgtttttaaaatattcataattctctttttaatctgccattagatctttttaaacagccttttatatgattaaagataatttataaaatcttgctatatgtctcttactctgaatgttagtatgttattaatatactttgttttwtcagaatcatttttcttcagattatatatactattaaaacaagaacagtgtgttcttattcaacatctcagtttctaaattrtaaatgaattataaggtaagttaaactgactgtcataaaacaatagatctaacatttttaaatataccatacttttttttttctaaatgcttgttttacttgggcaatatgataagtataagttattttcattttctttttaaaaaaatcattttactgtttctcacaatgtatgtatttatataymtayatatatatatatatatatattttttttttttttttttgtagagacagggtytcactgtattgttcaggtagtctcaaactcctgggctcaagtgatccacctatattggcctcccagaatgctgagattatagacatgagccaccatgcccagcttttttttttttaatgtgtttgagtataagttggaactatatggtgttccataattgattccagtttttccagtcttaattaatggaataatacaatcaatataaagtatttgctgtgtttagtcatacgggattttaagcaaaatgttttttaccagtgttcatctgctcatgagggatcttctcctatgacccaaacacctcccattaggccccatctccaacattggagattaaatttcagtgtgagatttggataggacaaatatccagactatgtgaagtggctaaaaggcagaagaactaggaagagtttgagtcttgtgaggcaacagttggagttcgcagtttatcaaggagagtctgataaacagttgggtttttggctgcaaccctctgaagacggatatcctgcttagaataagcttaatctcagattgatctgcctcttacctttcttctctgggggaagataaaactgtcagagcctctacagattttcatacacaatgttcagcattctaagagacagggtgaagataatagaaacaggtttgtaggggatgcagatagtaaagatatcaaacacagaattttaaataactgatacttttgtttaaagtggagaatattagcagaggactggaatctataaaaataaaggaaattctaggactgaaaaaatacaataattgaattatcttttagatgattaatagcagattagattccattgaagagaggattagtgaattagatgatgggtcagaagaaaatacccagactgaaagataracaaaaggatgaaaagaaagtataagacacatatgagaacacagtgaaaagtctaatacatgtattattggaagctatatagaaaaagttaattgcaaacctccatttttcttttctgtaaaatggtaaccccaggtttaccttcttttaatagagtttctctggacatagactaagataaatgtgatttatcagttctattgccaacaacagtatttattgtaaaaatgacctgtgattggttaactgcatttggactgggaggactacaaatggacatgttatactcccaagagactacattattcaccatttctaccagcataaaacttatagggaaacagacgtccagtttccctttaaggtgtctcttcaaactcaagcacttcctgatgggaggcttagaagttgcaagaatgggcttattttatgaagtatttcttgtttgaggcttgtatatgctggagtgtactgtatccactgatacgggcttcccaacttcatgtacccctgtgtgatgaggaggcatggaagtagcagctgaatattttaaggacttctgatgaagatgtttttggttatgscatcctgacgttctgtgtttctgtcctaagttctcataaaaagctaagtaaaactgatgtaacattaccaccttttgtatcctgaggtatgaatgtcatcttgaatccaagaccactgatggtcatacacagcaggtaatacataattccagaagaagaggacaaagggaatggggcagaggcagcatttgaagagataatggcagaaagtattctaaaactgattaaatgcctcaagccacagattcagaagcccccagcagaataaatgtaagaaaaccattcctagagatatcattgtgcaactggtctaaaccaattcccttttcttgagcctcccttatgctggtgtagactgtatttatccttgcagaaatgggaaaaaaatgttgagaatatcttaaaagcagccagggggtggggtaaaaaaaagaagtgtattatcttcaaagggacagtaataagttgactccccaactaaaacagtgaaaacaaggaaaaaatggaatggaatttttttttaccttcgaagaggtaaaagaaacaaactgccagcwtataattttatgcccagcaaaaatgttcttcaaaaataaaggtaagctgggcgtggtggctcatgcctgtaatcccagcactttgggaggccaaggcggggatcacctgaggtcaggagtttgrgaccagcctggccaacatggtgaaaccccgtctttactgaaaatacaaaaattggccagatgtggtagcacacatctgtaatcccagctactcgggaggctgaggcaggagaattgcttgaaccggggaggcagaggttgcagtgagccgagatcgtgccactgcactccagcctgggtgacagagcragactccatctcaaaataaataaataaataaataaaactccagcctgggtgacagagcaagactccgtctcaaaataaataaatgaatgaaagaaggaaggaaggcaaaatgcatttttatgcaaacacaaattgagacaatttgtcaacagaagacatataacaaagggaacaccaaaggcaatttttcaggaggaaagaaagtgaccccaggtggaaggaagaaatgcaaaaagaaatgaagagcgttgggaagtctaagtatgtgggtaactaaatagatactgactatacaaaataatatcttgcgagaytgagaatatatgtaggaatgaaatgcaagaacagaaaagatatgagaaaaagtagagttatagtgttctaaagtccttgctttgtttgggaaatgtaaaaacacaaatttttattagactgaagttaaggatgcatgttgtaatatctggggtagccattaaaatgaaacctgaggactctagagaaaaaaacacagatcatgtttcttattttgttttggagagaattctagatcattccacaactctactttaaaaagaaattttatggaatgtaaaattatgtagtcaacaagaaaacattcagaggtggttaatgagaatggaaggggagttgtttgaagacaggaaaataaaggaggacgagtaagaaggagatgaagcatgtggaataagagagacaaaaagaaaatagacacataaggaccagagttggaaagacattaagagagggcatggtttatgacgctttgggataagtgttgctggcagagtctactgaatgctaatacattctccaacggtgttaaagagtctactraatgctaatacattctccaacagtgttgaagaatttataatggtaaatgttgttgttkttttttttcttccccccccccgccattttttgtttgtttgtttgttttgttttgagtctgggtctcactctgttgcccaggctggagtatagtggcacaatcatagctcactgtaatctcgaactcctgggctcaagtgatcctccgtgatcctcctgcctycttttttttttcttttttggaggcagagtgttcctctgtcccccaggctggagtgcaatggcatgatcttggctcactgcaacctctgtctcccgggctcaagcaattcttgtacctcagcctctgcagtagctgggactccaggtatgctccatcacaccaactcctgccttctcttcctgagtggctgggactacaggcgagtgccaccatgcccggctaatttttaatttttttttttttttgtagagatggggtcttcctatgttgccagggctggtctgaaactcctggcttcaagcgatcctctcgcctgggcctcccaaagtgcttggattacaggcatgagccaccatgcttggctgtaaactgtattcctgactctattttttaatcttaaatgatgatgtaaaaataaagttgattttcctgtggaatcctagattaacttaaattttaaagaagtattttattggctgggcacggtggctcatgcctgtaatcctagcactttgggaggccgaggcaggtgaatcacatgagaggccaggcattcaaaaccagccrgccaagatggcaaaaccctgtctctactaaaaatacaaaaaatgagctgggcatggtggtgcatgtctgtaatcccagctacttcagaggctgaggcaggagaatcgcttgaatctgggaagcagaggtttcagtgagctgagatcatgccaccgcactctagcctgggtgacagaacaagactctgtctcaaaaaaaaaaaaaggaaaaaaaaaggtattaaatattttatttatttatttttctttttattgctgctgcacaaattaacgttttaaagaaatattttaaagttacaatctaaagccagtataaacacttattttaaaaataaagcagaggtgtcatatctcactcctgtaatcccagcactttgggaggctgaggcgggtggattccttgaaccagcctggacaaaatggcgaaaccccatctcaacaagaaacataaaaattagccagccatggtggcacgtgcctatagtcccagcgacttggggaactgaggcgggaggatcgcttaggcctgggaggttgaggctgcagtgagctgtgagcgtcctactgcactccagcttgtgtgacaaagagagaccctgtctctaaataaataaataaagcagaatacagcatatcacataattaaagaagttaggtgtagagcaagtctttactaaaataaattattttcataagtctttactgatctatgtaaaatagcccattttcctgtcaccttgtcactctgctttcttcatgtatcatcattacatcactgtttcttctattagaaaatttccttattttttgtcttctaacacaccaagcacaactataatgttatatatttgtttattatttatgttctccaccagaaggcaagttccatttattttcacaattcaaggcaatgcctagtacacatcagacactcagaacatatttgttaaatgaatgaatgagcaaatgaatgaaagacttcaaggatgtacaagttcattctcttaataacatttaagttcattttacatattttattaggggatttagagactcttaagactttcagttcatgtgttattttcttgatttttcagcacttcttgatgactaaccttagtatatctgatccatacaaaggccacagccctaccccagccttactctctaactgaacacagcaattctccatacttgattattttcatgcattgtccctccctccttagcctatcactactagactctatcccttcactgtgacctcatttctcaaatctaatgctagagataatgcttatcctcttaagcatgcaagtgagcacccttgatacgttgtaatcaaggaaacctgattattgaagggtaaaattatgtgaattttgagcttgggcgttagaggcagatacaccatcctgtcactcaccaatttctaatttccagtttgctcacttgtaaatagggcataataatatttaccttgtgggagttttgggaattaaatatgtacataaagtactatttaataaatatggtacttatttaataagttgtagataaaaaggaaaggaagtctcttgcttccttgtgagaaccatcctttagagaactttaaaggattttcagggaaaggaaatttggagaagagcaatgagattgttttgtttcaccaygggcagaggtgaaaggagcgttgtgttgttttggcaggagtctggggatggtaggggtyggaacatatgtgcattacataacgctgctgatcaccagagttacggcttttgacatgaatgagttaaggttgctgaccaccccatgaggcccaactggctgatacatgtgtgatctcttggctcgtcacagcttaggtatatagtgtcctccaaatgttcttaacktttttattgtactccatatacaagagtatactggcatcttttaygtaaattctcaataaattttcacaaactgaacacatccacgtaaccaccactttgataaagacatggaaaatgaccagtatcccagaagtccccttgtgtcccatatccccttgtttccaacctccaccccaccaatgggaaccactatccatggatagtttcacctgtttttgaactttatagagacagaattctactgtatctggcttctttacatgggattatgtttatgagatctatccatgtcattgcatgtagttgtaattcattctcattgctatatagtattgcattaagactatactattatttgtccattctattactgatggaaatttggtagtttttacatcttggttgttatgattaatgctattttacacattcctgtacttgtcttttttctatttttattattttagaaaaacgtgaatttaaaaccatatatataaatattattttagaaatatatttttttctactgtcacatttcagattcttgtcattactgggagtattttttcaggtatctaccatggctttctagaataccatatttattgttatttaagttgtttgagatgcaatacttttgaatccatacacaatactgtaacaggtacctgctaatayaatgttacaaccacaggtgttttttttcacttgtctttttgagttataatcttcactatgttgtaactatttagtatactaatttttaaagtaatctttaaaagactttaaaatgatattctacatttgtatgtgtgaaatcattcttcagggataattatcatattactatatccttgataagtatcttttttgttgttactgattccatcagaagttttctcccatgtagtaaagattgatacatttgttaggcaagtgtgtcttacatatagtcatttgtcrttcaaaataatttagaaagtgccttcttaagatgaaagtgtcttcttaagatgaaagatttatragaacttgaatttaggaagaatctctttttttctgcagtttaacttttgattaaaaaggaaacatcagattatatttgggactatatatctttgagaaaaacatatgacagcacttcaaaaattcatggaaaaatggaattaaaagataaaaataaaaaatataaacatttttaatttttaattttaatttcaattttttaattaaatagagatgatttwaaaaaaaaattaaatacagacgaggtctcactatgttgcctaggctcgtctcaaactcctgagctcatgtgatcctcctgccttggcctcccaaagtgctaggattgattgcaggcatgagccaccatgcccggccaactttattttttagcataaatgccatcaaggtcaagatacttttgtaagcaatgatagcagccatttagtccattcctaaagaatttacagtcctcagagtttaaccatgtcagtgcagtcttttttacaygagtaactaaaagaaaataggtttgttttaaaggtgtgtgtgtgtttttttttaatattaggaaacaaagtcagaaggagccacatcagaactgtaagttggatgcctaatgattttccttgaaaattcatgcaaattgcccttgtttgatgagaggaatgagcaggagcattgtcatggtggagaaggactctttggtgaagctttccatgggagtttttctgctaargttttggctaactttcccaaaacactctaataatcagatgttgttgttccttggccctccagagagtcaataaacaaaatgcctgaagatcccaaaaaactgttgccatgaactctgctctgttttttgtttgtttgttgttttttgtttgtttgttgttttttaagagacaaggtctttgtgtcacygaggctggagggcagtggcgcaatcatagctcactgcagcctggaactcaagtgatcctcttgtttcagccccctgagtagctgagactgtaggcctgtgccaccacacttgggtcattttaaacaatatttttgaagagacggggtcttgctatgttgccaggctggtctcgtcctcctgggctcaagcgatcctctcgcccctgtttcccaaagtgttgggattcacaggtgtgagccactgcgcctagcccacctttgctcttcaccagtccactgtactttaactggaccacttccacctcttggtagccattgtcaggactgtgctttgtcttcaggatcatattggaaaagccatgtttcatttcctattacaactcttcgaagaaatgcttcaggatattgaagctacctatttaaaatttccattgagagctctgctcttgtctgcagctgatctgagtgcaacagttttgacacccattgagtggaatgtttgctcaactttaactttttaggcagagttgtgtcaaactaaatcgattgacatgcctatgatgtcggctgtcatttctgcctgtccttttcaattaaggcatgaacaatatttaattttttttcttacaaatctgtgagggtggtctgctgctatgggcttcatcttcaaaatcatcttgtcagccaagcatggtggctaacccctataatcccagcactttaagaggcagaggtaggaagatcgcttgagcccaggagtttgagaccagctttggcaacatagcaagaccctgtctctacaaaaaataaaaaattagctgagcatagtggtgcacgcctatggttacagtttctctggaggctgaggtgggagaatcacttgacacagaaggtcrgggttgcagggagcagtgattgcatcactgccttccagcctgggcaacagagtgagaccctgcctcaacacaaaacaaaaaactcttcttgtcccttcttaaaacaaattacctatttgtaaactgctgatttctttgagtcrttgttcccataaacttttcataaggcctcaatgatttcaccatacttccattaatgcttcgatataaatttgatgtttgtttttgctttaacattagcagaattcatgttgctttaatagggactctttttaaactgttgcttatccttcttagtgcctcaaactagatcctgttcagacatgtaatagtttattttggtacaaaagttttttgatatccatgcatagttttttcataatatgcatttccatgaattttttgaattttttaaatatttttctttttagttcagatgttgtttctggtctaatatttacttgtttatatttaataagttatttttactttaaaaatattttgatctttttttacatgcatgtttgtgtgtgcagtttctggtgtatttttaacagtagcaataggactgttcaggactcttaggaaatgcaaagagagcaaatttttttccccttgagacttgctttggagatagcaaggtatagctttgaatcacagctccaaaattgattgcttatatgcaatttggttaagtgtcttaaactctgcgagcctgggttttctcttctacargaactcttgtagaatttaaattaaaaaatatataaagtgcttaatgcatttatatacatagaarcacatgtatgcataagtatatgtgtacacacacacacacacacacacacacacmcacacacayatatacatacrtacaaacagcytgctaagtatgaggcacgcattaccattactattagctgcctttcagaattacctgttttctattgatatcataactacctttcctcaattgctttatcttttaggccccagaattgtctggtctttcctgccttggatatccgctctagctagttcctatcttttttttttttttttgagacagcgtccaaaaaaaatccaggccagagtacagtggcactgtcttggctcactgcaacctccgcctccccggttcaaacgattctcctgcctcagccttgtgagtagctgggattacaggtgcccaccgccacacccagctagtttttgtatttttagtagagacagggtttcaccatgtttgycatgctggtctcaaactcctgacctcaagtgatctgcccaccttggcctcccaaagtactgggattacaggcttgagccaccacacccagcctagctagtacctttctaaagtacaatgtacgagtacttttctttccatttcttagatctttgctacctaaagtttaagtacatagattagcagcattgaaagcttcttataaatacttcaaagcacttgagcacttttaatttatgcatttctgttggttataatacttgggagtgaaatcactgagtcatagagtatatacatgttcagttttagtagttacscattttgcatcaatttattgttttcccaagtgtttgcactaatttacattccytccagcaacctataaaagttccagttgctgtatttcttgactaatacatggcattgtctgtcttttttattgtgctattctggtgggtgtattatggtattgtattgcattgtggtcttaatttacttttctctgatgacccatgatattgagcaccttttcatgtttattgactatctagatctcctcttttctaaatctgttttcctgtgagacatataccttcttttgtaatgcccggaccttgactaaattgtagttctggtgctgatggttattattttttcttctgattcttttccatatttagaagcttctggaatgcagtactacataggattctttaggacttggaatatatagataataactctcttttgataggtgtttgttggtttgctcagatatgagagtgattagcacaccaaacttacatacacctcatattctaaagcagcaatactagtagattgtgaagcctgtatcatatattcacgcaccccaagtattagagttagtcatgcattttttttccatacagtaaataaatagttactgagtgttagttatgtgttaggtactgtgccagatgccaaggatcaatgataaatgagacacagaccctgttctgaaggagctagccaccgtaaaggagatcagtaacaacaacagcaaagtaggtaattacagcacttgatgttaagagccaccaggaagaggagctgtgggattacattagaacatcacttaatcagactgttgagttggtggaatgagttggggaatggggtgctagttagggaatgcttactgaaagacggtacttcatttgaaagacaaatgagacatagacatgtgatgcattggagatttggtgaatgggaatttaaatagttcacatatttaatggcatttatgtattccattgaatacagttcaactgaaatttgctgaatgcttatcataaactgggcatgtgttggctctgaaaatgagagaaagcacagtccttatgggaagttccaaatagttctaaatgactgaagtataacatttgaggtgagggaatagtgaatgatgttacaggaaagacaggcagagacatatatatgtattatataaatactttatgtatacctatagcactatatgaagtcctttaatattcaaccattctgattaccttcttactccaattttccaattaggtgcataacatgctgtgagtgtagaatgggtttcagcttcccaatatcagtggagcctccattctatatggtaccataatttgtcctgactaccagagcttctgtccaacaccatcgtacaaaattcttgaatcttccccttggttttcatttcagtcagcttgccttacctgtaattacagggtatacagaagactaatctttcttactactaaagtatttcataacatatggacactttggtcaaaagcaattagtggaaagagaagtgtttctgattcagggtctacagaaaataagatagtggagctggctgaggactgatacacatgccttccatcagagccaaaacttatctatgctcgttcctcatttcattcattcttgcccccagtgtttttttcccccacctcttaaacttagggccaatttaaaggtctggccttcagactgtttagggtcgtgaggggaacattgtaactggtagccaaaaatgccattccaactggaaggctatatctctagcatctaaacttggaattctaagtgtcacttctcccaaacccaaattattattacatatggtgtgtattaataaattctataatacctttaatatgatagcattatttyatatattatgagttaaatctttcgttgggtaaccacagattgcattatagtataatcattaggaacataggctttagaatcagatagatctggatttaaatactgattttgtccattactagtcagtttgaatttctctaagtcttagtttccacatctataaaatttcctcatacagtcattaaaagcttaaatgaaacaatgtatataaaatgttaaacatgtatatatacatatagatacacacctgctaaggtatccctcacagatttgtgagaaagaataattaactgtcattaaataacccctgctacaaatctggattataaattgacttctgtagacaccctgaaggatgatgtccatttcttggtagtctctcttgtgccttcacttggagaccctcctgaaggacttagtgcacattttctttttagtctaaattttaagtcagaccaccccaaatatgtcccaaaagttctaagaaactttttaagctatggtaatacaatggtaggcttgattttatttatttagataaaatacgatgatagacttgattttacttattatatagactaataacttcctgggagcactgtgattgccacacttccaaagagaagaaaaacttttcaagcaccaaaaaagtagcttaaaaacaaattttgtacaccagtcagggactctttagagtrcactcataggtgggaattgaacaatgagatcacatggacacaggaaggggaacatcacactctggggactgttgtggggtggggggaagggggagggatagcattgggagatatacctaatgttagatgacgagttagtgggtgcagcacaccagcatggcacatgtatacatatgtaacaaacctgcacattgtgcacatgtaccccaaaacttaaagtataaaaaaaaaaaaaaagaaataccaccttcagcaccttgtccagtggagcatgtgaaattaagtacttagattctttttgtggactgaagcttcattttctttgggctagttcaaattattatgcagtatttccatagcctttacattttggcaactcttttctttgatcctagcagaaaaataggttataattttggccccaaakaattattttttaattgttccttttgttttattagatatgataatatcctaaactatataatatattaaaatagaatgaggatgtatctgatatgaattactatgggatgatgtacagatacagaagtgttccaaactatgccttatgaaactgtagtgtcttgcctgtggtaaaaaatgctggacttcatatgggaatgatattggaaatttgaaaacttttaatctttgtgtaaaacgattgtgtatttatacctgtataacacagctatgtgaagttctgtgtcttgtatataaagacaaatgtgtcaaaactgaaaagcatccagaaagtggcaaccgaaatcgtcaagaggcaggagtggcttaaaagcttkatacccttcaatgtggaatgatcctcagggatatcattaggaaagtcttagagttggaaggggaattagctttgatctactccaacctgttatttaatgcaggaatttatcttatgataatcctgataaatggctgagcttcctctgtttgaatactggatgatgcattaagagtgctgattttggctgggcacggtggctcacacctgtaatgccagcactttgggaggctaaggcaggcagatcacctgaggtcaggagttccagaccagcctggccaacatggtgaaatcctgtctctattaaaaatacagaaattagccaagtgtggtggtgcgtgcctgtaattccagctacttgggaggctgaggcaggagaatcacttgaacccgggaggcagaggttgcagtgaactgagatcgtaccactgcactccagcctgggtgacagactgtctcagaaaaaaaaaaaagtgctgattttggggacatgctgcttgggtttaaacccagccctgcctactgggatctaccatggtcactcacctactagttgagtgaccacaggcaaattcttaacctctctgcaaatttttacccagccccatttcctggcttattattgccagcatctgtgttcctgacaataggcgaagacacaagggatctagcctctgaccccatcccatctagcattgagagatgaactgagaatcaagtaaatgtttgcattatacatctggtggaaaaaaagtatattcagcatatagtagttaccttaaaaaatgaaattttcagcatagaccagagtggtgaaaagcaagtttaggggaggcttcatggatcagacaagtctgttagttgaaggagagtctattgacagttcccagttctgccttctggaacaacataaatcagtttaattccttctgtgtgacaattcttcaccttatcaaacgtaaaatataaaaggcatagttcgggtgagtgtggatttttcccctcttaaaattccatagctttagagagtgttttgtgtattttggctaaaatttaggaaaaacaaaatgaaccactaatgggtgataattttgtagagctctttaactttttaatccaaaaaattgtgtggactataaattaaaatttrtttccatcaactcatatatggttactcagcaaaattggaaatttgaactagattccaaaccttttgagttttaaaatattctaaatagtgtattatttagattcagctttgagtgacagaaatatccaaaataagaatggcttaaacaaatagcagtattttgctgtcttgtaaaagtctgagcaggtgatgtagactgttgttatgtctgatggtgtcaaaaatatggttttctctttcctgttgctctccccttcttaagtctggtcttgaggtgcaaaatggtggctttgataattctaggcttcaggatgaaggaagggatgaggaataagttgccagggacatttctgctttatatctcattggctggaacatactcaggtggccacatctattaatagttacaagagaggctaagatgcaggctgtackctgggtagccatgtactcagttgtaatttgggagtttgatgtatgggagaaagaaagatgcagaagatattgggggacaaccagcagtgtaatgtaattagtatagctacttacttgagtaggccttcattaaatcgttgttcaacagatgaatgtttctaattgctcctgtcaaagtaggtattgatctggatatttacrtrtatacatgataaattatggcaagattatttattattggtgtttttataattttatttctcatctactctttatgaatatggtatatctgacagtcttcaggcagatgtaatactgtacaagatttatttcagtttatttattgcrgtctccccaccccccaaaacttggaggcgtattaaaaaatctcttctcatgtgtctgtctatgatcaacgtttcttgcatatgctcggcaaatgttttgagattgaataaatgaatggtaataaaactttgaggcatccaagccttttcttttaatttcttttgtttcgatttacacaaacaaaagtttatatctgtaatatacatagaagaaattcttgaccttaaatctgtatttattacaagattttcaggaacattcattcagctttcrggtggaatgtggttaggtttggatttaattatggttaagtaccaattatgacgttattaggcaaaaaaggctaaatccccattgtagggatttcagtgctagttatttcattgaggctattggggatttaaggagagagacgtatttgttagaccagcctggcaaggtgtttgggtcttataaaattcccaaagatgagtaataaactacccaggtatcaagaaaccatttaacttattttaattgaatagaaagttcctagaaatcggtaaggtttttctggagtcctagaaacatattttgaaatgttagcaagttatattgcttgaacttgatatgtctcactttgtttgttttatatgctgagaaagtaactttcaagcttcattaaattttttgacataatttacagtttgcaaaagttattaagataaaaataatctccagcgacagaaactcagttcttcctaagtcatcgcattacatgtttggagtactctgactgagggtattactctgtggcagttatgctggctctgaagtcagacagcccaggtcagatgttatgccatcacttactgtgtgacctygggtgacttatttagctcctctgtgcctcaggtttctcatctatacactggagggtaataatacttcatagagttgagagagcagggaagctagcacttagaataaagcttagtacataataaacaataaatgtcattaatggtcacttttgtcatcattattaatgtttttctcaaaatgagttaaaatatgactccaagaaatatttaggagattatatcagttgactttttcatttgtagcatatatgctatgtgctaccaagtgaaatagaagacacaagtttggtgaagaagaggaggagaatgctgaatgtggtttttttgtttttgtttttcatttttttagagacagggtctcactctgtcacccaggctgtattgcagtggcaccatcttgggttactacaacctccgcctcccaggctcaagggatcctccttcctcaccctcctaagtagctgggactatagacatgtgccaccacacccagctaattttttatttttagtagagatggggttttgccatgttgcccaggctggtctcgaactcctgggctcaagtgaaccacctgcctcagcctcccaaagtgctgggattacaggcatgagctgtcatgcttggcccttgaatttagttttgaatgtgttgaacttgagttrtttctgggatattaatcttgaaatatgaatttaaaggagggacagaggtcactggcatatgggtgataattaaaactatgggagatgaatgacataacataagggtctaccktgggcctaggtttgaaacctggggatactaaccttcaaagaacaggcagaggacataaaggaagccatctgagagttagtaggagraacaggagagagaaataccaccaaaaagaggtatgrtgtctgatgaaatagaggttatagtaatctgagaactgaaaagtatccatggcttgttaattaatgggtattttgtgactgtttggtatccgtagagtggaggtggaaaccagatagctgtgaatttagggatggtgataagggaggaaaagaaggcaataaatgtaactactgtaactactcttgagaaattttaatgagacaagttggaaactagaggaagatacaggatcaatggaaaagttttggagggtatatgatttggataggcttaagagaaatagccattagaaaaggaaaaaggttgaatatgaggasagtgtagaaaagatgggttcaaggccaaagttgacgagactggctttgaataggaggagggatgtggacagaagtaagcctttaagatagaggaaattggggttcacctgtaatccctgcactttgggaggctgaggcaggaggatcacttgagcccaggagttcaagaccagcctgagcaacatggtgagaccccatctctacaaagatttaaagaaaaattagctggggatgctggcacattcttgtagtgccagctactgggaggctgagtcagaaggatcacttgagcccaggaggttgaaggctgcagtgagctatgttcactgcactgcattccagcctggataacaaaacaataccctgtctcaaaataaataaatgaaaagatagggaaagtcactccaaatgacttccatgttctctaaagaaataaaaaagggtgtttgtcactgaaaggagggttagatagatgttttgaggagagtagtgaaagattagaatagaattgaggaaaatgggagaggtagctgacaaatttgttcttcgactgagggatttttcacctgaacagtatttaaagatatcactgttagtgtggatgccatgaatgtgttatatgaaaaaacagaatgactatatttatcatagaatatattgatttagcacctctgtgtacaaagcactgtgcgcrtatacttcctgagagattcagatgagcactggtcatcttgtccaaggagagtatgagctaatagctcaggtcatgtgattgtcacaaatgcaaatgtttataaaagattaaaaatggtaaatgacacatgagttttataaacatactataacagtttgaaagagatagagattccatcaaatgggggaaaataagaggactttatgaaaaaggcacaaaaaagggctaggtgtgaattctctgttgaaatagtaattaytgtgaatttttgatttattacactatttattcttctatgactggcattaaacagaagaagagaaacaaagagattaatgaaacagtgagttctctcctgtccaaacaatgttctaaagttgattatgtttttagtaagaatatagaattcagtaatcattttcacaaatattccacaaataggaacrtctctgttaggtgcaaaagatacagagatgactaagatacagtttctgtcctcagagagtgcatactctaatagaagaaatagaagtaaaaagaactgtagttttgtacaacaagggatataaagatggtatatatgagtagagaagtttagggcacaatggaaggaagcatgaataaatgattatgttgatatgatagcacattttttttcctttttcttttctttagttggagaacatcaattracaggccataaagtggcagttaaaatcttaaatagacagaagattcgcagtttagatgttgttggaaaaataaaacgagaaattcaaaatctaaaactctttcgtcatcctcatattatcaaactgtaagtatttttgtatctaataataccaaagagacacctatcttaaaatgttttttaggaattttataataattgttaattgttaaccttttacaaagattttttttcatgttcatattcagcaagtgttaattcatttaacctttatcagtccttttttttgcatactcttggttagactgaacagacattgtttctaaattagtactcaatttatgtttctaaattagtactcaatttatgtttctaaattagtacatcaattctcaagtgatgaatgaagttgattcatcacatttagaagttgattcttatccaactttaaatgtcattcagggctttgacatttctagattcatttttataatttttatctagtcaattttcactaacattcagggtattttttcctttggaaagatagaaagtatatgtcaaagattatttcacatagtatattacttgtagaastgaaagtagtactataaccataaagcttttaggaaggcaaatgtgtttttttccccttggaataaattataaacttaaaagttaggtaaatattgagataaataagataagtaattgaaagataaatakattattttaaaattgactagaccctagaaaatttaaatattcattgtgcaataatgtgtttctttcagtcatttaaagttgcagtttaatatttgttgggaaaatgtaacgtgctagacactgaaaattgtcttatttatctttaagcttggatacagttttataaaataagtattgctcttacttattgagtacctgatagtggtcaggaactgtaccaagcatttttttttgtcaagtttctgctgaatgtgtggagcattttccttatttaatttaatattatcttcatgatcagtgtctaaagtaggcttactttatagacaaggaaactgcattatctaaaaagtaatagcagyttatccaaggccacacagctagtaagtcacagagctggtagttgaggtcaarcctgattccaaatgccatgctgttaatgctccagcattccagtttttcttaaaactgagagttatataaattccttttaaagaaaaaataaatttatggatccctcattttgacttaattatttttaatataccattacttaagaaacaaagccctatgtataaactttatatgcatatagttcgaatacaactatgaaaccaaaagaaattcacaatttaaatacaaaaaaacaatggaatcaatgggattcaaagcagtatcaatagtataatgtgacaaataacagtgttttataacaaccaaaatcattgttagagagtttaatagtggaaacagtaggaggagatcaaatactaaatttatattgtgagtcaaataagattggtacagagaaagcatgttcatataaatatactattaaaaaagaagtattaataactctgagatgttatttgctagttcattaaaatcaggcattatatttaggctgayctttgtcagtgagcagtctttgaatgtcagcattaatgggaacaacttgataaccctgtggagttatattgtttacttgatgacaagagtagcatataagtgtggtaagcagagtaatacctgccccccatgtctatttcctaattcccagaatttgtgaatatgttaggttgcatggcaaagggtaacattgctaagcagctgaccttaaactagggaggttatcctggatyatgtaggtgggccaaatattaacacagtggttcttaaaagtagaggagaagagtagaagaaaagagtcagagaaaaaggtctgaacatagaaacaacatcagaatgataaaatgggagaaggactcaactggccgtttctgcgtttgaagatggaggaaagggagcatgagtcaatgaatgcaggcagtctctacaagctgggaaatgcaaagaaattctgccccagagccttcagaaggcaacacagctctgctggcaccttgattttagcccactgagacatatgtcaagcttttaagataaagaactgtaagataatacatttgtgttgttttaagccactgagtttgaagtatggcagcaatgggaaactaatacagcatcattcttgaaatccttaaataaatggctggtccaattattgttgagatttggaacattcatttagtctttactgctgtacttattgttagtgaactgtggcttattggtatttttaatgaagggacccatgtggtgcatcttacyggcagcaagagtatgccactgactgttcagagcaggcttttatgggattggtgtggatgaccggtgatgactcagttctcacatcactgctaggaaaccttcattcttagagtaagcttcaatgtcatatgatcttcacttgaagttcacttagtcataaacataaacaaaatgaggtccctgaaattgcatggcagtacttgattataaggttatcatccaggacctatgtattagatggtccagagtatgtatatagaggtttttaaagattgtcataagaattaaaattcyacccatgagcttggtractcacctytcctatccwttgtttctttaactttaaaatgggacacctcatttgaggattaaatgtgttggcactggtataatgcctagtgtttgataagcattggcccagagcaggaattagcaacttataaactaattccagtcctctttcattattccaratggttttcacttaactgaaacagttagtctctgacttcaactcygtattattcatgactttgttctagttactgggtaacatctaagctaaatctctttgctcttccccactgagtgtccacttcctatgagaagagaaagctgaaatagccagactaaaagtgtcatatgctagaatgaaagtggrgaagggaaagatctttccatatttgccttataccttgacctcatcacttttacaatgccaaccctgaaagactttgaggaaattttacccgtttgggtatgagtcctactatctgtacagttcccagttcctaaaaacacaaatcagattttatcaataagcagttgcaattgtcataattgtcatgaggattctaaggcttcttttcctttttttttttttttaacagagcctagctctgttgcccaggctggagtgcagtggtgcaatcttggctcactgcaaccttcgcttcccagattcaaatgattctcatgcctcagccttccaagtagctgagactacaggcatgtgccaccacaccctgctaattttgtattttttgtagagacaggctttccgccattttgccaggctggtctcgacctcctaagctcaaaaccatcagcctgccgcagcctcccaaagtgctgagattacaggcttgagccactgcgcccaggcccgaagacttatttttgatgtcatatttatcagtgttttcttgcctycatttctatatttactttcaatcattttatttttgtttgactgtctcatcctgattatttaattatttgctrttttctgaaggaattatagaagattgtcagagttggtcagaaagtaattggcagaggtgaatttgcagtttaaaacttttggcttccagccttgagattaattcattcagccacattgcctctttaattgtagatctgatcttaaaacaaaaaacaaacaaacaaaaaaacactcatgtatttttgctacagaagaagcttattgacatcgtctgtaacagtgttagtgatttaaacrgagagagcaaccttaccctttcagtggttttcttttgtgtagccttggactgtcaggaatagtttccttattgcaaaagtgggactctagaattagcaagaaagtttgagcattgaatgccaagaatgaaggatatttattgcatgatttctttattaacccaaattgaaaaaaaaattacaaatgaatgacctaaaacccactggtagaaaattaaaaggcacaaataggatttaaagaaaaatccaaactttcctatgaagtagaatttgttgaattgatttttgtccttttttttctttcctccataattcttaatgcaacttgattttacttggtcaaaagatgcttgttagtctggtagagatgatcttgtctaatttttttttttttttttgagacaaagtctcgctctgttgcccaggctggagtgcagtagcatgatctcrgctcactgcaacctccgcctcctgtgttcaagcgattctcctgcctcagcctcctgagtagctgggactacaggcacacaccaccacacccagctaatttttgtatttttagtagagacggggtttcaccatgttggccaggatggccttgatctcttgacttcgtgatctgcccaccttggcctcccaaagtgctgggattacgggcgtgagccaccatgcccagcctaattctttttagtctatcttatttaacctatggcctgctttttaacatcattaaccgccagcaccaccttgaaatgttgtctctaggtttccatgacacctcaggcttctgttttctttttttcattcttgtttattctgaaaactttcctttatgggccccgctttatcttcctggctgttaagtattgatgcagtcaagtacactgagctagtgtaattttcttagtgaaccctcttttgatgatttcatctactaccatggtgccatttgccatctctatgctgaagatttccaaatctttatgatttctggcccttttgtttctccagatttctgagcacatttatcaaattgtttatcggatgttcacattctaaagtcacagagtcacctgaagctaaamttttctctctcttccaaatttacttctctgtttttggagggtgyggtgggagagtggagggaggtaaatgaaaataccattcatgcagtttcccaagccccaaacttgggcaaaatctttaatttcttcttttccctcatttcttacatacaatcaatcattaaggtctgcacttctttttcctaagtgtcctctgaatttatccatttttctttgctctgtcaggttaccatcttgcttgttgtacttcagctgtttcctctgcttggaatactttatccacatctccctttccctaggctgccaattccaacttgtcttttaagtgcaattacatttgacccttgaacggtatgggtttgaaccacattggtctacttatgmttgggttttatgccrcctttgctatcctgagacagcaagaccaacccctcctcttcctcttcctcctcagtctactcaatatgaagatgacaaggataaagaccttgatggtgatccatttccacttaatgagtagttggtatattttctcttccttatgattttcctaataacattttcttgtctctagcttactttactataagaatacagtaaataatacatttaacatgcaaaatgtgtgttaattatttctgttatctgtaaggcttctgctcaacagtrggctattagtagttaagtttaggggtagtcaaaagttaaacgtggatttttgatgcacaggggttgacaccctaacccccacattgtctgaggatcaactgtacccctgaaaacctactttactcactaagactaggttaggctctaactcctctttgctctcaaagcactcaatgttcaccttttccraagcccttaaattgtgttgtaattgcacattttcttattggtatttcccacaagactgaagtacttaggagcaggaattatggttttttttttaattcaaaaaaaatttttttattatactttaagttctagggcacatgtgcacaatgtgcaggtttgttacatatgtatccatgtgccatgttggtgtgctgcacccattaactcgtcatttacattaggtatatctcctaatgctatccctcccctctcctgccaccccacgacaggccccggtgtgtgatgttccccttcctgtgtccaagtgttctcattgttcaattcccacctatgagtgagaacatgcggtgtttggttttctgtccttgtgatagtttgctgagaatgatggtttccagcttcatccatatccctacaaaggacatgaactcmtccttttttatggctgcatagtattccatggtgtatatgtgccacattttcttaatccagtctatcactgatggacatttgggttggttacaagtcttcgctattgtgaatagtgccacaataaacatacgtgtgcatgtgtctttatagcatcatgatttataatcctttggctatatacccagtaatgggatggcgggtcaaatggtatttctagttctagatccttgaggaatcaccacactgtgttccacaatggttgaactagtttacagtcccaccaacagtgtaaaagtgttcctatttctccacatcctctccagcacctgtcgtttcctgactttttaatgatcgccattctaactggtgtgagatggtgtctcattgtggttttgatttgcatttatcagatggccagtgatgatgagcatttttcatgtgtctgttggctgcgtaaatgtcttcttttgagaaatgtctgttcatatccttcgcccactttttgatggggttgtttgattttttcttgtacatttgttaagttctttgtagattctggatattagccctttgtcagatgggtagattgcaaaaattttctcccattctgtaggttgcctattcactctgatggtagtttcttttgctgtgcagaagctctttagtttaattagatcccatttgtcaattttggcttttgttgccattgcttttggtgttttagacatgaagaccttgcccatgcctatgtcctgaatggtattgcctaggttttcttctagggtttttatggttttaggtctaacatttaagtctttgatccatcttgaattaatttttgtataaggtgtaaggaaggggtccagtttcagctttctacatatggctagccaattttcccagcaccatttttaaatagggaatcctttccccatttcttgtttttgtcaggtttgtcaaagatcagatggttgtagatgtgtggtattatttctgaggcctctgctctgttccattggtctatatctctgttttggtaccagtaccatgctgttttggttactgtagccttgtagtatagtttgaagtcaggtagcgtgatgcctccagctttgttcttttggcttaggcttgtcttggcaatgtgggctcttttttggttccatatgaactttaaagtcgttttttccaattctgtgaagaaagttattggtagtttgatggggatggcattgmatctataattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggatttttattgagcacctactatgggttgggtgctgttctaggcataggggatataatcatgaaggacagagtctctttcttgtgttttttatgttctggacagtaagtaaacaaattaacaagatcattttaggtaaagataagtgctatgagaatgaaacatggtgctgtcacagagtgtgactaggaaagaagaagggctaatttagattaggtatgaggaagcctcactaagaagataggtttgacctaagacctaaaggatgatgaagatctgacatgtgaaaatctggggacagaatgttttcaaagcaaggggaagagcaacatcaaagaggtgaagcaaacttcaagtgttgtaggcaaaggaagattatgtactctcaggagtggagtgaggagaagagaagtagttcaggaattctaagagtagatggggaccagataacaaagggatttgaaggccttgctaagaaatttgattgtgttctaaataggaacttttggagagttggagaagtaacatgatatgaatatagtgtagaatgggtatggtggcagaagtagaagcagacagaccagttgggaagctattgctatagtctacctgggagattatggtggctttaaccaaagtgataatctagattagtgttggctaatacagtagccagtggccacatgtggctgtgtaaatttaaattaattaaaatgaaaaatttggttgtctggtcacactagccacattycaagtacttaatagctgcatatgtttagtgaccactgtgttggacagagcagataaaaaacatttctatcgttgtaggaagttctgttcaacagtcctggtctagatggagagaaatggatggatttgatatgtattttggagggagaactaatgtattactgatgggttagataaggaggagaaagaaaggaatttttttttttttttttttttttttttgcttaagcaactgggattttgggttttggcttgagcaagtaggtagtgatagtggtgtcattttctgagatggaaagaatggaaaagaaacattagagagatgtgaacattaaggatattgttttggccatgataagctaagaatccattagacatgtaaatggagatatcatctatcatctttatctctcctgcaactagcacagtagtaggtattcaataattacttgtagctccataatgacatttgaacaaggtcctgatggctctaggagtccaagcaagaacaaaagaatgaaagtgtraggaatatggtgtattgggaacaaacagtctggtttgtttggtgcacagagtatgtatagggaagtggaaaaataaagccagaaaggcaggttgttggttgatccattcattcaacagatgacaccatttaggcactagggatacagcaacagacaaaaaggcaacaacaacaaaatccttgctattatagagattatattagtgtgtggtggaggggtggtrgggaaatakacaataaatcccttattatatgtyatatgttagacagtgaagaggtgaggggatatgccatgtagatatctgaagkgggtraatgttacacatagagggaagagcaaatacaaaggaaagtagaaattcctgcaggtcagagatcaagggagcagaatgatctaggaagattagagtgagagatraggtcagagacataaagggcattataggccattgtcagggctttggcttttactcttgtctaagatgggaagccattggaaggctttgattagtggtatgatgtgatctgacttacatttagactgtaggtgagcaagagttgaagcagggaaaccaattgggagtcaattgcagtgatctgtaaaagatgatgttggcttgaaatacagcatagtgtagtagtgtttagaagtaagcatgttttgtatgtactttcaagatagagtcaacagcatttgctaacagataaaatgtgagttgtgagaggaaagaagttaaggatgacgccaaggcatctggcctcggcgaaaaaacaaggatggagttgccagtaactgaagtggagaagattgtaggaggaacaggtttgaggtgggatgttaggggggtggtttcaacaatttaattttggttttatgaagttgaaatgcttattagacatccaagtagagatgtaagtaggctgttgaataagtgaatctggagttcaggggagaggtgtaagctagagagataaatttggaagccatcagcagacagactgtatttaagatatttaaagcccyaagactggrtgaaatcaccaagataaacaagaagtccaaggactgggctctagaacactatgatgctaacatgtctgaaaaatgaggaggaaccagtaaaagagaatgaaaatgatcagtgaggtgggaggaaaattaggggaatcgggtatcttgaagccaagagaagaaagtgttttaggaaagatcaccaactgtcccttttactggtgaatattgagtaagatgataacggagaattgactgttggatttggcaacgtggaggttgctgttgtctttgaaaagaaccaatttattggaatgatgagggcaaaaacctgatgtaaagggtttaagagggaatatgagataaaaaaggggagatagtaactatmggcaggagaggagagacataggagtggtaaccagaaggaaatgaggagtctaaacaaggttagctttttaaaatgggagatattgtagaatgttggtatgccaaaaggagtgattcagtcaagaggaaggaattgatacaaaagaaagaggggctaattatagaagccaagtcccttcgtaggtgtgggagataatccagtgcataaytggaggagttagtctttgaaagtatatgaccatggagtggttggctgtgtgtggtggaagaaaagataattagaaatgaggcattcaaagaacttaaaggccatatgttaagatattttaagccttaagactggatgcggttaccaaagatatgagtacagataaacaagaagtccaaggactgagctctagagcactatgatgttaacatgtctgtttatatcacagattatctataaagatatcacttacacctraaacagtgacagtagtagcaatggggaaaaagacattaattcagaatgagaaggagttagtaagaagattgattgatgactataatgtgaaaaggtatgaggaggtattatctgatggcctgcacttcaaagacaatgagatttttgagggaggaagttttgggtaagaatttcttttagatcagaattcattcattactagactatgcaaatttgccagcatttaagatttcattaaattaatgtgaattaatgcatctaggctctgatcaacagtggcttccaatgtgtcagaaaaagagacacattatatgcctttggctagaggtacactacactacttagtctttcaaatgaaaacaaaaattgcaaaaatgaaacaaatctgatcaagtatctagatttaagagtgggttagaaattgtgcattttgctgctataaaggatggaacaacaaaattcatactgtggaatcctctttaacaaactaactggtttcttccacaaaagaatgcaagaaaaaaacaacagagatagaggagcaacctataaattagaagagacataagagacaaatgagccaattacaatatattgattgtgtttgtatcaataaatcttctgattggatatttgatgacattcatggttttttaaatttatgcatgataacaatattttgcatattgtgcatacacacatatatttttaagttatcctttagagatatgtacagatttatttacaaaggaagtgaaatccaaattcaatgtgaaatgatgactgaaaacatatacttttacaaagttaataaccaagacattaattaccttagactctagaatgttatagaaagtttgacttattctatatgtccatacataaataagaaaagtactgtcaactcaataarcatgggcaaaagacacagcattttctacgaagaaatgtatatggtgttttgcaactgttggagaatatataaatccaccagttttctaaagattttakcattgccaaactttctttggaaaactgtctttggtattatcttttcaattggaacatacacaataactatgactcagcagttgcactcatcagtgtatatcaaggagaaaatcttgccatgtagaagaatgttcgtgttagtccatttttacattactataaaggartactgaaggctgggtaatttataaagaaaagaggtttaattggcccacagttctgcaggctgtacaggaaacatggtgctggcttttacttctagtaagggtctcaggaagcttacaatcatgacagaaggcaactggcagccagggtgtcacatggtgagggagagcaagagaggaaggaggaagagccagtctcctttaaacaaccagctctcttatgaactgagcaagaattcacttattactgaggcaatggtgctaaaccattcatgagggatggatctacccccatgatccaatcacctcccaccagtccccatgttcaacattgggaatcacatttcaacatgagatttggaggggatgaacatacaaaccatattaatgttcacagcagcaaataatagcaacattatagaaacaacctaaatactcttttttttttttttttgagacagagtttcactcttgttgcccaggctggagtgcaatggcgtgatctcagcttaccgcaacctccrcctcccaggttcaagcgattctcgtacctcagtctccctagtagctgggattacaggcatgtgccaccacgcctggctaattttttatttttagtagacatggggtttctccatgttggtcaggctggtctcagactctygacctcaggtgattcacctgtctcggcctcccaaagtgctgggattacaggtatgagccaccgcacctggccaaaactctttagtggtagagtagatgaataaatacaataggatataacaatggtcaaatcaaataactacagcaaacacaacaataggattgaatctcaataaaataactwctagaatattacatagagcgtgatacctggtttttaaagcaaagaacagtttaacatatatatgaatttgaattattcatatatatgaaatatacatatgtagagagaggggatacacacacatgcatatgtacatatataaactgtataaaagaggtggggaggaaaggataaacagggtgttcaggatgacagctgcattgggtgagaagcaatgggatggggaaggcggatccctatattaattagttggaagctgttgtcaaggtcttggcctttttgtctgagtgatgggtttgtaggtattacattattaaaaatagtaattaaataaaaggtcattcatggactactgaagacaagtgtcatcaaccaagcatgattgctacatttctatgtaactgagttctaactaaagaaaaatcttatgtgtatgtagctacataaataatattctaaaatctcaatagattttaccaccaaaaaggtgtactcatgaatgttgatttttggctaactttggaaagatttctattttttttgattttcatatactattttatgtggctatttcctaaaaatgcgtataacttggtcaactggaaaatgcttaggatttttctggattattaatttatttttaccaattagaaatgctgtttctgaaaaatttttaaactacattagtttatttctctgctgtactaggaaaataatactgagaagtatgagtgattcatgattgaatktcttgtaatgcttcaatatacttgtattttagacagcacaagagatttgacttactcaggccaggcttagaatgtaatcctggaatttgccttttccactaaatccttaatgtaaaactgtctttttaagacgtcttccttctgaaatttgtttccctttgtccctaccccattgtggttaggggtgggggacaaagggaaattttattggttgaagttttgctgtaattttgctatgatttttcagtttcagattactctggttttggctctaagcactcacgttatttaaaagtgctaatttatacatttacttaaatacctactttgttataggcactttactaaatacatattcattaatcaaattattgtaataataaaaacatataattacaaactgagatgcgtggtctgaagctcaggaaaacgcatctgtgagtgcaaaaaggcacctcacctggacttaggaagtgacttttaagctgagatctaaaggatgattagggctcactcaggtcatagtataggattcaggtcagtgaaaacagcttatacaaaggagctgtagcaggaggaggtacagcatgactaacactgaaaaatgtagtatgactcagtgttgtgactcaaaggtgagaccaaacaacagagatggcargggcctgatttattcaggacctaagagcaatgggaaacctttgaagattctaaattgagaggctactggagatcatatttgtgtttgaagagaatctttatttaatgtctgtctttctggctaaactgtaagctccacgagtagaggcaccaacttttgatctcaccgagtacaatacaagtaggtactcaataaatgttgtgtcaccatttaatagcttagtgcctggcagacagtaagtgcttagtaacgttatgattttcattgctctagactggcctttagtgtaagacagtggctgctaaggatttagaggtttcatgaaataattaattccaagaatatctgttgaagacctgtgatatactcagaaatggcagctaaatttatttattagaatgtcatcacttcttttcttttgtgccccatctaggatgtacagagcacaaaagtgattgaaaattgttactaaatcagaccaacctacagtgaggtgctacagcagatgcacctgccctacagtattcagtttacgtgatcactttggtgcttgtaaagatagcttttataaaactatttcttctagagttctcagtataattacctttccaaagttcatttgaaatagtctcaattcttcttcagtcatattcgtttattttatataaattagaataccttgccatgtttcttcccaaagactaatgattgccattcaaaatatttcttctggccaggcttggtggctcatgcctgtaatcccagcattttgggaggccaaggcgggcagatcacttgaggtcaggagttcgagaccagcctggccaacatggtgaaacccccctctctactaaaaatacaaaaattagccgggcatggtggtgcatgcctgtagtcccagctactcgggaggttgaggcaggagaatttcttgaacccaggaggtggggtrcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacasacagacacacasacacacacacacacacacacacacacacactcttaatttttcatgatgggaattgtttaacatttacaaaagtaamgcggtgaaaccccatgcatgtcttattcaccttcaacagtagtcaattcattgttttatctacgccagattattttgaagcaaatctcaacattatctttttaatctgtaaactcttcagtatctactctagaaaatacttttttaaactctaaataacataagcatagtatcatcacatctttttttttttttttttgaagcggagtctcgctctgttgcccatgctggagtgcagtggcacgatcttggctcaccgcaagctctgcctcccgggttcacgccattctcctgcctcagcctcccgagtagctgggactacaggtgcccgccaccatgcccagctaattttttgtatttttagtagagayggggtttcaccgtgtttggtttagccaggatggtctcaatctcctgaccttgtgatctgtccgcctcggcctcccaaagtgctgggattacaggcgtgagccaccacgcccggcctatcacatcttaattaaaataattaacaacattatccaccactaatcagcatgtagactttcctgattgtttcataaatggtttttaaagttggtttatttgaatcagaatcaaaataagtctatacagcataattggtcaatatgtctcttaagttacttttaacgtatagtttatcctttccctttttttcttgcattttatttgttgaggaaatggtcatttttcacttcctggattttgctgaatgtatccctgtagtatcatgttacgtgtccaggaaaatatatgtatgttttacagaaatgaggtcttgctatgttgcccaggctggtaaaatactgactttagaagatatattccacttaattgccaacatgaagcctatgcttttcaaaatcggttccataaaatcatgttgaagatcagttattttcttttcttagcactttcatgtatgttctgttttagtttgttttgctgtcaattccccaaaacattgccctgagctcaagtgattctcccaccttggccttccaaagtgctgggattacaggcatgagccatagtgtctggcccaagtatattttctgtttatctttaaatatgtgatacctcatctccttttactgtaaacaaatttttgtttatatggaaaaattagttgttgaagagggaaagatttcaaaaattatgtaaacttgaaagggaggatctaaaggaacggccgtgagcctcaagaaatagaataattttgtaatggtccgtgtttattgctctgtgattattttgataacatgtaatttgttgccatcttaaagtattataaaacattgaaatataaaattgtagcaagagtagatataccagtttgattttggttaaagtaacatactttgttaactttttttaattaacaaaaaagataccaggtgatcagcactccaacagatttttttatggtaatggaatatgtgtctggaggtgaattatttgactacatctgtaagcatggacgggtgagtaacatactatctggtacactaaatctctaaactaataaaaaggaaagtattgggacatagaacaatgcaaagatatcttcaaggttgaagttgcttttatggtagtgctcaactaaacatgtagagtgttagataaattttctttcttaaaaagcattccttttgaaatactgattttagaaaatatgtttcacttaattgccaacatgatgcgtatgctttttaaaatctgttccataaaatcatgttgaagatcagttatttccttttcttagcactttcacatatgttctgttttagtttgttttactgtcaattccccaaaacattgtgcacatttaataatattaattgaaatttaaatatttctgcttagcracaaagacaaacttgtcttttgacatgttgagctttgacaagcttttggttggtttattttgtctgatttgttgagaattccaacataattctagcttgcttaattatatttagcctaattatgaaattaaaactcttgtcaaatagatgtctcagattttttttttttttttttttttgagacagactcttgctctgttgcccaggctggagcgcagtggcatgatctcagctcactgcaacctctgcctcctggtacaagcaattctcgtgtcccactctcctgagtagctggaactacaggtgcatgtcaccatgcccggctaatttttgtatttttagtagagatggagtttcaccttattggtcaggctggtctcaaactcctgacctcaggtaatccacctgccttggctgggattacaggcatgagccactgtgcccagccccagatattcttaatgcagtttyttttgtgcttgataggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggtatgtaactccagggttgttcagaaaggtactagctaccttttaaagcataacaactcattgaactaagaactttacttttcaaccttgtacgttctgtaccatgaaaaggaattarctgaaatctcctcagtagcttttttttttcatttaattaaattttcattaattttcattaaatacactttaaaaatgcagatacctctagagaagttagaaggttgtcatcaagataaatccattcaatctgcattttctcctaaggaaatgatgcataactgtttttttgttttttttttttttgaagagaggggaggagtcccagacttctttgaaaatctcatgaaagtatgggcactttccctgatgaatgcatataaaccaaggtacctgaaaatatgcatgcagttggaaaaaagcccttctgaactgatccacaaagaggtccttaggtgtaacgtctaataacttgattagagaacagtttttgtcaggggtaaaaggtacataaaatgtgatttttatactccaaacactttctgggataaacatacgtggaaaggatgccttaatagggtatttgagaaaaagactaggaagtgagagattaaagagaaagagatagaaaggtacaggctattgttgcctatttgtggtctataccttgtctttaatctaaaaacctrgaaactactttctctatttctcttccttctctaaatcatgaaacttatttattactatagctcagctagatttttggttcaatagattattttttccatgttgaattaaatatttctaaattaaaaacttttggaacataatctctttatgaggtggggcccatctggtttctaattacagaatttaaagaggcttttgaaagcacagggcaaaaaagtagtagtctctattttattctttcaactatggaaataggtaaataatattttgatgytttcatgtttgggaaagttaatatgcttcagaataacctcatttgtgatgggaatcaacatttttatttagaaaggaaatttagtttcactcatatatgtgatgtgctttagctttttgttacagtgtaagcactctgagacggtctctttccagttaaatgctttccactgcttttttttaataacttaaaaaaaaatgatatatggaggatccaggacttgaaattttgctcatatttatatgactttatctacttttaaaaatatctagcaccaagtaaacattacttttatttttaggattatctaatatgatgtcagatggtgaatttctgagaactagttgcggatctccaaattatgcagcacctgaagtcatctcaggcaggtaataatcagtgaagcataagctttttgtaatcttgtgttcattttgataacatttaattacaatatattctctatggaaggtaagattttaacatggtagaaatggattattcatttatttttccactgttaaagggataatggttatatcaaaaaatgttaaacatttcatttagatgtcattataaatatacttacgaagttttccccattagaaaaataactgaagtagatcctgatttaacatatctttcattttacaaaagtgcagataagagagtaagaatttgctaaatttaagctagtgtcatttatttattagatatagttctttaataataccttgcatattttccaaagtatatagagcattgttttatattttgtgtttggaaaaaygagattttgggggaaaatattgtttcatgaaattacacaagtagagattgtgtagttactcataacttattcattggtacattataaaaatgtttatacagattgcagtggtaaactcaagtctttctacagtgatcaacgtgtgattttaaaagttaacagaatcctataagagaaaatatggttaaagtattattgcaaatagcagataaagaattatcttagtccatttgggctgctataagaaagatacaataaaggtgatagcttataaacaacagaaatgtatttctcacagttctgaagtctgggaagtccaagatcaagatttggtatctggtgagggtctgcttcctaatagactactgtatgctcactgtaacttcacatggtgaaagggacaagggatctctctggggtcgctcttataagggcactaatcccattcatgagaactctgcactagtgacctaatcaccccccttaagtccccacctcctaatactatctccttgggggttaggatttcaacacatgaattttgagaggacataagcattcagtccattgcaaggagtttgaacaatacagcaaatgatgtaaacaatcaccattttttatataaacagattatattcttttcattagaatagtaaagatttactttgttacctcagacccaggtttgagtatggtaatatgctatcatgggaattgtaatgctgtagaaacgtaagagaaaaaaggaataatactataagcataggttatctggatcaaagatgattttagtcatatgagttaggaagtgatgagaatagaaatagtaagtactcaggataatgtgatacaggataaatactgtctacacagtactaattaagtactttaatgttttaaatatctctctctmtatatatatgatatattatatatatatatrtatatattttttgttttgagatagagtctcgctctgtcacctaggctagagtgcagtggcacaatctcagctcactgtaccacctcctgggctcagatgatyctcccacctcagccttctgagtagctgggactaagatgtgcaccaccatccctggctattttttgtatttttagtagaaacagcgtttcaccatgttgcccaggctggcctcaaactcgtagcctcaagcaatccgcccgcctcagcctcccaaagtactaggattacaggtgtgagctaccgtgaccagccttaatattctttaaaggtgtgccaggggtagaaattctattatatgtatacattatatatatgttttctttcttgtaatagttctttgggaaaaagatttaacctatacaccatagtattttttcaagtttgtggtcatctactttgtttccctcaaaaatcaaccacagaaagtattatatgttttaattcgtatgtttcagttaaatgaatttgtgacaaataaaaataccctattcacttggcaggcttgaatagtagttggctagccccattactctctttggggaacaaacactgaatattggggagcagccatggacttcattaaagaccttggaaatgaatatgtactgaatgtagactacctatatatagaagtaggrtacatagagaaaaagtgattcttgcatttcaggtttgtgttgtcatcttttttcttagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataaggtgattyttctttttgtttctgttctgcatattttctcataggaataataatgttaattaaatgattctcccaaagtctcatttcctgccctcaccacctcaccccagtactcatgcttcagccacattgaacttgtccttgtttctcaaacctaacatagattttatgccttcatgtctttgtttatattrttcactttgccttgatgtcttttcttgtttcttttttgacctgatagacttccattcatccattaaagttcatgccaccccttttgtgatttccacacgtgcttccatttctgttttatcaacattttgttcatgcttttattatttaatcctcatcctgtatctagttatttctcagtgtgtcttttttctctcttaaattatgatatcagggtagagagtgtgtcttattcatctttgactacacaatgctaaaaggcctggaaagatggtatgcttagaaagtgtctgaagaaatttcaaatggagaaatagggtgagattttgtattttacatatggttaaagacataaagcataaaaagttttgctaagtttttgaattcaatagctgctagtcagcttactgtgaaggcttttttgtcacttgagaaagtttggaaagtgccattgctgatgcgcctatgaatatgacctttgtatatcccacacctgtgtatagtagcaagatgattcactgcatcctgcctatgacttatcaaggcatgtttyttagaggttttttcttcttacctaagatttcatccgtgtttgtttacaaacatgttcttttgacatctttccagaactctttccccttttcatcattagccagcaaagaatttttttttttttttttttttttttttttttaaggcagggtctcactctgtcgcccaggctggagtgcagtggtgtgatcacagctcactgtaggtagcctcaacctcccaagctgagktgttcctcccaccccaggctcctgagtagctgggactataggcacaagccaccacacccagctaattttttttaatttttttatttttagtagaaatggagttttgccatgttgcccaggctggtcttgaacttctgggctcaagcaatccacccaccttgccctcccaaagtgctgggattacaagtgtgagtcgttgcacccagttccagaaaagactgttttgagacctctgacctttggaatatttaaatgatggctgagatagctgtttatgtgactgctgctgatttcatacaggcaaggactgatgattctttttgcatttatgtatcattttcttttcccagcctttcttcagtgttccaaacctcatgtataacaatgtaaaagtgtaaattagccaccagatttaattataaaaatgaacttagcaggaaaaaaactctttgtgtttatagttctwtagcatatatacttctgttaatgacttttccttagaaaattagacatgctgatatatttgcagctgctcatatcagcatatacatttagaatagtaataggctgggggcagtgtctcatgcctgtaatcccaacactttgcgaggctgagatgggaagattgcttgagcccagaaggtcaagactagcctggtcaacatagtaagcgcccatctatattaaaattttttttttattaaaaaaaaagtcaaatggtaatgattcattgctttaaaacaggtgtttgtatatttatatacttcagaagaaaaatgtaaatatatttactgggaagagttaatttgtacgtaggtagatggcatgaaagtatcattcatctctatactttaatatgataacttgaatctatagttttcatctttttaaatttatgtcatatatatatttacttatctatattcaattttttaatgtttgggaattctcatttttttaattcttttttttttttttttttaaagagatggggtcttgctatgtttaccaggctggtcttgaactcctggcctaaagcagttttcccatcttggcctcccaaagtgctaggattacaggcataagccaccacgcctggccaatgtttgggaattcttgatttgataaaatatagttcaatagggaaaagaattactaatcatggaaaaattacaaaataccaagcattctgctttatggcttaacttatgttattgcattgacttttcatatatagctataaaccattttacaaaccatgaaactgaagctcagaaaggttacatcatgatttatgtatctgtttgcccctattaaattataaattactttaaattagggaccaattattaattcatagcaaaatgcacaaggtckaacacatattaaatgttaagtaaatctgtgtttgttgaaaattacacaactaataaggagcacaatggggctcaacttggaactttacctgaattcaaaacctgtgccatttatactattccaaattgttacatcagttctgtgatatctatcctttcaatctatcatattttatttatctcttatgctactacatacttactgtctcaatattatttttgtacatctattattttcttgtaagatagccattggaagttcggaaatatatcttcatatttatttgcttatttaaccattttcgcttttattcattcaacaaatatttatttcacatctgctctgtgcaaggtcttgtgctaggtgctggtaatatagtggtaaacaagatagatattatcttcatggaaaacacatctttgtgttctccaggtatcttaagcttagtaatagtattaatgttatcatagttaaagtgagcggtctgaagttcaactgagcacaaatcccagtgcatctgtttattagctatgtgcaacttagttacttcccacatatattagaattttggggagcgtagtcatagatcaaaccttgtgaaattgccatttaagtaggtctgaaaatgattgaatatcagaaactgcaaatactcaacttaatataattaaagcttttagaacaatgtctagaacataatattagctattattatttttgagggaatatttgaaaaccttttagctgcacttaaagaaatttgggcatatcatgaggtttctaaaatttgatagtctttataatctaaccttaagtcatatatcaatttcaggtatcaggtagtagtgatagaaaaatataatttctgatgcctgtataatagcccatgtgaagtgaattgcttttgtctcagatgaaccttcataaacatcctagttactgctcactttggtagagttagttcagaaactgactcctgaaaatcaaaagctagaaagatggcttttaaaattgtcagttattacaaacaattatggccatttgactaaattaatgaattagaaatcaaatttagattgtttccttattgttttttaaaattaatttttaaaatataattcacatatcataaatttatccctttagattgtataattcactrgcttttagtgtattcacaaagttccataatcattacggccatctaattccagaactattttatcatccgtgaaagaaactatacacactaatagtcactccccatttccccttcctcctatcccctggcaaccactaatctactttctgtgtttgtgcctgttgtggacatttcatataaatggaatcatacagtatgtggtcttttgtatctggcatctatcatttagcataatgtttacaaagtactttcctactgtagcatgtattagtacttcattttttttgcttgaaaaatattccagtgtatgaatatactacatttagtttatgcattagttaacgaagattgaattgtttctaatttgtggcttttatgactactgtttccatgaacatttacatacacagtttgtatggctatgctttcatttctcttcggtgtatatacctagagtttataattgtcgtatgttgttgctgctrcttctgtttgtttagtgattttcctgatctgattctgtaaaatctgtattcttttttatatatggctactgaaatctctctttggtttgcttaatgatcagctagtgattagataacaatttccttaaatgccctgatctaataagtctcccatcctttgctaatgggctttgtgtgatattggggtatatccttagtgctccaacaggcagttgtaactctgccttagccttcacttcctgcttgtgcagagcctcaaaatctgccagtggtgagaaattatggccctttcaattttttctcaggcaaacacacaactctgcatttgtttctggcctttctgagtcccagaaatatatcagagctttccaaagacccctctggaaattgtgtttcctaatttttccttttaagtgttttggtcagcttttcctttacccagctttcactgctgcttcaggcagttgcgatgttagacagttgccattgatttttgttttttcttttttaacaaatgccctggggagaaggctgtttgcaggagtaagctctgagtcaggtcacataaaaaccaggcttgtgagtggaggtttccagagaactgctagacatgtaaaataatgacagttctctcatggtaagatttttggggagctctaaactattctgctcctctattctccccacctcaatgccccagtgattgttaagctcctgttttctcagctctgtgattatgaggctgttggttttcaaggctgcccaggagctggacaaagggaagcggacttagggcaacttaaaaagccacaaatctcacctttcttattgagattcagccatttttcttgaataaacagtcttcagattgttgcaagcctttggttaatttccagggttctgaaaaaattgattttcacagtttttggttaatttccggtgttctgaaaaagttgattttcacagtttttgctggtattttattgttttatggaataatagattttttgagtttattttgaaagtgcttaacttttctatttgtcattgatatttaaaaaatattagacatgtaacataattttttgccttcttttacttcttttgtagctgggtgtggtggtgtgcacctgtaatcccaggtactcgggaggctgagacaggagaatcacttgaacctgggaggcagaggttgcagtgagccaagattgcgctactgcactccagcctgggtgacagagcgagactccatctcaaaaaaaaatatatatagaaaagatctatctcaagttatttttattgctgaacattaataggtgcttaatattattatatagccaataaacacatgaatgaattattttttgtgtccatactttgtctatttatcatatatgcagcatttattgagcatttactctactaggtagtagggtagagctaaataaggtatggtcactatttcaagaagttgtcgccgggcgcggtggctcacacctgtaatcccagcactttgggaggccgaggcgggtggatcacgaggtcagcgaccatcctggctaacacggtgaaaccccrtctctactaaaaaaatacaacaaaaaattagctgggcatggtggcaggtgcttgtagtcccagctactcgggaggctgaggccggagaatggcgtgaacccaggaagcagagcttgcagtgagtggagattgagctactgcactccagcctgggtgactgagcgagactctgtctcaaaaaaaaaaagaagttgtcagtttactgggcaagattaagaaaaaaatcaacaactaaaagaatgtattgtgatagaaaagtctagtagctgtagaagttttatctttgtacatatcctcagggcctggcacaccagtatttcttacttggactattgcaactagcatcaccatcatcatttttatcttttcttttttttttttttgagatggagttacactcttgttgcccaggctggagtgcaatggcacgatctcggctcaccgcaacctccgcctcccaggttcaagtgattctcctgcctcagcctccctagtagctgggattataggcatgtgccaccacgcccggctaattttgtatttttagtagagacggtgtttctccatgttggtcaggcyggtctcgaactcccgacctcaggtgatccgccygcctcggcctcccaaagtgctgggattacaggcrtgagccacggcgcccagcatcattkttatcttttcaattcattttctataccacaaacaaaatgatctttacagaatgataactaggttatgctaccctgtctctttaaaatccttcaatgattttcatcaaccaccagttcaaatcatgagatttcctttttatggcctacaattcttagaaatatctgatttcatttggtactccatctcataactcattcttctttcatgatgttgagctcattccagttcctagagcacagcataactctttcttgtctcatggtctttgcacatattgtttcttttgctgggaatatctgttctgcaactctttgcatagctgacttcagatcattctagtgtcagcttaaatattactcagagtggcttccctgatcacctgcctctcattctaaattatatactctcattttactctatgcaatttctcttgcaatctttatcacaggatttgcatatttgtatatttgtaactatattttatgtatatttgtttaatctctgtgcagctaaaatataatctttgggaggaatggttctttttgtccatagtatgtcctcagtaaatattcaaaaataaattaatcagtgaatagaagacattcagtcagaatatatcttcatctgaacttaggggatgcccagttctaccaggtaataatgcctaaacaatctcgaaggagtagtttgtgttagatgaaaatggtttggtattctaggataacaatagtaacatcaagcrcaaaggcccagaagtgtgagaaaataaggcttaggagagcagttctcagactttttgattttaaaatcttgtaactcttaaaaattattgaggacctcaagggggattttttaaaatgtaggctattatctatcaatatttactacattagaattaaaactgagaaattaagaaaatatgtaatttacttaaaaataactatgttaaataatacatctttcatgaaaaataaccatattttccaaaaaaaattgtgagaagaattactttatatcaaagacagctaggttctcataccttcttcattcaatctgttgcactattttgtattagctgaagtgtggttttcataccttcttcattcagtctgttgcattattttgtattagttgaagtgtgtaaagaaggtctgacctcactcagataagtggttggaaaagaaaaaaagcatatttattattattaacaccaactttatcagaaagtctttaagtattgagaagctgttaaactcacacaaataatacaaaatttgaaatttttgcttgaaagcttgaattttatcattggcaacaaatattgctggttgttttccttaaagcgatgggcttgcktttttcrtttttgagaaaatgttgtccaaatgccaagtcttaataaccatagttattcaagggtggtgggtarttaacttgctcaggatcacatagctagtaagtggcagagctrggtctagagaccagatcttttgattatattctattatattgccctatgtctaaattatttggacttgccaaaccatgtcttacaataatgtattgtggtgtttttcctagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtaggaaattataatgtaataagatcatttgtagaagccatttttctatattataagctgctctgagctcctgagttgagyattaagcccaactttttctagtaatatgctatgcacattaaaaacaaaacaaataacctctataaggatgaaaagtggttgatactgggaaccaacatattttgaattatagaagtgttcttggtcaagaaaaaagtaatcaactagaaatcatctgagaaaatagcttaccagtttcagcatgcatcatagcaatgaaaaatcatgagtgtcttcaaagatagtatgtttttactttctctttttttttttagggaggttatttttcttttctcttttttttaggtgacagaggcaggtggctgtaatagctagtggttgatacaaattatatcatcaggacatatttattcagtcaataaacacttttctccaagttgtgatattctcttttatttggctagtgcttttaatacttagagtacattttccttactctcagcccacagtttgcttttcttaaaaattagtgctcaatttcatttgagttctatttgaatatatgtgtggggaggggcattttttcttttcagatatgcctttcactcttgttcttttcttgaggattgtgaacttttaaaggaagaagaaaaatgtgcaaacttaccacataaatatgcatttgacgtgttcaaataaatcagtcattttcattttattatttgtacatgaaatgaatattttcttaaaatcatttaaaaaacagatctctctgttttggagcagtcttatttagttaaaaaagagacgttaacatttttaaaattctgtactgaaacattttgaaattagtaccacagatgttttgaaaacccaaagcagtgttgtttttttgtttattttttgttgttgttgttgtttgtttttttgagacagggtctcactctgttgcccaggctggagtgcagtggcgcgatcttggctcactgcaacccagggtcaggctatcctctcacctcagcctccctagtagctgggactacaggcgcctgccaccacactcggctgattttttttgtatgtttttgtagagatggggtttcaccatgttgcccaggctggtctcaagctccagggctcaggcggtccacccaccttggcctcccaaagtgttggaattacaggcgtgagccactgtgcctggtcctctttgttccttctactccataatcatccatgaacatgttcaggcagagactggacaaccaaattagaattgatgttttagagttgatgcttatctagagtgaaagctggaccctatgtaatctctgggttctctttaagtttttcctttatctttcacttttttcttcagtaccccaaatttattcaagtagcttttcctttaaatcttaattgccatacagtactgcttagtggggattaaataaatactaaagtgaactaccagtaatataaaaaaattattcgtattcctttcctacctcacccctattaattatttgttttgactttttttgcataaaaaggtagatattttgtagtttattatttttattgatttttcactttaggtagtgaatgcataccatcttcgtgtaagaagaaaaaatccagtgactggcaattacgtgaaaatgagcttacaactttacctggttgataacaggagctatcttttggactttaaaagcattgatggtaaggaagctatgcatgcatgagctctgagaagataaaacttggcactagttgaccagatgttaaaatcatctcgaagacatccggtgggtaggtcctgcactggtttttaagcaatctagacttaaccaaaatgtaagtgaagtgaaaaggatgaaagacatgttgaatacctcttacctggcatctttccacaagaagtatctccgtggcgtaaaagaatcatttgaagtgttggccgtggagcacaagtaaggaacaacagggaagcaggttttacttttcaaaattaactgacttgtcagattctttgtcatatttctccattcatattttattagttagtattatagtgtctaaactttctccttcatcacctttcctcatcctgggtggccagggcgaccaaataggtctccattgggatttgggttggatttaggtacccatggcaatcaaggagccaaaggcgtcagggaaaattgtcatgtccaagaacttagtgtgtgccaagaattaaacttgggtaaaccaaatctgattattcatttcagaggcccaagtgggataaaaccagaataaactaagggtcaggtgctggatggaacaagaatggaacggagtttagagttagggaagttgttttaaacgaagcatttaaattttactcttgaactaccatcaactatgtatggtagtgtttatatggatcccagacctrtttcatcgaaattacatgttgttgttattaaaacgcagatccctgggaaccactccagacctattaaatcagaatttctggagattggtcctgggaatcgtagaaaatgcagttttaacaagatttctctcactttgccctccacctccccaaggcaatatatgatggtgacttttgtttttaccttagtgattttttttgttgatatgctagaagaaaataagttgtcaaggatatgctttcttcacatgcagagatatcagtttgattccaatatcaatgccgattactccaatttgagcaggacttaggggccacattttgactgtgtgcaagtcttgtgattggtagcgatgtttgttatgattgttggaaggaagaagactgtgtttctacaacacagaaacatgacattcattattaagttgcccttgctcagatgtgtttayttaatattctgaatatcataaattcataggaagggcttgggcatatatactttccatataaattgctcttctttggtccatttcagatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctrtgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacacaaactatagcagggtagataatagtttattgattatattttgttttagtaaaagtatttaattttaaattctgtgtaatttatctaatttgtatttattcatttgttatttttatgttgtaattaacacttatttacctggattaccctaaaaaaattaagctcttgaaaacaaaaaaatgacattaccttgacaggcttctctttgccaaaagtaatgtatgttctgccaagaagcaaatgagaatgttagactaagtttctcctgtgttagtggaaaacaagtgtgtctatctttaaatattctttgaatcaggagtttgcgttgtgtcacatcatatggctttgcagatcttttaaaaactgatgttaaataacttataagtccaacttcttaatatcaagataaatgaatagttcaccaatttgggaaggagggcgggttgcaatttgagatagtttaaggtttaattattgaaagactgccatcttgtggccccaaaaggtaatttttacatgattatttgtatagtgataagcagtcctgctgtgttagcctggtccattatagatatggcatagttttgggttctctaaatgggtccatacctcttttgggaaaaaacagggccacctcataatatttgcctgattatgaatggaattaccttagaaataaggaactaatcagattacttaaccccaatgacaaaatccacaaaaattttgaaggcagagaaacagaaggaatccagtgatgttttagctccattagtctaataggtcagatattaaaaaattgttcatatcaaaattaccttatatggattattgccatgttttttgagagttaattatttactgttttctaattcttgccagtatttatgaacagctgtagcttgatatttacctactgaattttaggagaactaatggtcacagtttgggttcttttatgtgtatgtttttaaaacagctattttgtgaatctaggtggttggtttttagaagatttcaggagatgcagtccagcacaattagagctggaacattgttacagcaggctttttgttgctcatgggcagatagagggaaagaatcagttgttagccccaaatttccacatttcagtgttgtaaactctgaatgtgataggtagatgtgggctaagaataatttcctccagtgaagacacgggagaagagcttctattatgaggttatagataaggccttagttatatcatggaaatggactccatgtagttctagaactgcatttcccaaagtatatcctgtgagatgctccacagaaaaaatgattgcatggactaagtttgaaaaatgttgcatgctactcttcccctcgaagatgacagtggatgtcagcattaaagactttgacaggtctttctgtgaaaaaaagaaagccacataactttgttgaactttgcccaaattaatttttcattttaaaaaacttaatagcccatgaaaagcaaatttgggaaatacattttttaggaaaatactgtcccagaatgccataattagggtagttaataattaacacttccatttctcttactggttgttgggagaatctgattgaaaattagaattactttgttttaacttgcagacatgttcatcgtgagtgaatgctggattaaatagaattttctgtgtctgcaacttgtttcatgacaccttggttttcttaatcatcttgtattattatttgagtgcaacattattcttatgcatgggtgactgaaaaacctgaaacaagattacttgttaaaaaaaagtctaagagactaatgactcatgcttatggctcagtgggtaatgaatcagtgtcactgattcttacttttaaaatgtgtagtcagtgaacattttctaaatacttttctttgggataccatatgaagatctaattccttatgtttcagtgtaggaacagctaccttctcaaatagaatatgcagggagggaagtaggcaaaccatttacaagttgggtttttgttttgattaacctgttaagagacacttttgtaatctctagtgtttacattcctttatactagctatctataaagagaatccagaaggctaaattaatcagaaataattatatttctatgtcagggtattggctatatgtagcatgaacaattctccattttctgcaaatgggtttttcaggacagttttataattctgagtttgctttttcttattccctagacagtttgtactcagggaatacaaattgatttttactgttaaatgagacatagtttagaaaaaatcataagcaactattgtagatttttgatctgtttggatttatctgtagcattgaataatgtgcagtgtactgagttaatgtaggcacctcactttggatttataaaatgtaaaaacctggaacatgcctgccacagacaccactttgtctattcaccgggtactaatttacatcctattaatggttgtaaaagctgagtgtctaaatgctagacatgttcacaattttgtctgtttttgtttatttgtttttaagacccaaaacttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacaataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaacactaaattgtgccttctcccttaaattataagaagagtaatagtaaaaacttgtttaaactatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaataagtatctttgatactgataggatgagtatcttgattttt

SEQ ID NO: 12544 - DNA, 165223 bp, Homo sapiens
  misc_feature (1)...(165223): n = A,T,C or G, or insertion/deletion polymorphism (see Tables 1-2)
tcactgaagccttgacctcacagggtgaatgtgatcctcctacctcagtgtctcaagtagccgagaccacaggcgcccgaaaccacaccagattaagtttttttattttttgtagacaaggggtttcaccatgttgtccaagctggtttggaactcctgggctcaagtgacccactcaagtgcggtaagccaccatgcccggccccaccataattaaaaagtggtttttttttttttaaagtgggggttacagcatgttaaaaagtgacttgggccgggtgtggtggctcacgcctgtaatcccagcactttgtgaggccgaggcgggcggatgacgaggtcaagagatccagaccatcctggccaacatggtgaaacctcgtttctactaaaaatacaaaaattagctgggtatggtggtgcacgcctgtagtcccacctactcaggaggctgaggcagaagaatcacttgaacccaggaggcggaggttacagtgagccaagatcctgcaactgcactccagcctagggcaacagagcaagacagtgtctcaaaaaaaaaagtgacttgaaggtgtttctctgccaagtcatccctgccccagggatataaggtttaaagttaaggtagcaaggtgtctccacctaactccaactacccaagagtctcaaaaccttccccttcctgctcagtgttcttttatttccttttcaagaaatgtgaactgctatagccagaaacatgttccttcagcagtgtttgcagatggatctcatgaaagttcagaaaagggtggttcacttcaagcgggagacagtggagttcctccactataaggcgaagtttgcaaagtcccactagtttgctctgagaacatgagacccttaacctctgggtcatgtgtttgaggtccattttggtgcaggcatcacctgatgctaaaaaaggatcattgtttagtgtggggttcttaacttgggatgcttacatccccttcccctacctcaagaggtccttgggtagaattcaatgggatccatgaatatgaatgacaaaataaacaaaacaatctttattttcactaacatctaactgaaatttagcacctccttttattataaatgtaggaagcaaaccacagtattattactactactgctactattactactactacctaggaatttatcatcaataaaaattatattttcatatcctattatagttatctcaaaatactgagattgcagacgtctcaaaacatcatttatactcaccactactttgaagtaaggcagtattaaatcctccacaaatcttcctatgtcagtaaagaagcattatcttgatatatcacaaatctggttttttaatattttgattatacttcaatataattttgcttcctttgtaatggtttgtattttgttttattcacttaaaaataaaaatactctgcccggcacgatggctcacacttgtaatcccagcactttgggaggcaaggccgaggcaggcagatcgcttgagcccatgagttcgagatcagcctgggcaacttggtgaaaccccatctctacaaaaaatataaaacaattagccaggcatggtggcatgcacctgtagaccccagctacttaggaggctgaggtgggagaatcaactgaacctggggagactgaggctgcagtaagccacgatcgcgctactgtgctgcagtctgggcaacagagtaagaccatgtctcaaatttttaaaaatatatattctgagaaggggctccacagtttgcacaaatgagtagcaaaggagccgtgacaaaagaatccctgtaacttgacaacaacaacaacaacaaataccctccttgctcataagttcccacaaaggtatttattttattttgcttagggtggtgataaatcatccttcaaaacatgcacacattcatttgtgagcttaaactctcctcaatttctgatgctggtcatttgcagatcattagacccagaagtgatttttagagaccaggaatagtttcaactaaagaattcgttgggattctcttggacttttcagtaacatgggccaataaaattcctttttcacttggagtaatccaagtaaggtttttgtcatttgtacccaattgggctctgactaacacggaacccctctatattggttgaggctgttgaggattagaggaaggtgggagaccatctgggtggctcatatctgcatcacgttggattgtgtcctaataccaacaaaacattgataacacacctatcattcgaacagtttccaagtgaggtacttgtaaatatgttgtttcatctaatcctcacaacaggctcttcaggtatgtattattcccaacctttgtggatgaaacaaaaaaggactagaaatttgtatttgtatctaatctaaactccctcaatttgtattcattctgctaagaattcctcctaccagacaaacccactctgggaactccaagtcattctttaagactcaattcggctaccacccctctatggagcctccctcccttcatcttcccctcccaagtacagcccctcaggttaaagacacctgcacatccctccatcacaacacctgacacattgtgctgtctgcttactcctgtataccacccctcccagactatgtctttcccaagggcaaaaatattttgtatctcaagtacaatgtctgaggcaaagcaagcacataataaatgtttgatgtgaataaatttattggtcaccagctacatgctggctttaaatcaagtgctagaatacaaaagtgactcacagttcagagcaaataaacaagaattcattgaatgctacatagtcctaggcattgcagatacaggtaaaacacaggtctgacttaaagaagcttactctctagttggaggccgttgacatgtaaacggaaaatttcactagaatttaatatatatattctagaattatctatgggaaaggagcacttaataggtggagaagagtggtagggatggggtgtcaagaaaggtttctgaagatgccatctggactgaatcatatcacaagagaaagagtagcatatttaaatcccgagtgagtagagagagtgaacaaaatcagagaacaacctgagcgtagaaacctagggaataggccaggcgcagtggctcacgcctgtaatcccagcaccttgggaggccgaggagggtggatcacctgagatcagaagttcgagaccagcctggccaagatggtgaaacctcatctctactaaaaatataaaaattagccaggtgtggtggtgcatgcctgtcatcccagctactcaggaggctaaggcaggcgaattgcttgaacctgggaggcagaggttgcagtgagctgattgcgccactgcactccagcctaggcgacagagtaagactccgtctcaaaaaaaaaaaaaaaaaaaaaagaagaagaaaaaagaaagaaagaaagaagaaagaaacctaggggatagtcaatgtgcagcccatgaaggaacttccaaaaagtgtgagtagaatcaggagagtaagcaaggccaagggaggaagaactttacaagagtacaaaatcagcactgccaaatgcagcagaaaggccaaataagattagaccagagtgtattccatgaatttagcaactggcaagtccctagtaactttggcaagagcaattctactggagtagtggagggggcagaagcagtgaaatggcgagtaaaccggaggtgagaatgagaaatagtgaatgcagaaagcttttacaaaggttggctgagagaagagcaatagggcaatggctaaagggtgatgaagttttaagaacttttttttttagtcttaactaattctttccttcccaccccacactactcccaaatggacaaatttccatctgggcacctaaaattcccactctgctgtaagctccttaaggacaactcttgggtctgcatcatccttttagtccacacatttctctgaacatggtattcaacaggatctgttgaatgactgactgaataaatgaatgaatgaatgaaatgcaaattcagcacaggtggtaacagggaaatgatctactgggatacagctattgtctgttcttctttcatgggaatttgcgcttgtctgaaaattcaggaccacaaagtaaacaaatccaggcaatcttctctcactgatgcttataaatgtttggcccaggaaggcagatgtagatagagcccagtttagattttggagcctggaaaacagatcttcaagatcaagggctgttcattcttcattctcaggagctgttcaagttcttgggattggcagatctatattggactcttagtgctgccattatagtttttgtaaattatttaacctacctaagcttcagcgtcctcgttggcaacttgaagatacccataatagcatctaccttatagggctgcaggaggataaatgagacccagaaatgaagcgcttaccatagtgcttggcaaatagtactcaatgtcaacaaaataagataaataaagtactattaaaatgaataaaaatatccatttcaggggatgcgttccagaagaattgggcataagtcaaatctcacttaaaatatagaaagaaaacttggtcctcagaactccttagaaatgttttacaaaagtaagtgaataattagccccaacttatcaatccactttttttttcttttttttttttttttgagacggagtctcgctctgtcgccgaggctagagtgcagtggcgggatctcagctcactgcaagctccgcctcccgggttcacgccattctcctgcctcagcctcccgagtagctgagactacaggcgcccgccaccacgcctggctaattttttttttttttttttttttttggattttttagtagagacgtggtttcaccgtgttagccagaatgggctcgatctcctgacctcaggtgatccaccaccctcagcctcccaaagtgctgggattacaggcgtgagccaccatgcccggccccacatttccatatatcagatttactgaaaaactttttttttttaatttcccctatccgagtggacccgcccaatcaagtcagttaactttccttggccgggggcggaaccaaggtgttgcggtaatttcctggcctgccacgactgcttgcttgcgtaagggcgtctttgggtatgttgccattctaatgaaaattcagctccagccccgtcggtggaacagatcccgggcaccactgggcagagactagatgtttcaaacgcctgccccccagcaagcaggccgcgcaaagggcaggagttcggaaccaaggcaaactagggggcggggagaaaagattggcacccgcctgctgagatctgccaacctgacgccccagggggatgggtgctctcgccacccttgccccacagtgtcgggctccgagccagcgggaagcgccagtcctagccgagaatagcagaggagcgggcgggatgcgagggggctctgggcgaggcggcggcagtctaacctttcctgcttaaggcgacagcactctgcgccgtaatcgtatcttccaaggctgcaaggttagggcaaatgtcagacgcctcgggaggggcgggggacggggagagggaaggcagcggctagagacggagagtcgggcgtgaccttgggaggctccgcgcccgcacctccccgcgccccgggagtcaggcgagcaggtctgccgggtcccgtggccactttccccagcccggcgacctccgtcgggcctccaggccagaagagcgagcgcgaaggagagggaggagcgggaggtggaaaccgaggcggcagcgcgcggaagcggccggccccgagcgagggagggcgccgcgggccgcacgtcgcacacgcgccagggtgcacagcggcgcggggccgcgcatcccttaccccgttggcggcagcgatgcgagcgatgagctggatggcctccttcatgtagaaccggccgtccccgcccaccaccagcgtggcctcctgccgctgcgccggctccacggtggagatgatactctggatgaagttctccgcgtagttggcgctgctctggaacaccttcacccgcttccgcagcccgctcgtgcccggcttctggtcctggtacgcctgggtcttaactgtcacgatcttcaccatggtggcgacttgctgccgggggtcagagcggcggacttggctggcggaggggcggccggctgaggctgcagctgctctggggtgagggcacggcgggtgggggctacgccgcactctaggccggcgtttggccctcctccttaaagggacaggggacagggccctccctccgcgccagcccacctcctggcaggtccggcgggaggggaaaggggagcgccggtctctaggcctcctgtgaaatgggtggagccttactgatttactctccccttcggaatcctatccactgtaaaaagaggcccgcaactcctcctctaagtgttggggcagaggttggggtaggaacccggtcatagggcaaggacgtgaggcagggtggaaaaaagtacagggtagaatgatttccagtggtttggcgaatgcatcgtgtgtaaatagctttctggaaacctgttgggagggtcagaagtgccagccccagctcgatttcatgagtcgtaattctttctatttctccctaaatgtgagggcatttgagttccgtaaaggagtcgactccaaatgtttcctgctgcaccacacacttgactaccattggtgacggtgacttagctatgacttgctgagtgtagcgtttctaaaccttactaaactctgggttttatttttcccctttttatgcttacaaaactgaaattcaaagaataaaatgccttgtctcattgccacacagctaagtccatgcgggaggccaattcaggtggtctggctccaaaaccagggctcttcccatgatttgcccgctgtgacaccaggttggcaactaggaaatgtacaagcaggacttgacaaatgtaggagcaaatatatggtaaggataagtatgaacaccatcaaaattagccagttactcatgtaatagaaataaagtgaggagatcaacaaacaaggactgacatggctggaaaagtttcacgggggatagcaaggtcaaccaaggggatttgattattaagtaggaatcttyagtctttcttgcttttcggtttagtatctcccttaatttgatgagagtgrttgtctcctctgttcaagaaacctgtcattttggtaaagtggcaaaaaacttggctttacaagrtgtgtgctcttgggaaagttagttaatgtccgtgggcatcaatttccttactgtaaaataaacatatcacctactttggaatatttttgcaagatttaatggggttttgtatgtcagaaattctcagtcatggatacacagtagaatcctactgtgacccatgctcacagtagaattacttgaggtggtttctaaatgacccagtccaaacaaattcaatcataatcagctgttagaagtaaatcatctagcctggtgcctgaaacatagaggccttcaaaaatattagctccccttccccaattccaaaaccagagcatatcattcacctgtgaattatattcttttggtagttaattggtatgtcttgatcaagcagggaggcgaacagacccataagagtgcagactctcacaaaccaagtgttgatatacatgctcatatagtacatgctatgtagatacagtgtgttgatgtagtcactatagatgagtttcggtggcaaatattatgtgaaaacggaaccctggactgctagtaatgagttctaatatttgcacaggagtttacagagcagtgtaatcttgtgaattaaataatataatcaagcccattttatagacgagagaattgaggattggatggtgaatgtaatcaaggttatctaactccacaaaatgaaaatatagcatagattcactgagccttcaaaatacctaccttagagttgtatggtttagatagwsaatatacagctcctaccacagtgctaataagtaagtcatcaataaatgataacttgtaaagtcacgggcccaaattcagatctcatgccctttctatattcttcagtatctttggaaatatgatggagcttttcatttaagaggaattgatctatacttctctcaccccagaagttgtaacaattagctttaactgcataacacaccagtctaaatctgagtggcttaagacaacccccattcatgattatagttcatgattctatgagttaactggcagttctgctgttctggacagggttactgtggccccttatacagacctaacatgatccccatgttccttgcctcctgataatcatgcctttatgcaatccccttgtattacagattgagtatcccttatccgaaatgtttggtaccagaaatgtttcagattttagattgttccggattttggaatgtttgcattacaatggttgtgcatcccaaatccaaaaatcccaaattcagaatgttccaatgagcacttcctttgagtgtcatgttggcactcaaaaagttttggattttggagcattttgggtttgggatttttggatttgggatactcaacccgtacttttctactgctgtatgacaaattaccacaaactcaacagctgaaaacaacacccatttatgatgtcacaattctatagataagaagtcccaattctatagatcaaaaggtttggccaggttcaatcctggtaatcacggatatataacagcttataaacatcaaggagaaagtattttgaccttcattamattctttttaaggcaagcatacctgtttaaactgatttgtctatagccagttggtttaatttcattgaattcttcccagagcctcaagataagaacccacccaagcttggtgcgttcttatctggagcctctgggaagaacaccttgatttgaagtcaagagccaagctggcttcttatctggaggctctgggaagaatttctttcaagtgttaaagataaataaaaatagaggctccagtttagatattttaagtccaaccacccatagccaggtagccaaaacttaagtcatccttatttccctgaaacacttgctctagacataaacaaaacacaaaatgtccttgacagtgtgagtcaatgaaattaaaccaatcagctatagacaaatcagcttaacagctctactcgccttaaaaagaatgtaacgaaggtcaaaatacttcttcctcaatgtttataagctgtactgtaactgctgtgagctgggcttcttgccacttttggttagatgtcttccagtttgtaaactgttctttgtatgcatgctaaacttttaaaaatttttaaagtttgatctgattttaacacagcgcattcagattgctggcaggatctatttccttgcagttgtaggattgaggtccccatttcttagattagacctacctggataatctccctttgtaacgtgttcataggagtaatgtatcatcgtattcacaggttctacccacgttcaaaaattgacttgcagagatttccaagttgtagtatttatgaaaagcaagagaaggagtcttattcccctgtgggtagcactgaaatcgggaaagaagccattggaaatataccaagatatgcaacaatgattaccactgagttgcaagatagggcaatgtttattttctttatattttatctggattttccaggttttctatagggaatttgtattatttttaaaatgataagtacatattatgtattttccttttctttgaaataccttttaagtggtaatccttacttttttttttttttttttttttttggagacagtctcactccatcacccaggctggagtgcagtggcacgatcttggctcacttccacctccacctctggggttcaagcaatgctcgtgtctcagcctcccaagtagttggaattacaggcacatgccactatgcccagctaatttttgtatttttagtagagatggcgtttcgccatgttggccatgctggtctggaactcctgacctcaagtgatctgccttcctcggcctcccaaagtgctgcaattacagacatgagccgccacacccggccctcattatttcattaatgaattattctttaccatttagatgtattcgttcgtgtattgattcattaactctataaatatgttttgaacttgtactaaatgacagctctttgaaaggtgtttgatgaataagacaaaatagtctcggccgggcgcggtggctcacgcctataatcctagcactttgggaggccaaggtgggcggatcatgaggtcaggagatcgagatcatcctggctaacagggtaaaaacccatctctactaaaaatacaaaaaattagccaggtgtcgtggcaggtgcctgtagtcccagctactcaggaggctgaggcaggaggatggcgtgaacccgggaggcggakcttgcagtgagccaggatcgcaccactgcactccagcctgggcaacagagcgagactccgtctcaaaaaaaaaaaaaaagcaaaatagtctctggtctcacagatcttgcaatatgttgcaggagacagatactgaataataaatcataattgtgataagtgcaacaaagaagtataggtgctgttagattgtaaatagaaggatctatcattggagagagtcatggacaatatcctggagaaagtgctatgtaagctgagggataaaacaatgagtaatagtacctggccaggtgaaaagagaggaggagcatttcattccagaaagaacgttaagggaagtttaaagtaagaaggaatctagtgtcatcaataacttgaaaaaagacagttagtgtaactggagtataaaaacctcggggtggaatggtaggtctgatcatattgggccttgtaggggatgtcaggtgttgagatctttatcataacagcagtgaacaaacaaaagcattttgttttcattgtggcaagacatacgtaatgaaatttaccattttaatgatttttaagtgtacattcagtggcactaagtacattcacattgttgtgcaaccattgtaccatccatctccagaacattttcatcttcgcaaactgaaactctgtacccatgaaacagtaactccccattccctcctccctcctacccctgaaaaccactattctgtctctatgaattttactattctcaagtacaatcatatttatccttcatttgcattccaattgcaatgatttaaagaaatgtatttactataggatagcaatctttgatgactgcaacaaataatcaatggtatgtatgtgaaatttataataaaaaagatgtatggagtttataatgaaaatactggatggtgaagtgggtgatatagtggcattaacatttaacagttattagttacatggcttatatagaaaccaattatcaaagtgagaaatattgaaaagtaattcattaacaacatatagacaaagccttagcaggcacctatttggcatacaataaaagcatgtatcatgttattgttaaaaacaaaacagctctatatctatgtatcctcatcttcctgtctggtggtgtcaagtaatggtggaataatctatattgaggaatattgaggatgtctmcagtttaggactagaatgtcctaaactagtctctaactagagactagtctctcagttaacagagctctaatagagtaagtcagttgtaaataatcttctataagaatgtacagttatttgtaactggaaaataattgacaattccatatcaacccaaattaatgctgaacaatattgcaaatgtcattttagttcatttatgcagtctaaatcataggttcttcttgactgcagattcagtttattaaatcctgatctatttgtaatttgctgaaatgactagttcctacatatggaagcaatatgaaaccgatgtccgtttgtatccataagttattcaggtgtttaaaacttttacttgaataaaagttaatagatatctgcatgctgtgattctgaagtttgttcctgtgccaaaataataatagtttctgaattcatgtttcagtgtcaagtggttattcatgaggctatgtgtgaaaaggattgatatatgtgataaattggactttttccttagaattcatttttggaatcttctataaaggatatcagtctgaattaatttatatgaatatttgatatgcaaatattaatatttcaaatggcaaaagataagatttttaaaaatacagattgtgaaggacatttttcaagagataatgaatgtcttcatttttccatttcatcagtattcttgattccttgttagatgctgtggtaggttaaataatggctcctaaaagttatacatttcctaatccccagaatctgtgagtgttaccttatatggcataaatgagtttgcagatataattaagaatcttgagatggaaagattatcctggattgtccaagagggctctaaatgcaattacaagtgtccttagaagacagagaaagggggacatttgactgcaaaagaggagaaggccaaggaggcagattggagtgatgtagtcacgagccaaggaatgctggcagacaccaaaagctggatgagacaaaaaatgcagtctcctttaaaactttccaaggaagcaccaccctgtcgtcaccttgattttggcccagttatactgattttgaaattctggcctccagaactgtgagaaaataaatttctgttgttttaagctaccaagtttgtggtaatttgttacagcacttatagaaaactaatacagattgatatggtttggctgtgtccccaccctaatmtcatcttgtagttcccataatccccacatgtcatgggagggacctggtgggaggtaattgaatcataggggcagttaaccccatgctgctgttcttgtgatagtgagtgagttctcacaagacctgatggttttataaggggcttcccccttctgctgggcactcattctctctcttgccgccctgtgaaaaggtgccttctgccatgattttaagtttcctgaggcctccccagccatgcagaactgtgagtcaattaaacctattttctttatgawttacccagtttcaggtatttcttcatagcagcatgagaacagactaatacacagatgctttaattttatggagggctatgagccacaaaacttatggcttgatcctctggaggcctaaagcatgatttcaggtgacagcaagagacagaataaggaaaaaaaaaaaaaaaggctatcctaaggctctacaatcaataaacaccagagaaatatatatcaagtgtagcacgagtgaaggaaggaatcaagaaaatcacggaggtaaatatctccaaattattatcttgcttaaattatctgaaaaactaaggtcaaaaatgtttttttccttgaattgtctaggaaacatagttctttgtttattcactatgtagaattgctgcagtgtactgggagtgttctgtatgccaccttgagattctgaacgcagtctatcagaactagtttagaattggctggtattagcaatttttcctcatgacagaactgtttttcttttttcccttgatatcacttccctggatatgattcttaggttctgttatttttcttaattttgaaaccttctttgaaatacttttattcataccttcacttactctccctttcacccatctgttccttttcaaaccacctatcaaatttttactaagcacacagtacaggatagtcagttaggtcccagattagccaaccaaaataagatccctgcactccagaacattaaaatagggaaatctagacatgtacacaaattaataaaatatacraagtataagctacaaaaaggtactgatttttaaagctaatattaaaaagcaagatcttaataatctaagcttctaccttaagaaactaggaaaagaacaagtaatcccagggtaagcagaaagaaggaatgaataaaggtaagagcagaaatcaacaaaattaaaaacaaaaaaagagaaaatcaataaaactaaataaaatcaataaaacttttctttgaaaagatcaataaaaatgacaaacctccagcaagaccaacagagaagacacattttattaatatcagaaatgaaaaagggatatcactacagactgcattgacaattttaaaaaattctatgcacataaatttgacaacttagataaaatggaccaaatgctcaaaaactacaaactaccaaaactcaaccaagaataggtaaactgaatatcctgtagctgttaaagaaattgaatttgtattaaaaaaaaaaaaacctcttccaaaataaatcttcatgcctagatgtttctaatgagaaattcaagtgaacatttaaagaaataacaccaattttacagtcttttccagaaaacgagaaagcattcccaactcatcttatgaggccagaattactctgatacccaaacaagacaaagacatttccaattaagaaaactacagaccaacatccattttatgcagtcacaaaaatgctcaacaatgtacagttgaccctgaaataatatgggggttatgaatgccaaccacccccacaagtggaaaatctatccataacttttgactccccccaaacttaactactaatagcctatgttgaccagaagccttatggaacataaacaataaagttagctagagaaaggaaaatgttatttgttaccataagagaacatatatttactgttcattaagtgaaagtggatcatcataagtcttcatcctcattatctccatgttgaatagaaggtggaagaagagaagttggtcttgctgtctcaagagtagcagaagcagaagaggcaggcacacttggtgtaacttggaaatacactgtaatttttttcttttttcaagacaagatcttgctccattgcccaggctggattgyggtggtgcaatcatagctcactgcagcctcgaactcctgggctcaagtgatcctctggcctcagcctcatgagtagccgggactacaggtgtgtgccaccatgcccagctaattttattttttgtagagacaatgtcttaccatgttgcccaggctgatcttgaactcctgtcctcaagcaatccttccacctcagcctcccaaagtgctgagatataggcatgagccaccacacccggctacactgtaatttttgtctgacttttttgctttctcatttctctaaaaatgtttctatacagtacaatccatcttccactgtttgctttagtttccatgttgcaaaagaagtcaaaagtgatcttgaataatcagaacccttatgccagactgtctcatgtcattttgtttcctggcactgcttcttctatgtcttcttccacatcatttggcactggttcagaatcactcaactctctcctgttgtcttaactcctctggtgtggtgtcttgaatttctccaagatccatatcttaaaacctttcacctcccactttttttttttttttttttttggccatatccacgtctttcatttctttgattaggtctgtcataaattctgtgaaatgatgcacaacatctggacacagttttctccatcaggaatttattgtttcaggtttgatgactttcatggctttttctgtagcataatcaatggtattatctttatagacttttatgatgtccttttgttattgttgttttaatctttcagtcttttatttttatatagttttcttttctaaaaggccatctcggcttcatatcatggtttctctctattgggggttctcatccatagcgttgacattcctttccacagagtacctcccacgtgaaatgagacttaaaggccctcatgacctccaatctataggttgaattaggaaccttgttttggggagcaagtagacctcattgacaccttcagtgttgaatcatggggttccgtgtggccagggacattgtgccagatcaaaaaaactgtaaaaggtggtcgcttactggcaaagtacttcctgacttcagcgacaaagcattgatggaaccaatctagaaaaagggttctcattgtccagaccttcttgttgtacaaccaaaagactggcagctggtgtttatcttttcccttcaaggctgcggagggtagggcattgaagggggagagtttagcacctttatagataagggcaatcttgatcataaatgtgactgcattcataaaatggtagagtttgttatcccttcctgccttaaatcctggtgcttgcttcccttacttactaataaatgtcttctgtggcatgtttttccagaatagggcacattagtctgcattaaaaacctgttcaggcagatatcattcctcctcaatgattttcttaatagtatctgagaactcatctgatccttctttgctggcagaagctgcttctcctgttatcttgacactttttaagtcaaacctctttcaaaaattatcaaaccatcctttgctggcactaaacttttgagcttaatatccttaaacttccttttgcatggctgggtgcggtggctcacgcctgtaatcccagcactttgggaggccgaggtgggtggattacctgaggtcagaagttcgagaccagcctggccaacatggtgaaaccccatctttaccaagaatacaaaaattagctgggcatggtggcatacacccgtagtcccagctactcgagaggctgaggcagaattgcttaaacccagaaggcagaggttgcagtgagctgagatggcaccactgcattccagcctgggaggcagagcgagactgcatctcaaaaaaacccaaaaaacttccttttgctttgtcatataatgacttcacttttttaaaaatcctgttaatttacaggtatgacttccttatagcaatcctgtacccacataaaagctgcatttccaatatgagatgaaaaggtattttgcaaaaagggcaaggttctcatgcctgctggcatagctgcagcaacggtgttatgaatttccttttctgtttttacaatggtccttatgttttcttaatttatcttgaaatggcaggcaaccacatctgcaaacctcaatccacaatgcatatcaagcaattcaactttttcttgtaatgtcatkactttgctatgcttcttaggagcacttccggcatcactaatgtcactagtggcattttgaatgggtcccatagtgttagacaaggtttacaatattccattaaatacaatgaaaaatacataagaactatgagatcatttctttactttgatatgcaatttactggagagacaagctgctctcacagtttagcatcacagcatgcrgtgttttcagtggatactcacaacacttgagtttactgcaatagcagcaggaggtagctatgaaattattacaatactgcaatatgtactacagttaattttatacagttatgatttaatactgcatatttacgtttgtttacgtttgtctcgactatgaatggcaccatgtgtagtctgtgtttatgtgcctaaattttgataaattttaactttttataatagattttatgtatgtgtagattttatgtagtaaatgataaaacaggccactatctacatatattttatgcattcatgacatacctaactttttcttgcttttttggttatttctaggctatgcagtgagttttttcaaaatgtcacaaatctccaaaaaattttccaatttatttattgaaaaaatccacatataagtggacccatgaagttcaaacccaatgttgttcaagggtcaactgtattagcaaactgacatccaaaatatataaaaagaataacatatcacaattaagtggaatttatcctagaaatgaaaggctggttcaaatttgaaaatcagtcaggtttcagatcagaaaataaggtaccatattaacagtctaaagaagaaaamccaaccatacaaccacatcaattgaagtagaaaaaaatatttgacaacattgagcatccacccttttttttttttttttttttttaagagacgggattcttgaatgctcaggctcaagtgatcctcctgcatgagcctcctgagtagctaggaccacagccagaagccactgctcctggctcatcatccattcttaataaaaactctcagcaaactaaagagaagtaacttctataacctaattaagggcatctacaaaaacatccacagctaacataaaatagtggtaaaagactgaatgctttccccactaagattgtgagcaaggaaaggatatccactgtcattgktcttatttgatatcttaatgggmagtcttagccaatgcaataaggcaagaaaaaagacataaaaggcatatggataggaaagaaagaaatgaaactgtccccatttgcagattacatgcttttctaagtagaaaatcccaagggatatataaaacacaataaaaaaaaaccttcctaggacaaataaatgagtttaacaagggtctcaggatataaagccaacatataaaaatcaatcatattgttacatattagcaatgcacagctgaaaacaaaaatacaaacagctcataaaaataaaatatttaggtataaatctaataaaggatatataggagctgtatgctgaaaactacaaaatgctgatcaaagaaataaaacctacataagtggagagcaatactatgttcatgaattggaagagtcaacataataaacatgccagttccccccaaatgatcaatacagttaacacaataccagttaaaatcccagcaggatttattttttgtagatataaacaagccagttctaaaatttatatgaaaagggaargaaactaaaatagctaagatgattctggaaaagaacartaccaytggggaaatcatgttacctgaatataagacttacaatgaagctactgtmatcaggacaatgtagtattagtgaagggaaagacacatcgatcaatggaacagaatagagttcagaaatagactcatgcaaagatatggttctatatgaccagtgaatttttcaacaaaggtacaagagcaatttaatggagaaaggataatcttttcaaccgatgatattggaataactgacatccatatgaaaaaaaatggacctcaacctaaacctcagaactcatacaaaaattaactcaaaatgcatcacacatataaatgtatgaagtaaaactatacaacttttagaagaaagcagaagaaaaatctttgtgacctggggttagacaacgacttctaacttgacaccaaatgcataatccattaaatgaaaaactgattaattggacttcatcaaaatgtaaaactttcactmtctatacgatccagttaagagaacaaaaagactatctacagaagagaagaaaatactttcaaataacatatccaataaaagrcatatccagaatttataaagaatcaaatggtaagaaaatgaaactcaaaactcaacagtaagaaaacaaataacctaatttcaaatgggcaaaaggcttgaagaagcacaccatcaaaaagtatactatgtatgcagatgacaagcctatgaaaagttgttcaacatcattagccattagggaaatacaaactaaaatcacaatgagataccactgcacatctattataatggctaaaataaaaaacgcagacaataccgagtactgataaggttgcagaataactggaattctcctacattgctgctggaagtgcaaaatggtacagccaatctggaaaacactttggcggtttcttaaaaagtcaaacatatatttaccatatgatccagcagtactacctgtgggtatctactatagaggaataaaaacttatgttcatgtaaaaatctgtagatgaactttatagcagttctattaatagttaccaaaaactggaaaccacccagcagatgaatgcataaactgtaatacaatcatataataaaatactactcagcaataaagggaactattgatacatacaatttggatgattgtcaaaggcattatgctgaataaaaggattcagtctcaaaaggttacatactgcatgattccacttatacaacattctcaaaaacaaaactatagtgatgagaatagaatagtggtttccaggggataggagtatgcacaggggtaaggtcatggggatgtgactataagaaataacgtgagggagttttttagtgatgggactgctctgtatcctgattgtggtggtggttatatgaatctatacatgtgttacattaatagaactgtgaaagcttccccccaacccaccaaaaaagggtcaaatttactgtatgattttttttttatctgaaataaaaaccccacaggaaaaaagtactcgttttaaaatagaagttcaagaagtagaacagtttcttctgggctgagaaaaaaattaaaggtttcatgaaggatgaggtatttaaaaaatgtatgttacaggtacagactgtaatacttgttcacaatctgtcttctctgatagactatgtataatgagggcaggagcagcgtctggcttgttcacctctatataagcaataattaaagcagtactttgcacacattagggactcaatttatatatgattgatctattgcttgtgaggccgggcgcagtggctcacgcctgtaatcccagcactttgggaggccgaggcgggcagatcacgaggtcaggaaatcgagaccgtcctggctaacacggtaaaaccccatctctactaaaagtacaaaaaattagccgggcgtggtggtgggcgcctgtagtcccagctactcgggaggctgaggcaggagaacagtgttaacccgggaggcggagcttgcagtgagctgagattgcgccactgcactccagcctggatgacagagcgagactgtctcaaaaaaaaaaaaaaaatgtatgttagaggtacagcctgtaatacttgttcacaatctatcttctctgacagactatrtataatgagggcaggagcaatgtctggcttgttcacctctatataagcaataattaaagcagtactttgcacacattagggactcaatttatatatgattgatctattgcttatgatattaataggcaaagatacaataacattctaggaaaagtgaaaaacattagaaaataccttaaattttcatttcctctcctctttctaaatccctcctatctcttcaaggtcacttaaagttcagttacagaatcaggttcccctgattcttccagcccacattcatttttccaacttgtccaaacttgctctaacactgtcaaacttaatctaacattttagtgtagtactacttagtattttaaagactatgcctcatttcctttaatagttattaaaatgtgtcctctttttatattatttaaattttaaaatacattatattacatgagtaaaaacaaatcaaagcactacttagcttcaaactaaacttcattccttcagtcctccaacagattttcatctactttcatctacatcctctaaattggtcaagccttcccctcctcttctgtttccatattcacatcattagtttaatgcttaatgactggcatttattaagatttaatattattccctaacaggttaacatgtaactcatttccttagctttcttgtcctgaggacagagatgacacctactacttatttattttaactaattaatatgtaatagatacatgctaattggatgtccctgtgtactattccctagcctagtctactcctatttttacttctctactaagaaaaaacttttttttcaaaagccaattctggatacttttgtaatggatatttaaaaaggcagagagaaatttactttttagtaattccgcatactatatcagaaattgccagaaagcttacaatactggcattctggaacgatttcattttcataacatgctgacattagcctgaatcagataactgaacttaagctggccttgaatttaacttgcttactcttgtattcaattggaaaggtaagaatacaattaagaatatgtattaaatgttgaatatttatcaactgtgtctaaaagaagttgaaaaatatttaatttttgagaaatggaaccatactccaactcctttatcatatgtaagtcttttttgttaaatattcatatatatttttagaaatgtattgggtgaaaaaaaaaaagtactcttttttttttgagtcttactctgtcacccaggctggagtcagtggcagatctcagctcactgcaacctcagcctcctgggttcaaacgattctcctgccttagcctcccaagtagctggaactacagatgcacaccaccacacctggctgatttttgtatttttagtacagatggggtttcaccatattggccaggctggttcgaactcctgattttgtgatccgcctgcctcggcctctcaaaatgctgggattacaggcatgagacacagcacccggccaagagcacttattattatttatttatttatttgagacagagtctctctctgtcacccaggctggagtgcagtggggtgatctcagctcactgcaaactctgcctcccgggttcaagtgattctcctgcctcagcctcccgagtagctgggattattacagatgcccgccaccacgcccagctaatttttttttttttaattttatttttagtagagacggggctttcaccaggttggccaggctggtctcgaactcctgacctcaggtgatccacccacctcagcctcccaaagtgctgggattacaggcgtgagccactgcacctggacaagagtacttattattaaagtactttgttattttttgtttttttgttgttgttgtttttgagacagtctcactcatgtcgccygggctggaatgcaatgatgcgatctcagctcactgaaacctctgcctccagggttcaagcgattctcctgcctcagtctcccaagtagctgggattacaggcgtccgccagcacacctagctaatttttatatttttagtagagacagagtttcaccatgttggccaggctggtctcgaactcctgacctcaggtgatctgccagcctcggcctcccaagtgctgagatgacaggcgtgagccaccgtgtcaggcctacccctcagactttcaataatgattcctagagttcctggctcacacattacctcaccacatgaatctcatctatatcctctraatcaggtccactatttgctttatttttcctcaaatcattacagttcttttttcccccagaaattaagctaggctgagcatcaaagataggctttataagactacgtaaagatagcagggctaactttgaatgctcttaaacttgcaaactcatgaagactcattaggagaagaagacttagtatccccattataaattagaatatgttctctaataagaatgggtgttggctgggggcagtgtctcatgcctgtaatctcagcactttgagaggccaaggcaccaaatcgcttgaccccaggaattttagagcagcctgggcaacatggcaaaaccccacctctacaaaaaaaaaatatgaaaacsagctgggtgtggtagcgtatgcctgtagtaccagctactcggaaggctgagatggaagaatcacctgagcccagaaaaacaaggctgcagtgagctgagagcaccactgcagtccagcctgagtgacagagcaagactctgtctcaaaaaaaatgggtgttatatgcctgaatatgcatatagccatagtgtccaatacagtttgccaaaagcagtcttagaagtcataaaggacctaacacagtgcagagaaatataatactatccatctctctaataaataaaataatatgctcaccctctggtggccaaaatgggaaatacacatccattttcttggattatatccaaaatattagtgtagtatataatatattaagtttctgcttcatatttaacctaaaccaaaaagattttaaaaggccactgacttttttaaaaaaaagtctaccccaatatctaatataaaatcaataaaattactaaatatagtaatttaagaatatgtcatgactcatatatatataacagtacttgatacttaaactttaaatttgttttaaaatattagaactataaaactttaaagttggaaggagttacagtgatcatgtaagtctataatttaaaactgcatgttagataattagtttttttaatttgctaatgaaataaaaacatctgggtaaacagaactgaatagtaatgagacttaatttttatatttctagttttaatttataaatatgctaaagaattcagaaatattcatacatgtaaattcattttaattttccactcattttatccaactatccttccaagagagaatatagtatatactttctgccccgctccactacctctcagcaagctgaactcrctgccttaactcgagacctcgctctcgcaaaaggactaygcgtcaatatttatactgactgtaaatatgccttccatatcttgcaccaccatgctgttatatgggcagaaagaaatttcctcactatgcaagggtcctccatcattaatgcctctttaacaaaaactcttctcaaagccgctttacttccaaaggaagctggagtcattcactgcaaaggccatcaaaaggcatcagatcccatcgctcaagacaatgcttatgctgataaggtagctaaaaaagcagccatcaaaaggcatcagatcccattgctcaggacaatgcttatgctgataagatagctaaaaaaagcagctagtgttccaatttctatccctcatggcagttttcttccttctcatctggctactcccacctactccctcactgaaacttccacctatctcttcccacacaaggcaagtggttcttggaccaaagaaaatacctccttccagtctcacaagcccattctattctgtcatcatttcataacctcttccatgtaggttacaagccattaagccygcctcatagaacctctcatttcctttccatcatgggactctaccctcaaggaaatcacttctcagtgttccagctgcaattctactacctctcagggattgttcaggccccctcccttccctacacatcaagctcggggatttgccccagcccaggactggcaaattgactttactcacatgcctccagtcaggaaactaaaatacctcttggtcggggtagacactttcattggatgggtagaggcctttcccacagggtctaagaaggccaccgcggtcatttcttcgcttctgtcagacataattccttggtttggccttcccacctctatacaatccgataactgaccggcctttattagtcaaatcacccaagcagtttctcaggctcttggtattcagcaaactgatggtcttttaaaaaacacctcaccaagctcagccaccaacttaaaaaggactggacaatccttttaccactttcccttctcagaattcaggcctgtcctgggaatgctacagggtacagcccatttgagctcctgtatggatgctcctttttagtaggcctcagtctcattccagacaccagaccaacttggactgtgccccaaaaaacttgtcatccctactrtcttctgtytagtcatactcctattcaccgttctctactcataaatgccctmctcttgtttacactgccggtttacacagtttctccaagccatcacagctgatgtctcctggtgctatccccaaacggccactcttaactccctcttaaagtaaacaaataatctttgctggctgggctatgctgaacctccttgggcactctctaattggatgtcctgggtcctcccaattcttagtcctttaatacctgtttttctccttctcttattccgtttagtttttcaattcatacagaactgtatccaggccatcagcaataattctataagacaaatgtttcttctaacaaccccacaatatcaccccttaccataaaatcttccttcagcttaatctctcccactctaggttcccacgccacccctaatcccactcgaagcagccctgagaaatatcacccggcattatctctccataccacccccaaaaattttcgccgccccaacacttcaacactattttgttttatttttcttattaatataagaagacaggaatgtcaggcctctgagcccaagctaagccatcatatcccccgtgacctgcacgtacacatcgagatggccggttcctgccttaactgatgacattccaccacaaaagaagtgaaaatggcctgttcctgccttaactgatgacattaccttgtgaaattccttctcctggctcaaaagctcccccactgagcaccttgtgactcccgcccctgcccgccagagaacaaacccctttgactgtaattttcctttacctacccacgtcctataaaatggccccacccctatctccctttgctgactctcttttcggactcagcccacctgcacccaggtgaaataaacagccttattgctgagaaaaaaaaaaagaaaaagatttcctactaaataagaacaccacacaatgaaagcattatttataktttaataataaagtacataccatggacataaaatgaaaatgcatataaattgaatagattattatttaggtacatcagttaagtagcatttagytgtttaataaataacagactaaatctgaaataattcttagtttggtaagttctaagtataattatttaagaaataagagaatatatacaataatatatccattcttgtcgttcattcaaaggcattacatgttgacaaacctgcamataaaaatagaaagcttttactctctttttatatattgttacttttggctaatttttaaacaggacaacatttctaggccttgtataagaatatccctgtacagataaaattctacaatatttgtccttagcagagactagcaatctatgatctgaggtctaacaggataatccagtctaaattctaccctaacatagtagctgtcagttggtgtgtgtgaatgtgggtaaagaagagtggtggaaagaggagaaaatatcctttccttgctaaacctagagcgttttctaaaatcttaattggagaaacagaaaagataatctctttatcctgttctggaatgttttaggattttatggacagtatggagaaagaaagggtaagaataggaagctttttcctttctcccttcacttgcccagtaggtagctctattgatctgtccctgcctttgaacccctggctaaatcagaaacccagagttctgctaacaccagaactacagctttttctagctcttgacttacttgcttatttaaaactcagaggcattgtccctctcaggatactttagaaaatcttaataatgcagataaaagcattttgggttatcaaaattattgttactattaatactttacatttctatatgatgtaaaaagtactttcatgtacatacatcattttatttttatccttactttaactttgtgaagtacataaaactagtgatattatctttttttttttttttttttttttgagacagagtctcactcttgtcgctcaggctggagtgcaatggcgtgatctcagctcactgcaacctccacctcccaggttcagattctcctgcctcagcctcccgagtagctggrattacaggcgtctgccaccatgtccggctaatttttgtatttttgtagagatggggtttcaccatgttggctaggctggtcttgaactcctgacctcaggtgatccacccacctcggcctcccaaagtgctgggattacaggcgtgagccaccgtgcccggcctagtgatattatcytaattttacatttagagagactggaacatagaaataaatgaacttcccatagtcactcaaccaaacagtgacagaactggattagaaccaaagtctcctgtctctgagtatagaatgatactgatacaaatatcatacttaaaataattttccactccattttatatttacattttactcatagcattaatagcaaatttttttcaaagayataaaacaaaaggctttaattagaaaataatacattaccattgtagatttgggtcccacttctactgcaaatatgttgagtcctctgttgtttatgcagtttttacttagctcattgctgatgtgaataatcactttctcatctgactattaaaaaaagatttcataagctgctattcctttctttaataattacagacaaatataagcctcagaataaaccctgaaattctgttttaacatcatatagtgcactacaaattcatacaaattggctacttctttcaactttgttactttttctcattgattttctttccaatctgtcaccatttatataaactttttcttttaaatgtgacttaaacttacttaccttttaatcttcattcccagggtattatggacactagggtcacattatttcatccttgacttatgatagcaatagtgtctatttcttttgttgttatctctagttttttcaacttccattcattttaatactaccttccaactaatatgtctaaaacatctttttactccttcattgacaatatataaacaaatatatttattatcaactttgtatcaggcattgttttagggtctaggtgcactgagataaaagatagaattactgactcctagctcacactctaggggagacagacaaataaaatgacaattacaaaacactttgctgagtcttgtaacagaggtatttagaaggatctatagaaacacagaagatgaacattagctcggactggggtttcaagaaagactttatggaagaagtgacaactgagataaaagacaatggcctctaggatggatagggagcaagggaaagcagaatgacactgataaatggagaaaatgcaggaataaaaatattcccctactaagaatctgcgatcataccctaatgactataaagggggtagtataatgttagactacctgaatttatttgtcaactcttctactacttagctgtgtaatcatttgcaagttatttaactgctctgtgcttcagtttcctgtttgtaaaatgagaatagcacttatgtcatagggttgttgtgagaagtaaatgctctaatatatgtaaatgcctggcaaacaataaggtctaaaatgttcacattattatcacattttggtgaagagagttgaattttccttgaggaaaaaggaggcagagaattgagaactaataggtggtagcagaacagaggggttggggtaacgtagtaactcccttcacctttttaaccctaataaaacatagagggcagaaagggaaccatgatgcatcttaggaatcaccctctgaggcatgattggtccatttgaaaactgcaatctactaggtggggacccaagcttagttaatcaagtctaaactcctctatctcgttttcaagataacatatataatttggatccattctgtatgttatttacctcctaatcctcctccaaataaagctgtctattgctgcaaagcagatattctcactctttcctttatacttcatatatacccttcgccttgtttcgccttacactgtttcccctgcttctaaaggctgtctgtctgcatatctaaatcctagtcatccttcagtgctyaaatcccatatcacagttcccttgcccctcgtaacaaatccttccccaacytctatggtccaaattaacaacwactacaagagaaacagaataaaacccctattgcacacacaaacagtactacattatgtaacgtttaattattctctgatgtctttcaagagtattaattttgtctttccaattatagcccataaactccttgaacgcagagatcaagttttacactttctggttgctcctattgtgactaaaatagttacataatatattctcaggttgactaaaaacgctgccacatcttaagtattttaagaaatttatggcaggcataaaaatatgtctcacgtaggacctaaaagaaataagtcaacagtactgagcacctagccatcttatataaagttttatgaaaatttataatttctagagaactggatatttctgactaagaatttatgctcgtattctcttgacctgtaatatcaatagtattaatagcagggaagagagccaaaggtagaaataatcagcttgatgaaagcaggtcttgggacagtagaatacatttagttatattaaataataataatttataggatctctgcaacgttagtgtaaaacgctgggttgaaatttttcctttgcttataatatttctttaaaacatgatatmtattattaaaatagctatgtatacataaaaacttttagaaacaaactaaataawatactttgtacccagattgtgctctatattcactaatatccaaatgtttaattttcctaatattttaagagaaaaaattggaaacctttaaaaatcatataaaaattaccactcccagtttgagttagaaacctgaggagaaaaaataattatgcattataaacattattaatgtgatgggatacttaattaccacatacgaatagagtaaggaataagatgaaatatattagtaagctttgtagcaaaatgaggaaaaccacctcataattgataccttgttttcaataactgacgttatccaggtgtcacaactgtaagtatgcacgattatattttcatagccatccattactttggcatcaccgttgctaagaacagatttacaaatggccttctcaagttgtccactacatgcctccatatggacagctttaatttttggcttgcatttttctgcatagatatcaatgacaaatggacatgcctgataggaaaaaaaaatcttgtttcagccttttgatagaattttaaataaattattaatatgttaccatataagaagatatgctataccttctagcttgtccttctaataaacttttagaggaaaattttagtactatgaattgagtaataagcaagcatgaaatcctgactttttggtagcatattaactgataatgttcatagaaaataaaagaaaataataacctctagcaaatcagtaatataccaccttctttaaaccataataccatctcttcatttggttcaatgctaacaaataccatgttatttaattttcttttctaaagtgagggttacagaaagaattcatcaaaggtttctacagaaattattacatttacaattgaagcttactgcatggatacagagcactgactaaacgtttagtctaaaaacacctttaaaatatgagacttaaaaatattttctgcattccgaatgaaatttttctaatatctaccttagtctttttaccacagcctacaatgtggtaaaaagccaatgtggtaaagagcctttgcctctccatccaacctggtctcctgtgtctctatgcaacagctatcctgatctttcagatcctagagcaaatgaagcccttcatacgtagtgttctctccactgggaagattatccttatgtattttcacataggtaccttgtcttcctgcttcaggttaaagcttaagtgccacctctgcagagggatctgctctggccccccaatctccctcactcccccactgttctctgttctctacttcagcctttgagttgtttcaaaacacctttgaaataattttttttttttggagatggagttttgctcttgtcgcccaggctggagtgcagttgggtgatctcagttcactgcaacttctgcttcccgggttcaagtgattctcctgcctcagcctcccaagtagctgcgattacaggtgaccaccaccacacccagctaagttttgtatttttagtagagacaaggtttcaccatgttgaccacactggtcttgaactcctgaactcaggtgatctacctgccttggcctcccaaagtgctgggattacaggcgtgagccactgcacctggccgatataattttattttaattaattaatcattctccttcatgaaatataaatttcataagggcaggaactttgactattttattcatctttgtatcctcagtgcctctttcctgcagttatcacatagtaggtattcaataagtatttgttgaataactgaataaattcacaaattggtggtcatcttttaagaaaataaaagaaagaagtctgaagttaattttagtagactataaacagaaatttgtgttttaaaaaatattttaataatataaaataaataaatataaaataaaataattataaaatatttgtataataaaaatattttaatcacttcaacctttggcaataataaatttgcctttttaagagaaatagtagaatgaaaaatcattggactaaaaagtagaagacctgggtttatttttcatacacatcacctttgtaaaaatttttaaagattatttataataattatgagtatggcatttttaaaggtttatttgttcagtactggtaaattctggtaatattctgccattttttaagtcatgrytatcagttttattcaaccaaagaggatcaatatttgaatattcactgaaagcaaaacatcttaaaaggtccatgttaaaacatattctctaattttttttctttttttttacacttttaagttcaggggtacatgtgcagatttgttacacaggtaaacgtgtgtcataggagtttgttgtaagattatttcatcacccaggtagtaagcccagtacccattcgttatttttcctgatcctctccctcctcgtactcttcaccctctgataggctctagtgtgtgttgttcccctttatgtgtccatgtgttctcatcatttagctcccgcttataaatgagaacatgtggcatttggttttcagttcctgcattagtttgctaaggataatggcttccagctccatccatgtccctgcaaaggacatgacctcattcttttttatggctgtatagtatcccatggtgtatatttaccactttttctttatcctgttttccactgatgggcatttaggttaattccatgtctttgctactgtgaatagtgctgcaatgaacatacatgtgtatgtgtctttataaaacaatttacattcctttaggtgtatatccagtaataggattgctggattgaatggtatttgtctttaggtctttgaggaatcaccatactgtcttccacaatggttgaactcatgtacactcccaccaacagtgtataagcattcctttttctccacaatctcaacagcatcttttattttttgactttttaataatagccatttggacaggtgtgaaatgtggttttgatttgcatttctctaatgatcagtgatgtcgaactttttttcatatgattgttggctgcaggtatatcttcttttaaagcgtctgttcatttgcccattttttaatggaatttttttcttgtaaatttaagttacttatagatattggatattagacctttgtcagatgcatagtttgcaacaattttctcccattctgtaggttgtctgtttactttgttgatagtttcttttgctgcacagaagctctttaattagatcccatttrtcaatttttgcttttgttgcaattgcttgtggcatcttcaccatgaaatctttccccatgcctatatcttgaatggtattgcctaggttgtctctcagagtttttacacttttgggttttacatttcagtctttatcttaaaatttttttkttgttgttgtttttttttttgagacggagtctcgcactctcgcccaggctggagtgcagtgatgccatcttggctcactgcaagctctgtctcccgggttcacaccattctcctgcctcagcctcccgagtagctgggactacaggcrcctgccaccatgcccagctaattttttgtatttttagtamagacggggtttcaccaggatgaagccaggatgttagccaggatgtcttgatctcctgaccttgtgatccacccgcctcagcctcccaaagtgctgggattacaggcrtgagccatcacacccagccctagttaatttttgtatatggtgtaaggaaggggtccagtttcaatcttctgcatatggctagccagttatcccagcaaccatttattgaatagagaatccttttcccattatttgtttttgtcagatttgtcaaagatcaaacaggtgtaggtgtgcagtcttatttctgagtgctctattctgttccattggtctatatgtttgttcttgtaccagtaccatgctgttttggttactgtagccctgtagtatagtttgaaattaggtagcatgatgcctccagctttgttctttttgcgtaggattgccttggctattcgggctctttttttggttccatatgaattttaaaattttttttctagttctgtaaagaatgccaatggtagtttagtgggaatatcattgaatctataaattgctttgggcagtatgaccattttaacgatattgattcttcctatccatgagcatcaaatgtttttccatttgtttgtgtcatctctgatttctttgagcagtagtttgtagttctccttgtagagattgctggcctcccttgttcactgtactcctaggtgttttattctttttgtggcaattatgaatgggagttctttcgtgaattggctcttgacttgactattgttggtgtataggaatactagtgatttttgcacattctaaaatttttaaattaaaatcttatcacatctaaaagaactgccctatagttttattttttcttttcatgggcttgatcttttatttacttattttctttatcctactaacttaatataggaagcaaacaacaagcaagaaaactattaactgtaaattattcattgtaaaattattaacaatatatgtgataaggaagayggggaagactgcaataataaaacctagattatgggatgttacttaaatttagcacaatatttagctctcaactacctgttaacmyatacaaaagggaaataaaaagttatgtagtgcttaaactctaaaaaagaaagtaaattttcccagttctgaatctagaaagaaattaatatcatgaaattctattttaaaaaggaaaacagaaaaaaaaggggggcaaaactaaacatgtaagtttyacttctcaaattcagtaaaagagcaactattcaattacagtatataggggcaatgcccttataaagaagttatattgctctttaacagaggatcttcataggctgatacagggaatgtgtaatcagtaattctacagcctaaattagagaatttaataaggaaaaataaagaaataagtaataagaatktaataagaaacaataaagaaatttagtaagaaaaaagattttaaatctgttcaactgatgaggaacagctccacttcaattaacacacttatgttaggcaaccagtgtcagctcctcagttttgaaagtcaggcaatcagagatggattcacatcagtaaatacactgcttagtgccaaccaatcaacagtctcatccaagtaaccatgcttccccagatagtattaactcatttatgcctctaaaagccaggcaatccttgaattccatacctccccaaaaccctatataaatgagcattctgctcttagccgagagactgtgcctgatcagcatagctctcctttatagtaagcaatcaattcagctttgtctttttatttcagttactgagtggcagtctcatcatctattgatactttccaatgtatactgtattttttttaccttttgaatttaaatgatacaaataacctactcaataaataaatgaaatttaaattaaattaaatgttagctcagaaatccttcttgcttatagtttcaaaggtaaatgacatcagtaactgtggtaaaaagtcttaaattgctcttaactaatttccctaataagcaacaacatgggtagcacaatcaatattgttcctagattagatgctgattttacacatggttaaaatgtgggagtcactgactgttaggctcaagtaggatataaatagttaccataactattcacctcctatttctaaaaatggggaaagaatagagaacctctcaccaaacaggttaatgaaggttttgaatgatgtcaaaactaggaattaaaccaaagtctaaatgtatctaaaataaaatttgtcaaagttagtattgccctcctaagttgattcaagtatggaaaaaggacaaatactatttttaattttaagagtataaacaaatgtactgttatgtaacttgtggcctgaaactgaaactcttaaattctatattttaaatctgacataaaatatagaaattagcctgggtaaaacagtgagacccccatctctacaaaaaaaaaaaaagttaaaaaattagctgggcgtgggggcatgcacctgtagtcctagctactcaggaggctgaggcaggaggcttacttgagcccaggaggttgaagctgcagtgagctatgattgtgccactgcactccagccagggtgacagagtaagaccttgtctcaaattaaaaaaaaaaaaagttttakatatatatatatatatatatatatatatatataaattaagaaggcctaatttttaaatttttattacccctatggtttattacgagccctgttcaacttctatacctatcatgttaatgataataatgatgataatagctgatacatacacaatgctttgtatgagccagccactgttccaagtgttttacaagtattaaccccaaaagtaccctttataaaaagaccagaaatccaagttctaatgcagacacaktctccttattctaagagagcctttaaactgttaagacaaagtgtttccctatagaaatgagactttagtaactcaaactgccttttccaattttaatttttttaataccaaatttttttcctgcatattatatgcttagactcttttgtctttgaattattttaatgttggcagtaactaaatttcaggtgagaacaagaacttgtataaactaacagaaacatgttgttgcacccaggattcattcatatactaaagttcaaagatttgggtgcccaattcgaaagttatatgtcaggaaaatgttcataaagtaaaatattatgtacattaaacccattggcaaaagtttaagaatactttacctctgtcaactccagagctttattgtagcccatagagtgtagagttacccaaaggtcacaaggatctccttctcgatcattagcttccattagattcaaatccataaatccttgtcttgttagttcattcctctttgtatcaaaattctctgtttaaacaaccaaaagttktttcttacataatttaaaaattcataactttaataaaatgtctatgatatattattattcatagatatttattttaaaagaggcctatgaatctatgagcaggataaaagtggaataaaaatggctcaaaacattattgagagctattcttctagtttcccataactcagcatagatatatcgtagtacacaatttcatttttcaaaaaatcctaaagttataaatagtgcaaatatattctaaaattagaggaaactgtaatawttctgggtaaattccaatctgcctggttatttagagcatacgttgttatatatttcaaagaattaaaatgcttcatatgtatttgccacttaaagccagcagaaactggatgaatttgatataatactccccaaactactgagtttcagaaagaaaaaygggaatagtgtcatatttaaggagattactatatgcctgattcctctaattttagctaaattgtccccaagtcttgaaagactgacagataatggggagcactttggaatccatgaatcaactacattttcccaggtaagtctatgcctgttttaacactatttatgagcaaaactaaatttacctagaagtatctagacatgcataattcctgaatttgtctgtaacatggataataagtcgttatttattatggatattttgttagctatcctacaacagggaagattttatttcctaacttccatctataatatatccaagggaaatgggtagtcttatttgagatggcatctcttttgtgtgcattattgtgagaaaagcagcagagacataactgtgtaaaaccggttgactgattaatagcttaaaacatttagaagccgggcacggtggctcacgcctgtaatcccagcactttgggaggccaaggcaggtggatagcctgagctcaggagttcaagaccagcctggccaacatggtgaaaccccatctctactaaaaatacaaaaaataaaattagcccggcatgctggcatgcacctgtagtcccagccacttgggaggctgaggcagagaatcacttgaacctgggaggcggaggttgcagtgagctgagatcgtgccactgtactacagcctgggtgacagagygagactcagtctcaaaaaaaaaaaaaaaaaaaaagttaagagtttaaagttattcataactttttcaaggggaaaaaataaatgcagattaaattcaatcatgaagagaaatggtagccacaaaaatcgaggttagagctactatgtagaaacgatgaaaaaaatatttgacatataatacaaatacattaagaaacctatctagatactgtactatagagactatcaaaaacraatctactttttaaaacttaaaattctcaatcctcattaatttttaaaaaattaacacttgggccaggcgcagtggctcacgcctgtaatcccagcactttgggaggctgaggcgggcagatcaygaggtcaggagatcgagaccatcctggttaacatggtgaaaccccatctctactaaaaatacaaaaaattagccgggcgtggtggcgggtacctgtagtcccagctactcgggaggctgaggcagaatggcgtgaacccgggaggtgaagcttgcagtgagccaagatcacgccactgccctccagcctaggcaacagagcaagattccatctcaaaaaaaaaaaaattattaacacttgactccaagacttactataaagccacagcaatcaagacagtgtggtaatggtgaaataatgatgaatagatcaatggaacagaatagagagcccagaaatagaccgacataaatatattcaactgatatttgacaaaggagcaaaggcaattcaatggagaaaggatagtcctttgtaaatgatattgtaatggtggatacatgatgttacatatttgtcaaaacccatagaactgtacaagacaagagtgaaccctccaggggtttgagaccagcctgggcaacatggtgaaactcatctcaacaaaaaaatacaaaaattagccaggtgtggtggcacacacctgtagtcctagctactcaggaggctaaggtgagaggatcgcttgagcctggaggcaggggttgcagtgagttgagattgcaccactacactccgtcctaggctaacagtgactcaaacaaacaaacaaaaagactgaacctaatgtaaactatgaactttagttaatgattatgtatcaataattcactcatcaattgtaacaaaggtatcatacaaatgcaagatgttaataatagggaaaacttgtgggtgaggaggaatatatggaagatttctattttttttttttttttttttttttgagacagagtctcactctgtcacccaggctggagtgcagcagcatgattttggctcactgcaacctccacctcccaagctcaagtgattctcctgcctcagcctcccaagtagctgggattataggtacctgccaccacacttggataatttttgtatttttagtacaagtggggtttcaccatgttggccaagctggtcttgaattamtgacctcaagtgatccacccacctcagcctcccaaagtgctgggattacaggccaatttttttttttttttctttttaagagacaatttgctctgttgtccaggctggtcttgaaatcctggcctcaagtaatcctactgccttagccttccagagtgctaggattataggcatgagccacagcacccagcctgttttttctgtaaacctaaaattgctctaaaaataaagtttattaggaggcagtgcttgcagtgagccragatcacgccactgcactccagcctgggcaacagtgtgagactccatctcaaaaaaataaataaataaataaacaaaataaagcttattaataaacaaaataaaaataaagcatctttaagtgtaaaaaaagtttattaaaataatcttacagataaacagtacattttcttattattcaggggaaacattaaaaccttaaaagctctcatttctttgcaatattattaatgttggtaaagtagacattcctccaaatcatttttcaagtcaataactcttggagactttttgatagcattgagttcaaagttctggagcctatctgtgaaactttcttgctgtgtagccttggtcaggttacttaacctctaattctatttcctgatttataaagtgagaataataaagtactacttcatagagttggtgtgtagaagtgcatagatcagcagctggtacatggtagatggtaagctatcaaaaaatgttaaccgtcaactctgccaattcaattaaaattttaaattagaattttacttatcacaaactttaccatcagaaagccacaaattcactcttatggaatgttctctagtgccaattaaaagattatatcattaaagttacaagataattacatcttcctataggtaatactctattatgtatattatgaattttattaatcacagtttaatattataaatcaatatacatgtattgctgttgattatattaactttcagctaaaatagaaatactgaaagattcctttatataaataatatacttctctaccctacttgctgtctaggtaaacagactcccaacctggctcactttgccaagcttagaccattttaagacccacatatagctatcccagtgaaagcatacgtgagttaatctctcttgactgaattctggtctcctcatacctcttgttctgtgatctatagttggctatggctttttggttttccctcgaccttggggtctttggcttaaatatgcaagtatgtcttcccagactccttctaagtgataactgactttgcctcattctcagtgattttctttgtccatcttggcatttttggcttcaatatttccataaatggactttttaaattcaactcaaatacgaaaagcactgaagaatgtttaacatgtataatataagcaacttcctggaaaccttaatttgtgagtaaaactctagctttttggctttttgctgccctctcctggtcacagtttgtggttcttgaccacttcaggcccagtggtatcaagygcaaggacaagttttttgtcttctaaaccccgaagagtagagaatcaaaactaaaattatgattaagtaattcacactttcttttaacttgagtattataccaactatcggtttaagaaaaataaatgtttaagtttttatgatctacaaacaatactactttcaaactgtcctaaatgctataataatatttcatgcagaagtttgacttctcatttcttagagatgaaaaggtgctatatatatatttttatacatctgttaaggaaaagaaaagtgcttacctctgcagacagcccaagcatcttcatcacatttctcaccacttgttctcaattcaaaaaaattatattcttcaaggctaagaagaccatttccatctaaatcaattacttcaaatatatctgataaagtagacctaaaattataaaaatagctagttatttcttgtcactaaggcaactacgctgaagaagggttttttttttttttttgagacggagtctcactctgtcacccaggctggagtgcagtggcgtgatctcggctcactgcaagcaccgcctcctgggttcacgccattctcctgcctcagcctcccgagtagctgggactataggcgcccgccaccacacctggctaatttttttttttttttgtatttttagtagagatggggtttctctactaaaaattttagccaggatggtcttgatctcctgacctcgtgatccgcccgcctcagcctcccaaagtgctgggattacaggcgtgaaccaccgcgcctggctgaagaagggttctatgaggataacattcaaaaggaagtaatatagcgttacacaatttctgtaaactataaagttaatgtaaccaaatacagttttggctcagtccagtattacatgagataaaaaagcttctagaacaaccacagtatctcaacacacagtaagaactcaatgaatagtagtagttcccttcttttttcctttctccaatctactttcttcttcctctctaccaatagggagaaattgtcgatgtttgactgaagttgacttgccaaatgtgtagaacccacaagtaaatgaaaatcccagatctgcaaatggaggaacattttcagatgcctagagaatgagctgttttgttttgatatatatatttatggtgtacaatgtgattttttgatatatgtagacaatgtgaaatgactaaagctaattaacatagccattatctcatatatttatcatctttttttctagtgggaacatttaatatctattctcttagcaattttcaaggatacaatatataactataatcaccatattgtcaacagatctcctgaacttattcctcttatcaaactgaaattttgtatcctttcaccaacatatccccaacccccccactacttccagctgctataaccactcttctactctctgtttctatgggtttgactttttaagatcccacatataaggctggatgtggtggctcacacctataatcccagcactttgaaaggttgaggcaggatgctcgcttgaggccaggagtttgagaccaccctgggcaacatagcgagactcccatctctttaaaaaaattagccaggcatgctggcaagcccctgtaatcccagctactgctactcaagaggctgagctgggaggatcacctgagcccaggattctgaggcttcagtgagcaatgattgtgacagtgtactccagcctgggtaacagagcaaaactctgtctctatttaaaaaaaaaaaaagttcccacatataagtgagatcatgcagtatttatctttctgtgcctggcttatttaacttagcagaacatcctccaagttcatacaggttgttcacaagagttgaattggtgaattagaatctgaggatgggggtgggagctggccaaagggagtaacacaggctattaatatctatccagtctagatgttataattctaacattaataaacaaaacttacttaaattcctttgtaaggaataattcccctgtttcatctctatatacaagttgggcttcatctgttactggttttatttttttcctcagcytacagccagttgtggaaggaattaaccagtaaattccaggtcctagttcaccagtccatccaaacaccttttctcaaaacaatgaaataaaacaatcatcagtcttaatcttttcatcttttaatttaaagcttttaatatttcttctgaaagggacacattagaaatgatttttaaatcaatatttacaaattctattatagtcctatcagtctttttacaggtttcaaattctttttgttaatggtaatcccattatgagatcattagatacagcagttctttatatatttttgaaacaaatgcctaaaactgtaataggtaagttatatatcttctaaatcttccccaacaatcttcaaaaatatctgtgatgcaaataccttcaacaggaagcaaagataaatcgtagggtaattttttaatgcaaatactgagctcctttgaaaaaaagtaataatattctagattatggtttcctaatttgattcaaatatatgatatctaaatcagatttcaatgacataaaataaaaattaaatatattttgaaatggtttactatttgtataaattaatcacatttgtaagagctcaattatgtggatgaaagcactggaacttcactttttttaatgtaatatggactataaaataagacacagaatcccaaataaaccagctttatatgaaattctgtttcctatcaaatgttggatatttatcatgggtaccagaacatttgtayaggaaaacattttattctccagttctataaagaaagcaggctgggcatggcggttcacgcctgtaatcccagcactttgggaggccaaggtgggtggatcatttgatgtcaggagtttgagaacagcctggtaaacttggtgaaaccccacctctactaaaaatacaaaaattagctgggcatggtggcgggcgcctataatcccagctacttgggaggctgaggcaggagaatcacttgaaccyggaggtggaggttgcagggagctgagatcgtgccattgtactctagcctgagtgatagaacgagactctgtctcaaaaacaaaaaaacaaaagaaagaaagaaagcaaatggtatctctctatgtacctcctaagagctttttggagcccaaaggtttcctataaaagctagcagctgtctctgttaaatatattaaatctaaacaattcttagttgtgtgtaatagctaagtgcccttcagcacagactaacccaagagaatcctttcacgtattatgtccaaaaattccttttaaaacccaggtataaggccagacacggtggctcatacctatcatcccagcactttgggaagccaaggtggaaagattgcttgaagctaggaattggagaccagcctggacaacatagcgagatcctatctctaaaaataacaacaataataataatgcatctatagtcccagctacttgagatgctaaggcaggaagatcattttcacccaggagttcaaggttacagggaattgcatcactgcactccagcctgggcagcagagtgagaccctatctctaaataaataaacaaacagacaaacaaaaaccaacttaggtatattttaggtcattctggagactcatatatgaaataatgttgctcatctaagttctgggtttagttccatttctgccctggcaactcagagaaatcataatcttcttaaggtcaccaggtcctattttgatacaagaagaaatccaatataaccgaaagtcatttttaagactaaatgttggccaggctggtggctcaagcctgtaatcccagcactttgggaggccaaggcaggcggatcatgaggtcaagagatcgagaccatcctggccaacatgatgaaaccctgtctttacgaaaaatacaaaaattagctgggcatggtggcacacgcctgtagtcccagctacttgagaggctgaggcaggagaatcacttgaacccgggaggcggasgttgcagtgagcaagatcgcaccactgcactccagcctggcgacagagcaagactccgtctcaaaacaaacaaacaaacaaacaaaaatgaaatgtttaccaaatccatcctttgaaaagcataacctttgaaattggctagatgtagactcaggagtgaaaaaccagatcttgctgcttcctaatatatattatcccatgatccttccttatctccacacataaccttgcactgccactgtggatgacaaatggaaagttttttcatgggcacaaaactcatctataagaaaataattgtgaaagtataaatacaaataaaaaatcctttgtaaatacaacatattacagataaacagaagcctataaagaggtaaatagaaactcatgcaaactctattataattttgctatatactaatttttttacacatgcaatctcataagagagtaattttacccaaaacaaagtggaaacagctactgttttagacaatgctttatcttgaacttaactttgtagtcagttctgaagaagagtttagtcaaaacattaacttcagccaattttatttgtttcttgcctattcttgtctgtaaggaagcctacaaaaaagacttttatataacattctatcagggaaatgtttgtgtgtcattgagcctatataaagattaaatatgataytgtagtaagcccttaaatagcattatttctgttttgtgtagcagatgtattttgtagtcctcataaaataaatagccacatttatgtattggcttcacatatttggcctctgagtaaatatactattagaaaagatcagaacaaccccatgggcaacatataaaaacatttaaaagcattttttcatatcaatctatttttgaaccctataaaataagtcaagcctgaggatagtaatcttaagtttttctgttttgcrgtagtagtataagtaagacaaacgtctacagcagcttttccaaagtcttgaattgcttgcatttagggaaaaaaaatgtactggcatcaaccttttttattgagtatatcaaatgttcacacatgaggcatcagggcatttagaaaagatgaaagtaaggtacaatattatacaacttaaaaggtataagccaagactcaagactgccaaccaatcctcaattctttatttaaatttttttttagagacagggtctggttatgttgcccaggctgaagtacagtggctattcacaggtamgatcatagaataatayggctttgaactcctgggctcaagtaatcctcctgcttcagtttcccaagtagcagggacttcaggtgcatgccaccatgcccagctcctcccatccttaattcttaagaaatcgcagcaaacaagaaaaaatccttataattatttaatttaatttaatatgattaaattaaaaacatataatatctatagtgtttaagtgctgtttataccttaattggaaggtatatgaaagcttaaaaaataaaatacagaaacatactttccccaaactgcagttcatactatatttaaaaattaaacattagaaaataaatatgtatacttctctatttcgtagttcggtaaaacacacaagctgtagatttgcttgactctcattttccttgagaatatacaaggcagtatcaacggataaccaaggggatggttttcctacaaacaaaaaaaaaagcccaaacaccttaaaataagcaatcactatctattctttcctatataaaaaataagttactagtttcttcttggatattttctttagaaatacatattccatgtttttttttttcaagacggagtctcacttggtcacccagsctggaatgcagtggtgcgatcttggttcactgcaacctccacctcccgggttcaagcgattctccygcttcagcctcctgagtagctgagactacaggcatgtgccaccacacccagctaatttttgtatttttagtagagacggggtttcaccacattggccaggatggtctcgatctcctgacctcatgatccacctgcctgggcctcccaaagtgttgggattacaggcgtgagccaccacacccggcccatattccatttttatgtgtaaacatgatagcatttgcaataaggcacaaacctaaatacagcaaccttgtgagaaacattttctatatactcactttctaaaaatcataacttttcttgaactcatcaaaagctgaggttgcagggcaaccaattagcctgaaatccaaggaaaaacagagattttcagaaaaaaaagaggatttaagtactggcttacctgtggtggagcacacgaggaagagatgccagacatctatgtgctgacaaccccaaaatttatatctttaggatctttcctctgaatgttagacccatataactgtgtatttaacatttctacctagatttctatttccaaaactggacttccctagtctttttttaaaacgctgcccatctcagttaatggtaactcagtctttccagttgctcaggtcaaaaatcttggaatcttctttaactcttttcttttctcacataccaagaccaatccttaggaaatcctatggttctgccttcaaaatatacccagaatctctactaccccatctcccaccaacatcctggttcaaagcattgccagtcctcttctagaattctacaataatgtcccagctggattccttgctttctcctgcgtatccttccatctactttctttttttttttttaatgtttcaaatctatttttaatgttgcttgtcgaacattaacattttcacaattccagaaatgacattaataaaaatataaacaaattgatataaaaatctgtgtagactaagctagaatttacaaactcttaataaaaggtgtatctaagtttctcaattatgggacaacaaataatagacttcattgcttcatactaaaatggtatttttgactaatcacaaggaaacttaaactactgtatagttataatcataggtattcagtccaaagaggaaaaaagttttagtagtactatgagaacctgtatctctgaaaatgttagctccataagtgtaagcactcccaaagattrtaagataataaaatgtggaaacaggcaaactatggggcgatttaaagtttctaccacttcctaaagattttcttcaatagaatcattcgtgctaagtggataaaagttacaaattacaaaagaaagatacagaatacatccaataacaaattaatcagactaaggaatatttagtgtaaaactggcttaaaattttttgtcagaagaatttctcaacatctaaccctatagcaaataatacaaataacaaggaaattcttcaagcagttggcatttcttcaaaacacaagggtccaactataagaaaaatatcacattattcaaagtcctacagaattagaggagaatctgtactactcatgttttttgcataaattccatgatttataaataaataaacccaaaatataaattataaacatttaatttcagtataatgtagacaaaaacagcagctaacttgtcatctttcacagtaattttaacataaaaggtttaaatatttattttgccaatatatttttcattgcatataggcttaaaaaaaagacaatggaagttataagtaatcccttgacatgtgtaaaataaaattttttagtagatgggratgtattgatgatagtctcttatttcttctcccagatatgcaagcgatatatctaaatacttactagagccaaatctgtctcaaaagtttaggtcatttttttttcctttttgatagtattcaaygagaaataacactttaaataaaactttttccatgaggaaggtacagtaattatccacctcctggatactctcctgtagtcctctgagtaagctccaaactcaatccatactccaagtaacagacttaagatgttcaatattggaactctttggcatcaactaaaaaagaaaccttggtaaaagcagaatttacaaacattttgttccttgcagtacacctttcaaaagacatcttcatcaaataggtaagaaaggtaagaattgctgaggtaagtagwggtctcttttattatggtcttcattctatcattattaaaccttaatctcatgtcctgttccaaagcattatgtgagtattcaatcaaagaagtgaggctgttctccagaattggttctctgctacaggtcaaaaccgactgcgccagccttggcgaagckccgcctactgccctttgctccaagtaatttttggcgatttttaaagtaatttttccggcggagtcatagtggcsctatactcttggataggttatcctgtctcttccgctagattgatgagatcaggtatcactcgaaaatggcgccgaaaagtgctgaggctcctcattcaaattcgttagagccaaccctgccttctacctactttcaatacagtaacctaactgctcttgttaaaatataaatcagattatgtcctgccttctactcaaaaccctctaatggagcagagttgggagaatattgctcctttcctaacaataagaaaaagttaatgaactacaaaatcataacttttcttgatcccatcagagctggggttacaggacaactataagcttaaaatccaaggaaagacagatctttcccaggagagacgagatgcaagcactggcttacctgtggtggagcagaacaggaagagatgtcaggtaccatacaagtggaagaagaagaaagagggcagaagaaatatttgaagaaataaggcagaggattttctaaaaataatgaaaggcaacaagccacatatccaagaagctcagagaaccccaagcaggattaataccaaaaaacaaaaaaacccaggcaacagcatcaacaacaaaaacaaaaactacctagacacacagtcaaactgctgaaaatgaaagattaagataaaatcttgaccttatatatggagaataaaactcacaaaaaacgagggggaaacctcatttctctgatcaaaagcccaagtcctaattatggcaaaaagaaacctcttcctgattttgtccttgtttctccctggtttcatctcctacaactctctcctcacttactccatttgagacactctagcctctgttcttttaacaccagtacactctcacagagcctctgcacagagtattctgtctacctggaatactctgccacctcctccactcttcacccatcccttccagcaccatacacccacaaggcttactcccttgccttctgtggaagacagcaaaaatggctgtccccctcagtatctacagccttttgcaatgtgactttgcagcttttccatcaagagatcaagtctatttccccagcctatgaatctggacttgccttgtgactttctgtgagcaacagaatataacgaagtaacattgtgctggttctgagcccaaacctcaggagatcctattgtgccaagagaacaggtccaggctagtttactgaaggattattaaagatcatatgaggctgagtcaagttgtcccagatgggacttcatacgtaagaaagaacycagccaagattagcaaagccagccaccagctaacctgtagctaaccataactgtgtgagcaagccctatagagaaaaaacaagcctggctcagactaagaactaacagatctactgattcatgagtgaacaaatgtttaattgttttaagccactgagttttggggtagttttttatgtagcagttggtaactcatacatctctttcaaagtctttattcatatgacaccttcttaatgaagcatatactaaccactccatttcaatggcaacccacattccctcagcactcactaaccccctttccctctgattttcccataacacttatcactttcctacataccatgtcatttactatttattatgtttattatgtattgtttccctcactaaaatttaagttgacgagggcagggatttttgtctttttttaactctaatgtatcctaaacacctaaaytgatgtctggtatataaggccctcgataactatttgataaataaatgaataaaggaatcttgttaataagaatacagagaattaacaactacactgaatttgcagggytatcttgattcctctctctgaaaaataactattgttattgtcatttaaaagtatcatctgccaaacattataygtatcccacaagagatgcagtgaaaactttcaaaatctctactttaggagggaaaaagaatggggaggtgggaatcctttagtaagaaaatgcttgtatgtaaacattataaaagaaaaataaatattgatttagaacagccaacattaaaaaaggttatctagggaaatcacccttatagatagatatctttcattgcttaaaaattacataaccattttagacactagaaaagtatttttatctagaatattaccatgaatacaaagattattaataaatattgtctaagtcacagacaaagggttttgaaggtatttaaaaatactttcagcttcatattgttccaaattatccccttgcagtacttctctttgacatattaattttaaaaattgacaaatggaaaaagctaagattaattagcaaataaaaacttagttctggctgggcayggtggctcacacctataatcccagccctttgagaggccgaagcgggtggatcacctgaggtcaggagtttgagaccagattggccaacatggtgaaaccctgtctctactaaaaatacaaaaagattaggcgggcgaggtggtgtgcacctgtagtcccagctactcggggaggctgaggcaggagaatcacttgaatccaggaggcggaggttgcagtgagccaagatcgagccactgcactccagcctgggcaacagagggagactccgtctcaaaaaaaaaaaaagttagttctatatcatgaggaaaccagttaacattttttttcttttattttcttctatcttagctgtagaaaagtttggaaaaagttcttatttttaataaaacatgctttaaacatataaagcaatctacttgcttttcatatgattaacacagttcatgtataagccaacactttcttgaaatgtaaccataaattcttacttaggcagattattttcttccctaactaggactatggaatacttacataagtactttcaaggagggtacaaattgacattttaaaaatatacaaaaaacttaaacttgccttcaacttgactcaggtttaatggcttaattgttagataaaccatggacctctgagctatwtgcatcctgyactgatgactaatgatttcaccatcttcttctaagaagaagcaaccttttgattgcatgtgttgccagtcctgaaatgaaggaaaaaattatttcaaacaatatttattaaatgtttccagtatgcatagtaatgaggagaaaacacagggggatataaaagaaatgtcaaatataatcattgctctccaggaatgtgcaacatagttaggaggtagaaaacagacataacaaaatcctattatacacagggcatggtggctcacgcctgtaatcccagcactttgggaggccaacgtgggcggatcatctgaccaacatggagaaaccctgtctctactaaaaatacaaaattagccgggcgtggtggcacatgcctgtaatcccagctactcaggagactgaggcaggagaattgcgtgaacctgggaggcagaggatgcagtgagccgagatcgcgccattgtactccagcttggcaacaagagggaaactccgtctcaaaaaaatccaattataattggcagtaatatatggttaacacaaaaagataattatacatggaaaataatttactataatctaagttcctaaaatagtgcctaacacattggctcaacaaatatttactgtctaattgattggggttgggggactgatgtaaactgagtgtgcaactgatgaattatatcatgaagaatagatagcatttcaataatgaaaagttaggaaaagatataaggtaaagaagaagtaagaaaaataaagttggctgggcacggtggctcacatctgtaatcccagcactttgggaggctgaggtgggtggatcatgagrtcaggagttcaagaccaggctggccaacatggtgaaaccctgtctctactaaaaatacaaaatttagctgggcatgatgatgagtgcatgtaattccagctactcgggaggctgaggcaggagaatcacttgaaccagggaggcagaggttgcagtgagccgagatcacaccattgcactctagcctgggcaacagggcaagacaccgtctcaaaaaaaaaaaaaaagaaagaaaagaaaaatgaagtattgaaaaaagtaataaataaatatgttgctgtaatagaatgagattagtgctaggagcacagtaagaaggaagaattaaggattgctaaaagaaatatattgaaagaaaaaatgactttaaatgtaagagcaaaataattgcttcaagtgtagataactagaagcatgctgaataaaagtttcacagctggccgggagcggtggctcacgcctgtaatcccagccctttgggaggccaaggcgtgtggatcacaaggtcaggagttcaagaccagcctggccaacatggtgaaaccccgtctttactaataatacaaaaattagccgggcacggtggcgtgcgcctgtagtcccagctagtcaggaggctgaggcaggagaattgcttgaatccgggaggcagaggttgcagtgagccaagatcatgccactgcactccagcctgggtgacagagtgagactctgtctcaaaaaaagaagtttcacagctacagaacaatgccgatgaatataaaatatcacttttgagaaagacttttctatattggctttaccatttcttggtctagccaaatcccttcttgtctgaattcatatatgggatctcataactagaaatgagtaaaacttggccagccacagtggctcacacctgtaaccccaacactttgggaggccaaggcgggtggatcactggaggtcagaatttcaagaccagactggccaacattggcaaaacaccatctctactaaaaatacaaaaatagttgggcgtggtggcgcacacctgtaatcccagctactccgaaggctgaggcaggagaatcgcttgaacctgggagatggaggttgcagtgagccrtgatcatgccactacactccagcctgggagacagagtgagcctctgtctcaaaaaaaaaaaaaaaagaaaaaagaaaaaaagaaaagaaaagaataaaacttgaaaatggcatcttggacacaaagtagaagattctttattgaagttatgagaaaattgtgtcattaccatagctatgtgcaaaaatgcttttcactttattagtaggcttgcctacctgaaatgtaagtaagmatatttaaataataagttcaaggctttaataatattgataactactgaaaaggtgtatgctagctgtataataataacatcataaatgttttctaattcattatagaaagatttattatatcactgcaaaggcaaaaataatttacattgagatcggtttcatgctcacatttttaagagaagactaaattatcctaacatacttacatctcatttttctattttatgtcacaattattttcatattttattaaaaatctctataattctaatgccctacttagattttcatgtaatcctttctaatactgaccttatgtagaaacctattttttacattttaataaacactgctttatgttctgcttttaaaaattaattttatatccaaaatattttgctgttgaaaaygaataaagctagaggactcagactttctgatttcaaaacttactacaaagatacagtaatcaaaagggtgtggtactagcatgaaaacagacatacagaacaatagaacagaatggatagcccataaataaatccttgcctatatggtctaatgattttcaaaaagggtgccaagatcattcattgagggcaaggacagtcttttcaacaaatgaggctgggaaaactgaatatccatctgcaaaagaataaatttgggctcttatcttatgcaacacataaaaattaactcaacctgaagacctaaatatgctaaaattataaaactctaagaagaaaacatagggggaaagctgacgctggatctggcaatggtttctcagatatgacaacaaaagcacaagcaacaatcaaataaattggaattcatcaaaattaaaaacttttgtgcatcaaaggacactaccaacaraatgaaaaggcarttcatgaaatgggagaaattatttgcaaatcacatatccaaaaagggattaatatatagagcatataaagaactcctacaattcaacaacaaaacaaaccaccagattttttaaatgggcaaaggaatcatcaaatgatcacctctctaaagaagatatatagaaggccaataagcaaatgaagagatgctcaacatcactaatcattaaggaaagacaaatcataacctcaatgagataccaccttacacccattaggatacctattatcaaaaaaacagaaaacgacaagtattggtatgtggagaaattggaacccttgtgcattgttgataggaacataaaatgcataaaatggtgaagcattgtgaataatagtatggtaatttctcaaaaaagcaaatctagaattctatatgacctagcaattccagcttctaggtatagaaccagaagaattaaaagcagagactcaaacaggtatgtatgccaatgttcatagcattactgctcacaatagccaaaaggtagaaacaaccctaatgtcaattgacagaaaaatagataaacaaaacatggtaaatacatacaagggaatattattcagtcttaaaaaggagtaaaattctggcacatgctatacatgaatgagtcttgaagacattatgctaagtgaaatcagccagacacaaaaggacaaatattgtatgattccacttatatgaggtttaagtgaatttgaccacttcaaattcagagagacagaaagtagaatggtggttgccaggggctgtggggagggggaaatggggagtcattgtttaatgaatagagttccagatgaaaaagtcctggagatgtatggtggtggtattgatggttgtacaacagtgtgaatgtacttagtgatacagaactgtatacctaaaaatgagtaaaatggtacattttatgttttgtatattttaccacaggaaaaaccattttgctatgcaatattcaaaatttcaatttaaatggttctatgattaaaaattgtgttggggctgggcatggtggctcactcctggaatcccagcactttgggaggccaaggtgggtgcatcacctgaggtcaagagttcaagaccagcctggccaacatggtgaaaccccatctctactaaaaatacaaaaattagccgggtgttgtggtgggcacctgtaatcccagcctcaggaggctgaggtaggagaattccttgaaaccgggaggcggaggttgcagtgagctgagatygtgccactgtactccagcctgggtaacacggcaaaactccgtttcaaaaaaaaaacaaaaacattgagttggtataccattatttagttaactatttctaaaatgttagacatttaggtcatttctaatttcttatcacaatattaatagaatactgttttgtctaaatgcttttcttctgatgaataatttccttgagaacttctaggcaaaaatgtatgtatatttttaaagctattgacatgtgttcccatagtgctttataaaacagtactgccaattttacaataccaccaatggtatataatgtaataattttaccattatttggttagtattgttttataaaaaaattgggtgatgtgggatgatttcataagcaaggtgtgggtacataaagcattcattatggtattccatatatttgtatatgcctcaagtatttgatagtaaaaatggtattgtagtaacttttgcattaatttgaatttctctgattattaataccaaggctgaacatttccctcatgtgtttattatttattttgtataaattacccattctcctattctcataactctgttgcagacttagcatttttcttacatattttaataaattcttttgactattttagatattaaccactctgtgagtgttaatgaatgtattttctctatttccttttattttcattttggttatttctcaatttatacaagttttctatttttatctttatcttttctttggaaatttcttcttaaactkcattttaagattttatcattataaactgaactatactcaagctttcagtcagtcattaatcacctgcactgtcacacctttggggtatacaagatatgtgtatttttaattctaagaaattaagatgtgaccttaacttactgaaatttatcttgttaagtatattgcccatgacagaaagaagtcattatatataatatttcaacaacatcactatgaggcagtatggggtagatatgaattaagtcattttaataaacagaaaaattgaggtagccagagattatatgggttcagagttttataaggagtttgtagcaatattaggtctagagtccaagacatttggcctctacatttagamcaagtttctaaaagaaaatgtactcagggtacgaattcaaattttttattatctgtgatacaatgaggttcaaagttgggcttgtggcagaagttgaagttcaactttttttttttttttttttttttgagatggagtctcactctgtcacccaggctggagtgcagtggcgccatctcggcccactgccacctccacctcccaggtttaagcaattctcctgcctcagcctcccgagtagctgggattacaggggcctgccaccacacccagctaattttttgtatttttagtagagatggggtttcactatgttggccaggctggtctcaaactcctgacctcaagtgatccgcccacctcggcctcccaaagtgctgggattacaggcgtgagccactgcgcctggcccaagttcaactattaatgatgartaatgatacacagactttcatttagcttccctgtaaatctcttggatgggcatatatatggactaacaacagatgctggcattacctcagacccaattgcccttaacataatcaacatgaccttggatggtgatgactgctaaagaatagaaatgaaagaaatgttatacagcatttagacaagttacactttgagacagtttgaattatgattctgacattaaatggaaaacatttaaatgctttcaatcagttttgattatagcatcagatggaatttcatccaatatattttatattttttatatttacctatttggaatggtaaaggataatactttagaattacagacttataaaagtagaagaaatctaaaaagcagtctagtccagacttctcttttgattgacaaaaaagtctgaaaaataaagtgatatatgtgaacagctatagttctcaaytgactgcagaactagaaccaaaagctaggtctccttactttctctccagtgtgtaagttatattctaagttctgttctatttcacatttaaatatctgcagtgattttttaagccagtttttaaaataaactttatgaatatattacaataaagtatggtaaggcattatcaatcgggattccatacttttaagggttaagataaacttaattatttggttttcttactttaaaaatgtagaatttagtagctgcaaaatttcttaaatttgtactgtaatcatcagcacagcagccctacccccagctttaaaaaaatggttaaattaagctttaaaagataatgtactttgcctggtacactggtagtaaacataatttgtgccatttaggaaactcaaagatttcggaagaatttttcaatgtgctgatgctacctctggggcagtgccacagattaacaggacatagctttataaaatttaactggggaacaagttaaacatttttattataagtctttcctaagtaccatgtctagaaaataatgctataatagaagagaatttgtgagtttctttggaaagacagccaaactacatactataacattaaatatggattaatatagctggaaaatggtagaacaacagttattaaagtaagacaaataccacattatttatatcaaccaaacttcagtgtaatatacagatcaatttgaattctaaataacttcactaggagaacttatagctcctactgttcaaaaggaaacattcaacttaagatctgccagagttattaaacatacaatgcttactcaacttaaaatttcttttcaaggctgggtgcggtggctcacgcctgtaatccccagcactttgggaggctgaggtgggcagatcacgaggtcaggagttcaagaccacctggccaatgtggtgaaaccctgtctctactaaaactacaaaaattagccagcgtggtggtgcacacctgtagccccagctactcaggaggctgaggcaggagaatcactcgaactcgggaggcggaggttgcagtgagccaagatggtgccactgcactccagcctgggcaatagagtgagactccatctcaaaaaaaaaagaaaaagaaaaaaaaataccctttcaaacaaatagactttcaatcatacaaagctttttctctaggacctagactaaaatgttatgaactaaaagaaaaaattactgacaaattggctggctcattcaaataaatcagtttgaaaggattatagattaagctgacagtttgagtattaagagaaaaatgaaagaaggttgagttttgaaaataattttagaataagagtaagaaattccatgtatgatataattttttgacattataaagcagaaataaaataatagcttgtaattcttatatagggcatgaggtggtgctgtattctaccaattcaggtaaattcatataagtgcaaactgaactgttatttcctttatttgtcatatacaaattttacttattttcattcataatatataacgaaatgctgaaaagtacaaaaccaaatactaaagcaaaaaattcttgttatcaaaacaaatacatcagtatagtcmcatttttcttggaacactgtagtgaatgaaaatgatttgttttaacatacaaattctgtattattaaaattttcagtgagaaagaattattaagcagtagatctgccatagatttagtcagaggaggaactcatcactatcattatcatcactactgctttttataaagatttcctatgtcacatacttattaggaagctatttgctttggggtatgataagacaggtaggtaaccagttgttgcactttttgttattaaagaattgtaaactatacatacttaaaaaataaaaggttaaatagataatttatggagggtaaaattgatgtggcctgaaatctaattgacaggttgaactgatcaacattttgaaaatgtgagaaacttataagaaaattattatctggagctttcacaaaaaacagataatgaaccatttggaatttcaaatgtttttatttgtattgccatatatagacatacacataacatataaatggtatacaatgtagatgctatatatgttttgacatttataatatataggttgtacaacatgtgtgtgatgtgtgtgcatatgttgtactatatatgaataaaacataaatgtaggcatactctaagaatctgaatataggaagtattgcatctctggagtttacaactgatagtttggggcttactctaattctagacatgactggtcttagcaaggaaggtgaagctattcctctctgaaaggaaaattcctgacattccttgaccatcacagaayctaagtaaatggatagaattcgggattttaaaaagaataataatgcagtaactaagtatggccaatggaaagtaatatgcgtatagtacctgtaaggatcttattttccttttgtaattcaagtcctttaccaattgtgtggttttgtggtttaaaacatggcttacccttatctatcacaacaattttctaatttctgaaaagtccctccttctctgtcccaattccatacttttctgttccacatgaagttgagatacccaaacttgtttaaaataaatttaaagtatctggaaaattaatttaacaatcctttcagtaatttattctgtacattcacaaccaagtacttttcagaatggttataaaacctcaggaatatatgaaatttatgaaataaaaaaagaaaacttcaagtattacwgttcttttagaatttgtctagcaggttctctgtttttccagaaaaccacccaggaagaaacaagacttaaagaaaaatgtggccaggcgtggtggctcacatctgtaatcccagcactttggggggccaaggcagacggatcacttgaggtcaggagctcgagaccagcctggccaacatggtgaaacctcgtctccactaaaaacacaaaaattatccaggcatggtggcatgctcctgtaatgccagctacttgggtagctgagggaggagaatcacttgaacctggaaggtggaggttgcactgagccaagatcccacctgcattccagcctgggtgacagagtgaaactcttgtcttaaaaaaaatgcataaataaataaagaaaagaaaaatgtaaacaaagaactgaatgctgctgaataacaaaagagtcacttacttaaaaaaataataatttcagctcatctaagaaatagatagcaagcaacagtgggcaatatcaagatccgaaacaggatattaaaaggtaagatatacagagctatcaattatttccaaaagacattacattttatatgaaactcacagtattaaaaagttgacagtatgcccttttcttttaatcattaaattatcttwgtaccttttacctaattcccaattatcatccacaccattccctgctcttgacttacatacaaaactttagtctctttgttaaataatcgttatgacttacagactaattttggcatttttctattacacctgcccctatcgtattacattaagtactatcctaggccaagttatcatcactttatatttggaaaactctatcggcctcttagatggtgtctctgaggtctctatatataacacaacagtagattaacttttcttaaactatactttcatcatgtcgttcccatacaagcatccagttatttcttcgttctataataatattaatactagtatttattaatgtcctttgtatataataaatagtattaacattattaacactattctttattaatgtccttggcattgtgctaaatgctttacatatgtttacatacgatttaaatctttccaaagcacactaaatataattactccctatttataggtaagaaaactgaaactctgaagggctgctgacaaattcacccaagatcacacagttattaagtgataaagctaagattcaagcccaggtagatctctacccaaaactctagatcactaatctaatcaacatctagaacactggcacacagtagtcattcaataaatatttgttgaataaatgaatgaataaatactatgctatagtgtagcatataccaaggtagtccttggtatactgttaatagtcaaatgaaaatttatatttttaaattcaagctcatattttacactaagcaaaataactggcacacattacatgcttagtgaatatttgttgaattgaactaaattttaaaaattatattggtatgagcccaactaatgacacagagacaaagtcttactataacttaacataatccacattaatatttatttatatctctctttacagtggctaaaattacatttatttgtgcttttgaatcaggtaaaccataattatttaactaagttaattttattaataattaatttagttgcaaaatacaaaaaggttccattggtggaaagtaatattgttggaacactaaatattgtgtatgaacatgttggacatgcacaccaaattgcttagggtgtatagattcctaaacagtctgaacaaaattccttggagataatgttttaaaattttaatatagaacaaatgtcactctctagcaatttaaagatataagggacttcagagttcaataacaaatacagagttgttatttgaaacaaaaatgtggctcttgagagcaatcagttcagttttctaacagcagttatagtatgtggtcataaccattttttccccttttacagaggtctctagrtgcacatttttaatgtatcctagcagtttccagttaatgttttatatttctgtaactattattttctgttgaaagaaaactagtaaaggttgagtctagaaagggaaaacaaagaaagaagatcaatattaacactctacaaatattgacttagcaaagtgactttgttgtcattctctcacaggaattgaaattgaatgaatgatttatttatatgaaacacctatggtgaatatttgttaaacaaaacaaaaaatttgcttcccaaagtatataacttgataatctactcatcaggttataaaacttgagtgttaccattttcaaactgaagaccttataataatattcatcatttttaatttaaaagtattacactagcttacaggtagaaattacacagaaaaacctcaaattacttcataaactttactggttccctgtagacactgcacagttattaataaacttaatgtcaaatttttttcagaaaaagtcatctgttaacttaaaatactrtacctttattaaatttggctccrttaactttgagtttcggttaccattagcccccatggtaactrtgaaggaaacagatgttttgaacttcctggttgctgacagtaaagaactcctggtgtcacctgcaacaagtaatgattatttggtctgacattatgaaaagttgtcaataggagttttttccaaacacagtgcagtataaaagatctactgtattactttgattctctttgttctccctattgaaataaagtcagaagttttatatttatcaggctttaatgatccctaatttatgggcttctaataagaattcttatttcaatatgtcacctttcagtctgaaattttagttttaataaaatataatgagcatagctaagtcaagttccataataaaattttacttcaatmgatttttacagctgaaagagtctagaaatagtagctaacaaaagttagattctcatttgttttatcactgataagctgaaatggaaggaaaaatttatctgaatatgactcttcatttctgatcaagaaattcttagtgttaaaagtaaatacctttatttaagaatgtttctggatcagtttttcttgtgattttaggtgatggttttggtactggtgatgggtccctttcaggggacccttcgatgtggtttccaaactggtgacgcatcaatttactgtcaacytctagtttttctagtgtagtcttgagacattgctcgttggttgtcatatataatttacaaaactacaggaaaaaaaaagtccartgggtaaaacattcartcatacactggggaagaggagaaagcaaatgcacattagtaggcaaggaacagactgatagatggaatatatttcctattgatggttacgcattttattkttttgaatcagattgaccagcctcaagtgacctagtgaaatgtagccgtgattcaatgaggagttcatactctgtgtgaaaataaaatgttacacaaggagaggtgatttattattatttttttacaagatgtgtaggcttgcatttgttcaaaataatttttatgattcttccaccccagaaaaagtacatttctgagtagagtctctatgtttatgtgtgtatctgtccgtgtgtgtgagcacacatgttttttaacttggttatattattttaatgtagtcatcagattgcaattatgggactggaaaaattaaatttcatgcacaatatttaaggatgtcattgccaatattaaaaagatgcatccctttaaaaataatttgctgacatgttaattagttgacatgttaactgatttaattgtttcacaatgtatacatatatcaaaacattgcatgtacactgtaatgtcaattataccttaataaagctggggaaaaataaaaacacttttccaacacagtatgtaaatttacatcaatgtgagcttatgtaccttgatgtagtcaaatttgccatcagcatttacatcagccaaatttattatggcatttacttcttctcgagtcatcttctcacctctctgaaaaaaaaaaacaagatttattttaaagcaacatgattactcctttgttattcatggggacagtggaagcacattttaatcttttccacaagtaagtctgaatgtattgcttcattataaatcatgagtattatatataaagaaagaatgaggcggctatataaatttcacaattttattaaattttgtgaaagtgtgctgaatttcagtttactaaatagtaactaacaattgaatagtatagagtcagttataactgctattgagtttaggggaatgatattttctaacattgtatcaaaaaacagaatggattcctaatcccatttatatttggttttccttttacttatcacatatggaactatcactgattttcaaagagttctgaacaggaaccaattaaataggagaacaaggggatggtaacataagctcgattttatactttatcttttatttacaaagaacatttcatccagaaggattcctaagtacgttataaataacatgtaagtaattcatttaacctctcaatgaaatacttatttttaatgtggactttggtagtcaaagctagattccaagctgttttagaaaatatgcacattacaaaacagttttacagatcttacctttgttagaaatttataaaggtcagtgtgtaaaatacagccatcatcatttacatctaattgcttaaawgattttagtagttctgcttttgaagtaggtttttccttccttaaaattatacaaaaatcatcaaaattcagtttggcagtttgaggagtccaatacttattaatggtcttttgggatggatttcttcctgcatgctgaagagctgcccaacaagacaagtattatttgtgattgtaacacctggaatttgtacttaagcgcatttttttcttcaaatcattatgtattatgatatttacaaaacactatacatataccagtacattactttggtgttgacttatctagtgataccaagataggcctgactttgaaaaacaaaaatatttatgccaccacctaaacattctttaattattaataccagaattaaatagattttccttattctgacagtttggttctcaacctacatggtttaaataactaacaatatctgattacttaagagcttctaaaagcttctaaaggaaatacaagattaaaaacaaccatccacttaattgtttgggggacaaaaggataacacaaaaagtataaattagtactttttctggctaaataaataccttaatgactattcagccataaagaaggaggaaatcctgtcatctgcaacaacatggatgaacctggaggacaacatgttaagtgaaataagctagacgctgaagacaaatacagcgtatctcacttgtgtggaatcttaaaaaaaaagttaatatcctagaagtagagaatagatcagtggttaccagagactgggaaggggaacttaagtactatctaagtactctgggggtaggggaggatggggagaggttggtcaatgggtacaaagttacaatcagatagtgggaaataggttctgctattctattgcacagtatggtgactatagttagcattaaggtactgtatattacaaaacagctagaagagaggcttttgaatggtctcaccacaaagaaaagataaatgcatgcagcgacggatatactaactaccttgatttgatcattatacaacatataaatgtattgaaatgtcaaattgtaccccataaatacatacaatgtgtgaatttaaaaaacaaatatcttaatgaaatgagaaaatcattcatttaagaataccaatgtcaataaggcacgatatctaaaatgttcatctttgctaggtactaagctttcaaaaacattaatcatgttccaaatgtcaaatatatgcacataaagtatccctttgcaggcatggtcctgctaaaaatcaagaatgtcaatatactgtgagagaagattattatagagatgctatggtcaaactactcttcatttttaaccatatccttctatctatgaagagcaaagaagtacatgtgagaaaagctttgtatatttatgtatgtcatatcactctaaaataaaatggttaaagcaactgcagatattttgaacagttgaatagaagtaacttggtaatttgcaaataaatctctgcatactgaaatataacattttctaaaatgaaccaatgataaatttcctaagcaccacagaaggaattaacataattttaaaagatacaattgtcctgaattgtactgccaaattctattacaaaatcttatattggatagttccaactatctttatagaaattcacaagatctgcgcatcaccaatcagcatcaaaaaatgataatctggatattgtacaatttaatgtaataaggaccagtaagtataaaacaatttcactaaagaaatatcctcatggaaatagaaaccagatcagggtaataaatacagatataagtgagtcagttatattgaacattattgtgcacaagtatagtatagggtgatttttgttcatcaatacaaactttttagttccaaagaaattttatattctagactggcgtggtggctcacacctgtaatttgggtttacaattatactttgggtggccgaggtgggcaggtcacctgaggtcaggagttcaagaccagcctggccaacatggtgaaaccctgtctctactaaaaatacaaaaattagccgggcctggtggcctgcgcctgtaatcccagctacttgggaggctgaggcaggagaatcgcttgaacctgggaggcggagactgcagtaagccgagattgagccactgtgctccagcctgggtgacagaggaagactgcatctcaaaaaaagaaattttattttattattattattattttttgagatggagtttggctcttgttgcccaggctggagtgcaatggtgtaatctcggctcactgcaacctctgcctcccgggttcaagcgattctcctgcctcagcctcccgagtaactgggattacaggcatgcaccaccacccccagctaattttgtatttttagtagagacgtggtttctccacgttggtcaggctggtctcaaactcccgacctcaggtgatccgcacgtctcggcctcccaaagtgctgggattataggcatgagccaccgcgcctggcaagaaattttataatctaaataggaagtctacatctgactgtaaaattgctatctatggccataactcatgggttataacatattaaaaatccataaataaaattctcttctcctctagattatgccagtgactttcagagctaacagaagttgtagttgtggtaaccgccatcttccatatacctataaaggctttgtggaaattcattgcattggagataatataaatgtttttattcccacagttttattttggatgtcgacaaaagccctgattaccatgctgccctagcaacaacaggtaagtaagtattttgcctagtgtgtaaatgaactattccttaattcagctgtttacagaatcaaagaaatggcaatatgtgttttaggattccaaccccagccagctcctaccctttaaaagctgggaatacaagtagatgtaaatgaagttgtaattttttttttgcctctaaaatatttttattttaaaaaggcttagtgtgcaaagatgtttatcatattgctacactactgctactaataataaaggaaacaatgttcaaagaatcaaggagtggttaactgaatcatggtacatatacagaacrcatttacacaactactaaattatttttatgacaatgaatattatataaaatttcctgcaaaatttcttccttattgttaagcctaaagtgccttttttctaaggttcttttttttaaatctttaatttttggagatacatagtaggtgtataatatgagattttttgatacaggtatgcaataattacatcagggtaaatagggtatctgttgcctcaagcatttatcctttgtttcaaacaatccaattatactctaattattttaaaatgtacacttaaatgattttttttactagtgtcaccctgttgtgctagctaaatactaggtcttattctttctatttttctattttctattttctccccctacccccactacctttctcagcctctggtaaccatcattttactctctatctccatgagttcaattgttttaatttttagctcccacagataagaaagaatgtgtgatgtttgcctttctgtgccaggcttatttcacttaacatgatgacctccagttctatccatgttrttgcaaatgacaggatctcattcttttttatgatagctgaatggtastccactgtgtatatgtaccactttttttatttttatccattcatctattgatgaactcttacgttgcttccaaatttgggctattgtgaatagtgctgcagtaaacatgggagtgcagatatctcttcaatatgctgatttccttttggatatataccaagcagtaggatgctagatcctatggtagctgtatttttagttttttgagaagcctccaaactgttctccacagtggttgtactaatatacattcctaccaacagtgtaagagggttcccttttctccacatccttgccagcatttgaagtccacatgaaagaaaattatatcttctgttcagttttgagaaaaaaggtatgtaactttttctcacaagtggtagcttagcatatgcttgctgctatctttagtaacaaagaaaatattgttttaaaaaatgtactggtaattagamaagaacaactttctcagaataaaattaattatgccaaaacatgtactcagtaagcagatgtccccatagctaagaaattgatacaatctatttcctactaactttaatctctaggtttagaattagctggatctaatgattaagtttgatgatagtaaaaatatcacgtagctgtagatrtttaaattttgacaccatgatatggatcttttgccagggtttactttaaagttctgacatgcatctataatgcctgtattatttataaattgacaaaaaaggaacttaaagctatagtaatgctaccgctgtctctgaccttaaaatggaaatgcacdtaagtggcagaaggatatagatgaaaggtgtagcaagaagcagcagctctagttcatgttactcctttttaaaaaatagtttatctaaaatcaattattacaacgttaagagagtattccaccctaaaaccaaaagtgtatataacactgaagagacaaacactgtatagttatcctcccagataatttcataagattgatagcaccttagtaatacatacacattgattcacaaactaaatgccatagtagtggaaggcatgttaaacttttaaacttagcagattccttctcttagtatattttcaaaacagtaacaaaaaaaaactcggattattttagaaatwatggcaaattagaagtaattttaatttattggccaggcgtggtggctcacgcctataatgccagcactttgggaggccgaggcaggcagatcacctgaggtcaggagctcgagaccagcctggccaacatggcaaaaccccgtctctactaaaaatacaaaaattagccaggcatggtggcgtgcaactgtaatctcagctacccaggaggctgaggcaggagaatcgctggaacccaggaggcagaggctgcagtgaatcaagatcgtgccactgcactccagcctggaagacagagcaagactccrtctcaaaaaaaaaaaaatttattggatgtctgcctaaacatttaatgtatatgaattaaacacaaatacttaaaattcaaaatagagcattttagtaattttaaaattatgtaaatcaaaattaaacatgactttaaaagtcagtcatgtgcatttgcatttaaactactttacaaataatgtattttatttagacatcaaataaattttaatcttgtcaattcttgtattcctcaaaatacatttcctcaaatagatcttattggatacaaactcaagacactgctgcacaaatatgtcagggttttggtttaagaaaattcattataaaattggcaaaataactcagtttctctacccataaagttattagccttgatgaaactgacatgagtagtcagtgttatctagtactgttgtttactactctctcatgactaaagatgtccaaatcatttgatactcctggaaagaaccaaatttggtggttttggggacctttgtaatgagaggaatttttaaatgtgataaaggacagaagcaataaaagacaaaacaaaaaataaaaataagaaataaaaaaaccccaactcaattctcttttaaaagttcacttatctctcagtacttcactttttcagacattccacccatttttacacatcctttacactttcctcagtatgggtcaaattcaggctagtgacttaagaggccaaaagcgttttaattttattatgataaatcttaaagcaccaaaatgagaattaaaagtatcttaagcaagtagtaattgatagaagctttcaattacccatctagtttgtataaacattgaaagttttattttgtagttcctagaatatgtaactatatgatatgacataatagcttactgtagttccattgctcaagcttcactaagaaactgggatgattcaacaaggtaattctaatttcagtctttyggacctatttattaactttcaacaaaaaggtgaaagatttaaaaattttaaaaatttacctaagtaaagttgatctttagaaataatgttttccaagctgcttttgaagacagttaagtaggcagctctacaattcatataaaatatttcctcttcagttagtggaawtttctttgttcgaggactctctgaaggtgttgatttctgactggagaaagttgcrtcgcttcgtggactgatcgccattctattggaaaataatttaaaaatgtgtttgtcaatgtgagtcactaaaacacaaatgtcaccatgtctttcaaatacagggaggagaatcaagattttatacgtagaagaaaatttataacatatatgaaaagatcaagatattaaaagttttatatgtggaagtaaaagacgaatactatagttgtatatggacgtattatatattaaacaagaataagcctttggcagttaatttctaattttagatatatacatatgtatatatataattgttcaaatatgtgataatagccaaaagaacaaagatatacacaagagaagaatcactgaacaaaggaagagcacacatctattctctcaaaatacgaaagtcagatgacagtcttcatcaggtttttaagaggagcaaatcagttaatacatgtgaagcatatacaatattgcttgacacgtagtaagtgctaaataaactgcagataatgagaaactccagaataatgagaatcgggatatgagtggtagytgacacccatcttccacagcaggatcaacaagatcatttcattaacatctcaataatgcagccccacatttcaaatagctatattttaaaagtcttatttatagcattatcatagttttactgtgttcctttattaataacaatatttggggtttgtatagcacctctgtayataagagcttaaagaactgtcatacatcttgtcttatccctrttacagcggtcaggtatttttttgtccgttttacagatgaggaaattgaggggtagcaatgtcacccagctagcagtaagtggcaaaaagccgtaaatttcacgaacagtttcttctttgttaatgtggatatagtactgaacaatggttactatggggtattagattctactggtggtctaacagcttccartattactctacccagctttgacttctaaaaatagatctccaacctaataaattgaatatttcaagttcaataataagatracacaggtagggtccccttcaggactcattgcattcctactcaggaggcctaaatcacttgcaccttttcgaattatatagatcatttacacttgggaaagaaagataataattgcttatcatggatgaagtaccctatttataatacgcaggccgcctgcctgacactttcatattacaccagatttagaaggaccccacagggatgtggtgtcacagtctggttactgcaaattggtaatactataattaagcatcagagttctaaacacatatgtgtgcatgcatctcctcacaaatgtgaaagaaaactgtttcaagaagtaagggagaatgaatttcactttgcaataagcaattttaaaatataagtatattttaggatcgtcctcaaatattctttccaaacaaggcaactccctcacatggaaatcccaaggcagaaatgtgccagaattttattcttttcctttctgtgacgagaaaccaaactaaagcttaaataaacatataattgcaccccccgcaggcttggaaacctcccttacttaaaactccggcccgagactgagacaggggcctagagagtacattgcagcaaacrgctccataaataaccagccacacaatagcaagaaaaataaactgttaacaagcgcctaaggcttctacagggccaagtgaaaacagaaagccgtccagtcaccgtccctacacagtgaaataccgtcacaggtaatctcggrcaccatctctctatttttgtattcctctggaaataaaaccgcatttacatgtacattttaggtacatacatggaccaaatgtttatgacagagaagtagacaaagcagaggaaggagaagcagctgcacagagagggacagagggagcgaagagayagagacagcgagctgtttgctacctaattctarctcacaaacaaggaagcgcagccaattctcttcggcgattcagcgttcctctcaccgcagctggacagatctcggcctttctctaatcaccatggcaactgcacctcaccgccaccggaaataagatgcagagcccttctccaaacgatccggctagaaatctaggaagcgctgatccggagcgcacagagacagctgtgttgctcctctatcgcgggggtggtatggccagagtagtgagagaaggtgctctgttacaccagcaggaaataggtgctgtcctgggcctagaactccccgctcgctcctttgctcgcgcacacccggatccttcgtcgyggggaggatgtttccgcccggccgcggtgggcttgacgcaacgtccagcgcgygcttttcatkccttggcktttcctttggcggattttctgttttcggaagttgctgggttcgttttattcagcggcagtggtgctttcccgaatctcagaatgccgtaggtatctcctccccaggtattgctgttttgggggccctctgcaagaagagaagatattatgtggcccagtagcctttctcgttttcctattttttcggagtatgaacttgtctcctctgtccacaggcaattcccttcgcttggtaccctcaactctacgtctcctccagcggtactcatacgatagtcctccttcgctttctgtttctacgatgcttttgacagatttcgtaaactgtgggctgtatttaggtgatgtctaacttgaaataacataaataaggttgacacacaggatgggacagagtagataaaaacacgccttcgtagtttgtcagtcccttgccttcattaatgtggcgcgttcgtgtaaacccgtgggagaactcatggactgagtgggtctagatacctggattccagataagactctttcactgttgggcaagtcacttatcgaccctgagcttcgtttttttttacttacacaaataagtttgtactgcatgatctctaaattcccatctatgaccaataatctgattattgagaatgaccatagtgggaataggcattgtgctagataagattcatctgtttttcatatccttcatccatcctatattgagatgcataaaatagttgctaccctatagaaacttaaaaaagccattaaaggttgggggagtggggtggatatcaaacacctgtaatttctccttggccgtccttgtcctcaggttgatttargtaccccctctagtgtaacctgttccttagtttatttcaggattaagtaaaatgcaaagtaacacagctggggaaatttttgtatcaaataggaattgacatgaaaggggaaagctgtacagaaatgataacctatatttattgaatcttgaattacaatgtgggtgctgtattaatcaatttatctacgttttttcattgaatcctaaaatactttaggggatgggggctgctattatctttacagataaagaaacccatcacctaatagggtgttcaacacagctgccaataaatgcatgttttactgatgcccttaaaagttatggattattgaggaggttttcctttccccagaattaagcaaagagacttgtttccctactcttgcattagaaaaatcatccagttctcaaataaacaaagctgcaaagataatgtcacacaatcacacacacaaaatccctaagaatacagtgaaaacagaggtgtatttgccaaacaagtggtaatacctcctgaactgtgtgtatctgtgtataggagtggggaaccaaaaaactatgaaaagtggaactttttttttctttttttgaggcagagtctggctctgttgcccaggctggagtgcagtgctgtgatcacagctcactgcagcctctacctcctgggctcccacatgccaccatgcctaatttttttattttgtaaagacagtgtctccctgtgttgcccagcctggtcttgaagtcctgggcttaagtgatccttccacctcagcctcccaatgtgctgggactataggagttagccactgtgtcaggcctaaaagtggacctttttgacaactgtcttcctaacatatgcacacaagatgttatattaggcttttagataagtatattctggtaataaatacacaaccttaaagttgaggttaacatctcacatatatagctaatatatatgtgaaactagcaattactttgctaattttctaagttttagcaaagtgatttaagactaaatcaacagttaagtaatgcataaaacgtaatggcatgttagtagagaatctccatcattgttagtaaattaagtgtttttttttttttttaatgtggttactggtgaggtcataaatgagtggtgcaaatagttatcttggcaagttacatatgcrggtggattcatttttaagtgatgttgaaatggtgactatttggtatgtatttggaagactaaatgtgtaatataacttatgggagggtgtgatctatcttttttctaatttcttagaaccttgagcggaaaaaacttcaatacaacaatgagtagttgtgaaaatatatatggtccaaatgaatctaaaataaataagaaacagcaaatgttcagtgacaatagagcggatggatgaatcttaacataatgagtgaaataaccaatttgtatgagactacatttgttatccttataaaacttaagaacaygcaaaaataagctacttatggttatatatgtatatgataagattattgttaaaaggcagagaaatgataaatacagagaaatgataaatacagtttaatagatgccttttgggggaagcmaatagatgcatgtatacccagtcatattggtaatgatctagttcttaaattatgtggtgagtttatgcgtgcttattttctaatgttttataacttgcacagcttacattttttcattagtatccattattcattagtattacatttattcatttagtatgtactacttaaaatgttttttaaaaggatttagagattacctatcttaagtcctccctaagtgtagctttctctgccttctctttgatcctttggaggaaacagatgaattagataaatgctgctgttggtttcattaggctaatcatcttcccttccaatcttgctcctctttctgtgtacattctgaaattagtggcacagtcatttctctatctaggttgaaaccttcactttttaaagatttgaagtggaaaaatcatggactttggagtaagacaaaccaggatttgaatcttgagtctgttaaccagctgtgtgctccttagattgttactcagtgtcctcattgataaaatagttgctcaataagtatttattaattdgataaagttgctactttggaaagatttcattctatgtagacagatacatgtctttttagtagctcttgctgtaagtaatcaaatcccattctagaccttttttcttcttctaccttttctttataaagcttcctttaaaaagtaccatttgtttagtcttgctaattagtgtacatcatcatgctaattcagccaaagatactctctaccagagttaactttattctgttccaagctatgactgaactaaagctataaagttggaatagcattagtgttgtagaaaaactattcgtaacagtaacagtgggggccattctgctgctgtatttatagtctgagagttttctgagagaactttaaaatgtgctatattttttccaagataagggaaaatgaatataaacatattctggatctttattgtgcctatatgctgtaatcattttgatgctactgccaggtacaatgatttttattttgtgggttgattataaagaagtaggtgggtggaatgatgtgtcaggccaagtaaaagttaaccattaaataaacatcctttgaattatagtagatattcaaagttatataatttcttttataaataaagtgtcctgcattttaaaagaagattggtgaaatttttagtacttgatataagaaaaatatgaaatttaaatgcaattctttcctgcttgtaaaagtcagtaaagtctaatagaggaaggtataatagagcctttttggctgagcgtggtggctctcacctgtctatttaacttagaattttttgacttcataatagtgtgaaagcartatgcattcagtagaaactactttaagtacccatacaaccattcttttctttactttcagcacaatattcaataaattacatgagatgttcaacactttattttaaaagagattttgggttagatgatttacccaactataagttaatttaagagttctcaacatgtttaagctgtgatgttcagtaggttaaatgtgtgaaatgcattttcaactaacattttcaatttacaatgggtttgttgtaacataatcctgttgtaagtcaaggagcatctatatattttttgcttgcaacttcttaaaaaggtgagaatgtttaaagcaaaaattaaacactattatggggttatatgtagacataatatatatgataccagtggcacaaagtgtagagggagttgactataatgttgcaagattcttctcttttacatgaagtagtactgtattattataactctagatagactgtggtatgttaaaaaggcatactgtaatccccagagtaacctctgaaaatgcagagaggcatacctaaaaaacaaatagaggaattgaaatgatatatttaaaaataatgttaattcaaaagaaggcaggtaaaaaagaacaaaggaacaaaaacagatgggacaaatagaaaacaactatctaaatggtagccccaaccagataattacaagtttaagtgcagtaaagacatcagtgaaaaaggtagagaatattataaggctagatttttttttaaagcaagtcctaactctttactgtctataagcaacaaagttgaaagttaaaaaaaaaaaagaaagaaaagaaagggaaaggtagatataacagtctaacaggagagaaaacaaatgatcaatatccagaatgaaagggtaaattgtacttagatgaaagagaacataaactatcaatatccaaaatgaaagagcagaataccactaaagatgctatagatattgaaagaggtaatatcattaaagcctttattccagtaaacttgacaacttatacaaaattgacaaattccttgaaaaatacaacttagcatgatggcataagatgatacagaaaatctgcataattaaggaaatagaatttgttactaagaatcttcccacaaagacccagacgatttcattggttgattgtacagagaacatacccattcgtgagaaaataaaaccctcagcaaactaggaataggaggcaacttctcatttctttgaaaaacctatagataatatatttagtatcgaaaacttttttaagattaggaaaaaggcaagaacgtgccctctcaccacttctattcaaaaaagcacacacagaaaaacacccatagtgttaaaaaggaaaaagtggggccaggcccagtggctcatgccggtaatcccatcactttgggaggctgagacaggcagattgcttgagcccagtagttcaagattagcctgggcaatatggcaaaacgctgtctctatgaaaaaatatgaaaattaacaaggtgtgacgttacgtgcctgtagtcccagctacttgggaggctgaggcaggaggatcacttgagccgaggaagtcaaggctgcagtgagctgtgattgtgtcacttgcattccagcctggatgaccctgtctcaagacaaacaaaaacaacaacaacaaaaaaggaaaaagtaaaattaatgattcaacaatgacatcatgtatgaagaaaatcctaaaaaatctataaaacaattttcagaacaatttagcaaggatgtaggatgcaaaatcagtgtacaaagatcaatatatttctatatttcaggaataaacacctggaaattgaagtttaagatttttcatttataattacataaaaacatataataatttagcataagacatgcaagacctctacagtgaaaattacaaaatgttccttagagaaattaaagatgaagataaatgagagtatttttatttattttttatttatttttatttatttttatttttttattattatactttaagttttagggtacatgtgcacaatgtgcaggttagttacatatatatacatgtgccatgctggtgagagtatttttaastgataaatgtggtattattaaaatgttagttctcaccaatgtttagatttaatgcaatccctgtcataatcctaacaaacatttctttttaagttttgctcyttttttatttctactgtttaaaatggatcttttttaaaaaaagttaagtggatgaaaacttgtataatagtatttggtattatctttatcttttctgttttatatttcatttttcatgtaatctaattttccttctttgtactttctttttttgagtatgatcatttatacctaacttatttgtttttattttttatagactcagggtgtatatgtgcagatttgttacaaggatatattgcataatggtgaggtttgagctcgtaggtgcccatcacacaaatagtgaacattgtacccgaaagataatttttcaaccctcaccttcctcccatacttcctccttttgaagtctcagtgtctattatttccctctgtatgttcatatgtacccattgtttagctcccactaatagatgagaacatgtggtatttgcttttctttttttttcttttttcttttttttttttttttcatgaaacaaggtcttactctgtcacccaggctggactgcagtggcatgaacatggctcactgcaaccttcacctcctgggctcaagtgatcctcctgcctcagccttccaagtagctgggactacaggtgtacaccaccacactggcctaatttttaatttttttgtaaagacagagtctcattatgttgcccatgttgatctcaaacaatcctcatgccttagcctcctaaaatgctgagatcacaggtgtgagcactgccacacccagttgattttctttgctttcctttcctcttttttctcttgttttctttcttttctttccttttcccttcccccccccttctcccccaccttcccttcccccgctccgcttcccttcccctcccctctcctcttttttttttttttttttttgagacatggtcttgctctgtcacccaggctagagtgcagtggtgcagtttgctcaccacaacctctgcctcccaggctcactctggactcaagcaatctgctcagctcagcctcccaaagtgttgggattacaggtgtgagccaccatgcctggcctaattttctgcttctgagttattccagttaagataatgatttccagctctattcatgttgttgcagaacaacacggtatcattcttttttatggctgcatagtgttccatggtgtatatataccacatttctttatccagtcatccattgatggacacaagatgattccatgactttgctgttgtgaatagtgctacaataaatgtacaagtacatttgtctttttgatataatgatttattttcctttgatagatacccagtagtgcggtggttgctgggtagttcyttttttttttttttttttttttttaagttggagtcttgctctgttgtccaaactggagtgcagtggtgcaatcttggctcactgcaacctccgcctcccgagttcaagtgattctcctgtctcagcctcctgagtagctgggactacaagcatgcaccaccatgcctggctaatttttgtatttttagtaaagatggggtttcaccatattgatcaggctggtcttgaactcctgaccttgtaatctgcccacctcagcctcccaaagtcctgggattacaggcgtgaaccatcgtgcctggcgttgaatggtagttctatttttagttcttcaagcaaacattttttagaaattgaaaactgatttcaaaatttgtatggaaaggcaagtgacttgcagtagccaaaacaattttgaaaaaaaagaatgaagttggagtatgtacactaactagacatggcataaagtgttggtaatgaactcaatgtggtttgggcatatagagaaataggtaaatagaatagaatagaaagtccagaaatagacccacaaaggtaccaaagcagctcagtggggataacagaagattttcttcccaagtggtgctggcatacccagtggggaaaaaaacaaaacaccttgaccttcaccttatattacatacaaaaattaatttgagatacattttagtcctaaatgtaaaaaggaaagtttctggagggaaatatttgagaatatttttacagtctgaagtaggtgaaatttcaggcaagacgcggaaagcaataattataaaagaaaaaatgataaattatgcttcatctaacttttaaacttttgctcatcaagagataccgttaaaaaaagtaaattttctgtttttcttttttttttttttttgagacagagtctcgctctgtcaccaggctggagtgcagtggcacgatcttggctcactgcaacctccgtctcctgggttcaagcgattctcctgtctcagcctcccgagtagcggggactacaggtgtgcaccaccacacccagctaatttttgtatttttaggagagatgggcttttaccatgttgaccaggatggtctcagtctcttgaccttgtggtctgcccaccttggcctcccaaagtgatgggattagaggtgtgagccaccatgcccagccaaaaaaagtaaattttcaaacaactgactgggagaaagtatgtaacagatatatatcagacaaaggatttatatttaggataagaaagaactcttactaatcaacagtagaaagacaaaaatgttattaaaataatggcccaaagatttgaaccaatagttaataaaagaagatacacaaatgaaccataacatgttgctagacattttggcagtttcttatgaaattaaataaatatacacctacccaatgatctagcacctctacttctaggtatttatttatccaagaaaactgaatgcagtatagctaaggaaaacaaaacaaaacaaaaaaacttgtaaaaggtgttcttggaagctttactcataatggctaaaaactaaaaccaagtgtccatcaacaggaaaacaaataaatggcttattaagatagaatattaattaaaaataaatgatctactgatgtgcaacaacctgggtgaatctaacagttatgctgagcagagaaaatagacacaagtacatactgtatagttctatttatatgaaattctagaataggcaaaagtaatctatgctggaaaaaattagaaaagtagttgtgtatggtatagattatggacttggagggagcctgaggtaccctcctcatatgattcaaatattccatatcttgatatggatgtgagtttcagggatatagtacatgtttgttaaaactcgcatctatacacttaatatttgtgctgcttgctatatgtaaattttacattaaaaatattaggcaaatactgaacttgagtaagagatttgctttccatggtagtatgtgttagcacttctgaaactagtttttatgtgttctaggcttggtcaaatgagtaagtgtattgtggatgatgggagccagtttctcacctttggatggaggaatttcaaatttcttgacttggcattggagatgtcaatatgaaatcatagtttttaaaaatatacatattaaagatagaggtagatagaaatgtttttgtgtgtgtgtgtgatgtgtgttccagctctgtcctctgagagagactgtaagcgatgacgtaagtaacagtgaacacatttagtgcccagattttggtgtctaaataccattgtccactaaaaagagctaggtctcattggagaaaaagctgattccaaagctggtgcagagaaaactttttgtgtatgctggaaaggtaggaagtgctcaaagcgttatgggtacataggttaaacaggagccagggtgaaggggaagaatggtcccattgccaaatttgggacagttaaacatcaaaataaataatgataggaatggcttaaaatccattggctaacataaaaatctgtgacactgtagtgatataaatgaataaaggaaggagaactgaaaggcttttcttggaatgtaatgctaactaataaatataaaaggaatgatcattagtggctctttataagatttcttatttactacattggagaaaactggaagataatatcttaatggtcaaaatttatatcactgatattacaatacatcaagatcaagtgcctcaagttatgctctcagaaggatgcaacatcacttctgtgatatttatgccaaatatgcataacctaatcatggggaaatatcagataggcccaaattgagggatagtctacaaaaataaaaataaaaatggcctgcagtcttgaaaaatgtccaggtcaaggaaaacaaaaggtttacatttaaggagtcacatggaatgtgaatttggccattgcctttcatcaaaggatttctaagaatctcacaagcatactcagtaatactctaaacactcctgtgaagttgtagctggcaatattatcatctctattatagtgtggagtaaatggaagcactgaaatactcagtgatatttttatcttccactcagaaatttcttactactttacaggcctgtgttattatcaactttatgaagcttagtgagattatgtgatttgcccaaccttagggaagaatttggcatagcatgaaggctccctgagtcttaactgctttactaagtttattctttaccccccattcttcccctcagtcctgttattcaaaattgtatttaaactaatgttttaaaagttctataagagaagctcaaatcataaaattttgtgattttctgaggtgtcattcctggttttttattaggaatcaaatgatagggttttttttycctagaataatttctttaatactgtaactgatgttagtcartaacattgtgtaataaaactcatctgctttttctgttctgatgaaccagagaatcctattcaggatactaccatatgttaagctaaatagaaaagaggtcartcttagagaataatataattatacaaacatagttactctctctataaaattgcatgtcamatgctttctatctttttaaaattctcaacagcagtatttctggtagcaaccagaattttgatcccagtgaatctaaacctagtatacctagaaatataatataacttgtaaattacgggcataggtggaaatttgggtaagttggaagttagaagtcatccacagagaggttacctgtaaaagggaggtaattaggacacaataagtagatatcctttaaaaaaattatctatttttaaattgtgctaaattatatataacaaaatttactattttaatcattttttaggtgtccaattcagtgacattaagaatgtttaccttgttgtgcaaccatcaccaccattcatttctagaattttttttcatcttgtaaaactgaaagtctgtacccattaaacagtaatttcccattcctcactccctctagcccctggcaaccaccattctattttttgtctccatgaacttgactactctcctatgagtggaataatacaatatttgtccttttgtgactggcttattttacttagcataatgtcttcaaggttcatccatgttgtagcacatgtcaaatttcatttcttttttttaaagctgaataagattttgttttatatatatatcacattttgtttatcggttcatctgtcagtggatatttgggttgcttttctaccttttggctattgtgagcartgctgctgtgaacattggtgtacaaatatctgtttgtgtcccagctttcaattatttttggaagtggaatcatggaatcatatggtaattctatttttaattctttgaggaactgccatactgttttccatagctgctaaaccattttacattcccaccagcagtacacagggattctagtttctctacatcctcaccaacacttattttctgtttgttttttttgttttgtttggttttttaatagtagccatcctaataggttgtgaagtaatatttcattgtggttctgatttgcatttccctaatgattagagatgttgagcatcttttcatgtgcttattggtcattagtatatcactttggagaagtgtatattcaagtcctttgtccaattttgtgtgcccacttttttaaaccaagatagtagccacaggagctgcttataactttacagaactaccagatagatatcacttttgttagctaatactggtaacaaaagagtaaatattttaggaaaatatcccatatatctaatcaaattttacctattcttccttcatatgtttcatccgtctcttctattcctactaacagtaaagtaatcaatttagtatattctcgtcattgtgttgtaaaagagtggttgggcccagttctaatataatattaagaatagatggtcataaactctgtagtgggtttgctcttctcttcccttctttaattyccttcccctcaattccataaagatttattatgcacagggcctgagatctgagtttctctccctcaagatgtgtgacaataggcaagttgcacaaactgttttccctattggctgaactaagtgatttcttagatttcttctagtcttgtctattatatcttttaaggattcttttaagtattataacttttggttattagatgtccgaattatctgaatagtacactaccctcagtaaataatatttttagattgtcaccaaacataaagtgggagatgacagcctattttaactcagcttactttcttgtttactattttttacgtatttccttgggtttcttagatcaacctggggcctaatctgtaaactttttaaaagcaaacatttagttactttgtctaagaattaaccattgataacaaagcaatattttgaacagttaatatcaggatggaatatgtctccttctaaaagatactattgcatcttaatagcatttagaaacaaaggataagaaatgctgtactgtttaactttagttttttaatttctattttctttttcttttttttttgagacagttttgctcccgttgcccaggctggagtgcaatggcacgatttccgttcactgcaacatctgcttcccgcgttcaagcgattctcctgcctcagccttgggagtagttgggattacaggcacgcaccaccacgctaggctaatattttgtatttttagtacagacagggtttcaccatgttaggctggtctcgaactcctgacgtcaggtgatccacccacctcagccttccaaagtactgagattacaggcacgagccaccacgcctggtgtaatttctatttttgaagtgttataaataccagaacatcttacatacccaaatagggcaatatgtattccaaagctaaatataaattttaaaaaattatctgcattttagtttgtttgtacctctgttttcttcttgcctcattgggaaatcagattaaattgatattaagtagatttctaaaagcataaataattctttaaaccagtttaatctcaagaaataatgttgtgatagggtaatgtggatatagtagcaaaataatcttttagatagattaaatttctgtactgtatatttactgttcaatgattttcttagattgaccatctcttctattttttcttattcctgtcctttgtaaatcaatagttacttacgaatagtcattttctaagatcaatacaaacttttgggggatttctgtaatataacatagtacaatctttttgctttatgctctaattctttaatattttaattctatttctatttctcaagaatcaggaagatacttttaacactgcatttgtcactgaaaaaactagttttaatttatattgacctttttctcctttgaacatttagtctgcattsaataaaatgttgatgactgctctttagaagacagctgtatgaaataaagtattataaatattcagcttccctttctaagcattgtcaccaacagctgggcatccagtttagcagaacagattttgcacacagagagcctggcatattcctgaatcagtttagtgaaggaaacaaaaaatagtttcttatggattggggacttataaagacatagagcatctgttcctcagttaagtcatagtctggttgcactgaatcatgtttaaagctagaataatgtgcaaaactttttttcaccatgctcatacctttaacacctagtgcactgtttctgtactgtactttcaacatctccactgaaagtgtataaattattttgctcttatatatgatattgtaatagtggtattttaaagcagacaaacatactaacttttttataagagtttttataatataggactgatgtttaaattgtayggtagtccttgtatatataactgcatatattttttaaagaaactcatttaaatatttaattatgatcccatttagagatatgcaattagaatcaaacctgtcatcataaataattgctttcttcatatggtattctgctttaatacataatataaaaattggttggtagaactaagaatctttgtttatatatcttcccttaattattgggctactttaaataaagcgtgtcaaatctaaaatttctttaaattttttgtttgtagygttaaaagatcactgaagttggatggtctrttagaagaaaatgtaagtatttgcttaaaagtttgtcattgaataagattgtgttttcagtttttaactactgatttatctcgttaaatattaaaattatcttgataattttaattatatcacagtgtgatataattgtgattggtacaccattttctgcatataagatattttagtttttgtgaatctaatatgtggaagttcctggccagcttgaggtgttcagttaagaagcaaattaattatttaaaaaccttaatgaaataatttagtagaaattaattcactatttgtggaaaaaaatagtctgccacttaaatgtacaagaaacaatatgggacaatggcagtacttttaatctgcatactataatctgctaaaatgaaatgaaaacattagtagcatttttatatcaaaaatgtaattaccttcctcagctatgctggcatggattaaacagcataatactaacactgtaataaattgcaccacagttatcacaatgaaaattaaattgtactgttgccattactttttgtaaattgagttgtagcacattcccagtgccagcatatcatgacatatgttagtttattatcttttcataccaactatggatctagatagaaacactaatactgagatacttatgacctcagtaatcttaaatgcaggtaaattggtgagaaagtaaattaaaacaaatmgctagtcaataagtaggctcctccaaattcacatatgaatgccatttcartaaatgggttttatatggaatttttctttggaagacacactggtatttaacaaaacagaaatttaccatttagaaaacttgctacatgctttttaaaaatttttaaacaaaggtggcaaagtactgcaatgacacttaaaaaatcattaacagtataattagcaatttagaataccattatccaacttgttctgtgcagaatgcagctgtgactgtaattctgcatctgtttctttggtcagaatggttttttggtagatgagtagtccagcttgaaatgaaatactgttctttcctaccccaaagctgttctttgggagatggtmacattgtttaaatggaaaagaatgaccgtttcagaacccgttctcttcatgaagtaaattgtcatcatggcaggccttctttgtattttttcttcagatgaagatgtgtcaaggtagccagtgccacagctgacatcctgtattagaaaaatacattgttatgtttggcccagttctgtacctttcaacagaacttaaattgatttaagcttgtaccaactgatttagtagtaccagttgatttagcttggtactacatgaccacatctgcccgaaggaggttcctagcatactagcttgggcatttctatttcctgaccagtttctggtattttcagctttgtcctcttgccttatcatttgtttgaagctctgtatttacatcttagagctaacagcttttgttctgttctggtgttaagtctgggcttctctccatggctacatacacacttcatctactctagtaacaacttagccctgaagcaacctggctcccaattatatactcacatggcctatggccccattgaggctgccttagcccatgcaaaaggaaattggacattcaaaatatatacctacaattttaggagtacttaattgttgtgaagctatattggaactagtagtaactttgtggtcattttaccttaccaatatgttgctgaagggggaaggctctggtttctaagggaaagagatggcccttatatgccagttggttgaagtggagcctgttcatcctaagcaatggccatatccagagatatttggaactcctaactcccagtgttcctaatgcagctacagatcttcatggagattaatgcttcatgatgtttgggcaaggttcaaatgccatttgcttatggctcttgatatggtttcctgtgtcctcacccaaatctcatcttaaattgtactcccgtaattcccacctgttgtgggagggacccagtgggagataatttggatcatgggggtggtttctcccatactgtcctcgtggtagtgaataaggctcactagacctgatggttttatcaggggtttccacttttgcatcttgcttattttctcttgccactgccaattaagaagtgccttttgggcaggggttgcaatcctagtctctgataaaacagactttaaaccaacaaagatcaaaagagacaaagaaggtcattacataatggtaaagggatcaattcaacaagaagagctaactatcctaaatatatatgcacccaatacaggagcacccacattcataaagcaagtccttagagacctagaaagagacttagactcccacacaataaaaatgggagactttaacaacccactgtcaacattagacagatcaacgagacagaaagttaacaaggatatccaggaattgaactcagttctgcaccaggcggacctaatagacatctacagaactctccaccccaaatcaacagaatatacattcttctcagcaccacaccacacttattccaaaattgaccacatagttggaagtaaagcactcctcagcaaatgtaaaagaacagaaattataacaaactgtctgtcagaccacagtgcaatcaaactagaactcaggattaagaaactcactcaaaaccgctcaactacatggaaactgaacaacctgctcctgaatgactactgggtatataatgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagatctaaaattgacaccccctaacatcacaattaaaagaactagagaagcaagagcaaacacattcaaaagctagcagaaggcaagaaatacctaagatcagagcagaactgaaggaaatagagacacaaaaaacccttcaaaaaatcaatgaatccagtagctggttttttgagaagatcaacaaaattgatggactgctagcaagactaataaagaagaaaagagagaagaatcaaatagatgcaataaaaaatgataaaggggatatcaccaccgatcccacagaaatacaaactaccatcagagaatactataaacacctctacgcaaataaactagaaaatctagaagaaatggataaattcctcgacacatacaccctcccaagactaaaccaggaagaatttgamcctccgaatagaccaataacaggctgtgaaattgaggcaataattattagcttaccaaccaaaaaaagtccaggaccagatggattcacagccgaattctaccagaggtacaaggaggagctggtgccattccttctgaaactattccaatcaatagaaaaagagggaatcctccctgatgcattttatgagcccagcatcatcctgataccaaagcctggcagagacacagcaaaaaaagagaattttagaccaatatccctgatgaacatcgatgcaaaaatcctcaataaaatactggcaaaccgaatccagcagcacatcaaaaagcttatccaccatgatcaagtgggcctcatccctgggatgcaaggctggttcaacatatgcaaatcaataaatgtaatccagcatataaacagaaccaacgacaaaaaccacatgattatctcaatagatgtggaaaaggcctttgacaaaattcaacaaccttcatgctaaaaactctcaataaattaggtatcgatgggacgtatctcaaaataataagagctatctatgacaaacccacagccaatatcacactgaatgggcaaaaactgtgaacattccctttgaaaactggcacaaggcaaggatgccctctctcaccactcctattcaacatagtgttggaagttctggccagggcaatcaggcaggagaaggaaataaagggtattcagttaggaaaaaaggaagtcaaactgtccctgtttgcagatgacatgattgtatatctagaaaaccccatcgtctcagcccaaaatctccttaagctgataggcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggatgtgaaggacctctttaaggagaactacaaaccactgctcaatgaaataaaagaggatacaaagaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagccagaggcatcacgctacctgacttcaaactatactacaaggctacagtaaccaaaacagcatggtactggtaccaaaagagaggtatagacgaattgaacagaacagagccctcagaaataatgctgcatatctacaaccatctgatctttgacaaacctgacaaaaacgagaaatggggaaacgattccctatttaataaatggtgctgggaaaactggctagccatacgtagaaagctgaaactggatcccttccttacaccttataaaaaaattaattcaagatggattaaagacttaaatgttagacctaaaaccataaaaaccctagaagaaaacctaggcaataccattcaggacataggcatgggcaaggacttcatgtctaaaacaccaaaagcaatgggcaacaaaagacaaaattgacaaatgggatctaattaaactaaagagcttctgcacagcagaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaratcaaaaccacaatgagatatcatctcacaccagttagaatggcaatcattaaaaagtcaggaaacaacaggtgctggagaggatgtggagaaataggaacacttttacagtgttggtgggactgtaaactagttcaaccattgtggaagtcagtgtggcgattcctcagggatctagaactagaaataccatttgacccagcaatcccattactgggtatataccccaaaggattataaatcatgctgctataaagacacatgcacacgtatgtttattgcagcactattcacaatagcaaagacttggaaccaagccaaatgtccaacaacgatagactggattaagaaaatgtgtcacatatgcaccatggaatactatgcagccataaaaaatgatgagttcatgtcctttgtagggacatggatgaagctggaaaccatcattctcagcaaatatcgcaaggacaraaaaccaaacaccgcgtgttctcactcgtaggtgggaattgaacaacgagaacacatggacacagtaaggggaacatcacacaccagggcctgttgtggggtggggggaggggagagggatagcattaggagatatacctaatgttaaatgacgagttaatggttgcagcacatcaacacggcacatgtatacatatgtaactaacctgcacgttgtgcacatgtaccctaaaacttaaagtattaaaaaaaaaaaaaaaagaagtgccttttgcctcccgccatgattctgaggccttcccagccttgkggaactgtaagtgcaattaaacctctttttcctcccagtctcaggtatgtctttatcagcagcatgaaaacagactaatatacctcttctaatgarggaagcagagatatggaccataccctgtgttcttcctataatatacgggatgtrtactgccagtaccacaatttgctaaacctcacaaattgttgggtgttgtaaggaggtgaagaaagttccaatttataatcatctactgtatttggcctgcttgagttgttgctctccaagcattgttcctaggtagattttcaggaatgaagatgaattatatattacaaactgttgccgatggcagtccagatgaatttatatggacaactggctacctggccatataccaagccagcttgacccagtctttttcaggccacttcagagagagaatagaagatgctacggttgggaagagaagagcatacttcttaccaaggccagctcaataggcttcctgccagaggagtagtggtgcaggttttgttggggaggtttgctgatttatatatagatatccagtcaagggtactccataacttattagtaagacacttttttttttttttcgagacagggcctcactctgttgcccaggctggagtacattgttatgatcacagctcactgcagcctcaaccttctgggctcaagcaatcgtcttacctcagcctccagggtagctgggactacaggcacaggcctctatgcccagctaattttttgtatctattttttttttagttttgccatgttgtccaggctggtctcaaactcccgagctcaagcaatctgcccatctcggcctcctagagtgctgggattacaggtgtgagccaccatgcctggcagtaagacacttctaagtcagattattcccattgcctaacttaatctctccaatcctagaacatttctctcaccccaaaaggaaaccccatacctattagcagttagtctcaatttcctcctctccccctccccctggaaaccactaatctactttctgtctgtgtagatcttcttctgaacatttcatrtaaatggagtctcataattttgtgtctggcttctttcatttagcataacattttcaagattcaatttacctgtttctttctttgattgtccttttgatgtcatatccgagaaacatgtaacccatggaaacacaggtttttatctacgtttctaagagttttatagtattaactctttcatttaggtcttccattttgagttaatttttgtacatggttcaaggtagggactggattcattattttgcatgtgtataaccagttactgaaacagatatccacatgtaaaaaaatgaatctagtccctaccatttgctgaaacgactattttttcctttattgaacagccttggcacctttgttaaaaatcaagtgatcataaatgtatggatttatttcagaattcccagataaattccatttgtctatctatatatatgtgtttatgccactaccatgcggtcttcattactgtaagtttctaagattaaaaaacgttttgattgtaagtttgaaatcaggaagtatgagtccttcaactttgttgttctttttcaagattgatttggctattctgtatcctttgtaattccatatgaattttgggatcagttagtccacttctggaaaaaaaaaggcattggaattttgataaggattacatcaaatttgcagattcagttgggaaatttgcaatcttaacaataatagtaagtcatccaaaccatgaatgtgagatatatttctgtttatttagatctcgcttattatctttcaataatgtttcatagttttcagtatacaagtcttatagttttctgattaaatttattcctaagtattttattctttttatgctattaatggaattgctttataatttcatttttagattagtcactgctaatgtatagaaatacaactgatttttacatatggatcatatatcctgcagctttgctgaacccatttattagcattaataatttggagattttcttttttttttgttttgagacagagtcttgctcttttgcccaggctggagtgcaatggcgcratcccagctcactgcaacctccgcctcctgggttcaagcagttctcctgcctcggcctcccaagtacctgggactacaggtgcacacaaccacgcccagctaaattttgtatttttagtagagacagggtttcaccacattggccaggctggcctcgaactcctgacctcaggtgatccgcccgtctgggcctcccaaagtgctgggattacaggcrtgagtcacagcccccccgccctacttagggtattctatatataagatcaggtcatctgcaagtagggatagttttacttcttcttttgcaatctacgccttttatttctttttcrtgcccattgctttggccagaacctcctgaaaaatattaagtagaagtggcaagagcagacattcttttcttgtacctgatcttagagggaaagaatccagtctttcatcattaagtatgatgttagctctgagtttttcatacatgtcttttatcagattgagaaaattctgttctattcctagtctgttgagtgtttttatcatgaaaggatgttagatttttgtcagttacttttcctgcataattgagatgatcatgtgtgcttttttcttttattctcttaatatagtgtattacattgattgatatttgtatgttgaaccaaccttgctttccttgcataaattctgcttggctatgacatataattcttttatgctgctgatttcaatttgccaggatttttacatctgtatttataagkgatttgggtctgtaatgttctggtatcaggataatactggcttcaaagaattaggaagtgtttcctcatatttttggagagtttgagaatacttggtgtcacttctttaaatattagtagaaaggctgggcgcagtggctcacacctgtaatcccagcactttgggaggcccaggcaggtggatcacctgaggccgggagttcgagaccagcctgaccaacatggagaaacccccttctctactaaaaaatacaaaattagccaggcatggtggcacatgcctgtaatcccagctgaggcaggagaattgcttgaacccgggatacggaggttgtggtgagccgagatcgygccattgccctccagcctgggcaacaagagtgaaactacatctcaagaaaaaaaaaaaaaaaaaacgctagtggaattcacttgtgaagctacctggtcctgggcttttctttgttgtaaattttttgaatattaactcttatgtctttacatgctgttgatttattaagattttcctgttctccataattcaatcctggtatgttatgtgtttctggaaatttgcctatttcatctagattatctaatttgttagcatgcagttggtcatagtagccctttatgatttcttttatttctgcaaggccagtagtaacatccctttttcattcctgattttataatttgactccccatcccttccttccttccaccctccctccctccttttcttccttccttcatcagtctagctgaagatttaccaattttgttgatcttctcaaaatactgactattggaatcaccaccactaatatctgttgttttttctccatttcatttgttttctctttaattgtctttttttttttccttctgcttgccttgggtttagtttgcttttctttttctggtgtcttaaagtagaagcttaggttattgatatgagagctgtctcttttaacatagttatttgcagctataaatttccctctgagtaccactttcactacatcccattaagtttttctatgttttgttgcgttttgttcttaatgtgttttttaagttttaaaaaaattccttctttgacccattggttatttagcagtatgttgtttgatttacacatatttgtgtattttctaagttttcttctgttatttttattgtcattctatgtgaccagagaacattctttatgagaacattgtattattttcctctttttaaatgtgttgagacctgttttgtggcccaacatgttgttatcctgccaaatgttttatgtgcacttgagaagaatgtgtattctgctgttgttgggggaggtttctatagatgtctgttaaatctagttggtatatagttttattcaaattttctgtttccttgctgattttctatctaggttttctattcattattgaatgyggggaattgaagtttccaactattatagttgaattttcaatctctcccttccaattctgccagtttttgttttatgtattttgggcctctcctgttagatatgtttatgtttataattgtatatctttttttgttttttgtttttttccccaataccaataagtatttattcattgtattttcttggaaaaaagaaaaagagggggaaaggaaaagcatgtgttacaatagtgcaacagaaaagaagtgcccagtacagcaaattgaccatcaaataaacacaccccagtgataaagtcatcagagtccaagggagctcagtctcctgcagttcaggaagacggggaagggatcaagaaaagaacagacaggtacacactcagcctaccttctgtccttccctcttcatgaattcagacttttgcacaaagctttagtttctatcagtaaacatcgagctgcatttgtccttctcttgtcttgtggccactttgacatacattttttgcacctatataaaagctcctgagtgacttagatacatttatcttccttttcttagtctcccccccaggatgagacacatgtcacccaatacattctatttgccctgtttgaacaaagggatgtaagtttatagtgcttttacggcaggtaaatgaaactccctttctctttagctactatgactctacaatcactactgcaacaatryaggacagtggctccagatactattaacaaaagcccttggtaatgggtctaggtctctaagtccagaatgttcaaaagttaaggattttttgttttattttatttttttagaatagggatctcattctgtcatccaaactggtgtgcagtsgtataatcatgtttcactgcagcctcgaactcctcgactcaagtgatcctcccaactcaacctcccgagtagctaggactgcaggcacatgccaccacacctggctagaaaaattaagaatttttgtctttgcttcatacatttattcctgggcaacacagatgggtacaggcatttcatttaaaaaacctatgcttaccagctcatactttcagacacacacacacacacatcttaatgtgcatggtagatttagtttaatctcagtgaaggatagatctggtgtgtgaagcaagtctagtactctaggattagagacttggaataggaatcctttattgcatatgtagacaacttcatctaaccttgttcctctctaggcctttcacctggcccaggctctaacctttcagcaccaccttcctattcatactcatgtccaatcttccagtaaaatgagatcaagtcatgggacaaatcaactaaaaccaagtatcccaagaaacattatcaagctggaggagctttaagaagacattgcagtagaaaagccagcccttattgacataaatgagatagtccaataggctgtatactccaagtagctgttttttgtggtgataatttaacaacaacaaaaagtattcctgctttgcagacctggagcagctgtcaaattatccctgaggttgcctgtgtacctcacaacaaagtataaaaataaggaccttagattaaaatatataaaaatatttttattaaggaaaaaagttaaaattcacaagatacatcatttgcacacatcaagttcagttggcctgctggagaaagtaagaaccaaggtacagttgttcaaaggagcaaattatagtgccaggtgcagtggctcacacctgtaatcccagcactttgggaggctgaggctggcagattgcttgagctcaggagtttgagatcagcctggcaacatcacaaaatcctgtctctaccaaaagtacaaaaaattagccaggcatggtggtgcgcacctgtcgtcccaattactcaggaggctaaggtgggagggtcacttgagcccaggaggcggacgttgcagtgagccgtgatcgcaccactgcactcccgcctgggtaacagagccagactgtgtctcaaaaaaaaaaaaaaaattgtagtggcccagaatgaagtaggagtaagcttaggagttgcaaatctgcagctgtttcctcaactgccccttttgcccataatcatacccgttgcttggaatagttcccggctccctatctcaagaatgggttatgagtagacacatggaaaagccctgccctaatctacctgagagattccctcccacagaatgttgtggcttcttggttgggtccatgaatctggtttcatgctgaatcttttcattctggtataggaaatattattatatatccttgtttaaaaggaaaaggggttgcctagagtggagcctaagataaagcatcctggttctagggagattttccacaaaagccctcactttttttgcttgaatagcatggttagaattaatttgccttcacccccacccccaccttcctccacaagggaagagagagtgattgccatggatcctggcctgagatacatggcagtgccagctgccccctacctgccccatcctactttctttgctctttgctagttgagtgagggaatatattagttaagtgaggaaactgaaattcagatgagtggtgtgtccatgatagcatagctggggagcagcaaaascattatgtgagcccaggctttccaatgttaagtctgcggttccttccatataccacagctatctttcctttagtgtaattgtttaaagacttcatgattcttcattctctttggaaaatcttatttctaatactgtttttggttcatatttttatattatctttagcagttgactaaatttgttaaacgttttaaaatactgggtcaattcattggggaaaaagaaagtctttaataaatggtaaccatctagaaaaaaattcacttcatatacaaaattcatatgcacttcatatctcactttatttacaaaatttattccaagaaggatcataggcctaaagtaaagccaaaccataaagtctctagaagcctgcatggtggcttctggctgtaatcccagctttgggggaggctgaggtgggagaattgcttgaggctagcaatttgggacaagcttgggcaatgtagtaagaccctgtctctaaaaaaattttgtttgttaaataagctggcatggtagtgygtgcctatagyctcagctactcaggtgggtaaagtgggaggatcacttgagcccaggagttcaaggctgcagtgagctgtgatagtgccactgcacttcagtctaggcgacagagaaagactttgtctcttaggaaaacaaaattacagtgtaagagaatgacagtaatgatacttttattattaaaattaatatcttaatatctttaaattgtgaaaaaataattactacaaatagaaaaaccagtgcatcaacgtttttagccagtattttatttttcttgtcagggtgaaatttgcatattattaatttcaaagatctcgagtgtataattcgatgagttttagcaaatgtataattcagtatcatagctctaatatattggtcatattctttccttgctatccctgtaagatcactaagataagttcaaaatgtttctgttctccatggctaccataaaaacaaaaccccaagatttttagaaccattaaggttgataattgtagtagctgataagaaggtagttggggttggttgtggtatctcacacctataatcccagcactttgggaagccaaggcgggcagatcatttgaggtcaggagttggagaccaacctggtgaacatagtgaaaccttgtctctactaaaaatacacaaattagccggacgtggtggtgggtgcctgtaatcccagctacttcrcttgaacccgggaggcagaggttgcagtgagccaagaccgtgccactgcactccagtccggaagacccagcaagactctgtgtcaaaaaaaaaaagaaggttgttggttggtatctagtactcttctaggcaccttaggcccaaattgtgaaacgtctctgaggcagctaatgctagagttttctaatgtaaatttcataattagtactagtaatgcatattaattatatcttaggtgggacactccaatagcctaaataaccagcataagtttatgaagaattatctccttctagctgcccttttgtttctagttgaccagacactacagtatctgtattataaatattttagcataggctgacagttcaaaatagtgataaagtatcctttaaatcccatattttatcctgcaagaatttttagttagtactctctagactgtttataataggtttaaaaaaatcagtaaaatgtaggcacttttttggtagtgtatgctttaaacaaggtgacaaagtaagctacaatttgtgaaagaaattgaaggaaggaaaggaaaatatcatatctatttgaaattattgagagaacattgatttttttttcaggcagaaaaatcgatgcccaaattttagttttgctaatgtacaagattagacctccttataaaaagtacagtagcatttgggtggggctgattgcagcatcttagaatgtggcatttcttttgtttagaaatggtgttaaataactctaaggagtcaggaattattacaagcaggttkgtttgtttgtttgtttgtttgtttgtttgtttgttttttgagacagaatctccctgtgtcgcccaggctagagtgcggtggygtgatcttggctcactgcaacctctgcctcctgggtccaagtgattctcgtgcctcagcctcctgagtagctaggacaacaggcgcgccaccatgcctggctaatttttgtatttttagtagagacagggtttctccatgttgccaggctggtctcctactcggcctcaagtgatttacccaccttggcctcccaaagtgctgggattacaggcatgagctgccagcagttgtaaattattatagaagtggttgtgacatctattttcttscgcgcgcgcgsgygygtgtgtgtgtgtgtgtgtggtgtgatccacagctcactacagcctcaacttcctgggtttaagtgatcttcccacctcagcctccagagtagctgggaccacaggcatgcaccactatgcccagctaattttttggtactttttgtggagacggggttttgtcatgttgctcaggctggtttcaaactcctgagctcaagcaatcctcccaccttggcttcccaaagtgctgggataacaggcatgaaatgccctgcccagctgacatcgctctctttctttctttctttttgttttttgttttgttttgttttkttttattttgttacatcctgagtccttgcttttttctagccaaatctagccctcttactctttcttcctgtttttctaaagggctcataggtagcactcatccttgctgaatggaaggattgctgacttctcagttagtagytcagtcttctctcaaatcccagtattcttaattcttccttttgtgggagactaatgagtaggccaagatcttcaaagtttgggagttggcagaatggaaattctcagatggattctaggattacttttaaacctcttcagagattaaaagttagaggaacttggtacaaccttgagggaaagaaaacttagggaagtagggttatgcctttgtgtgtaccagtagggaagataaacaaaagtgcatatttactgaagaatatttagtggtatagtagggaaagggtagcttttcaattttccttctgtgtatagtagttgtagatagacatttttctttttaacaaacacaaatgaccaaaaaaataaaaaaagagagaagcctcagtatttttaaagtgaggcaaaaatacacacacacacacacacacacacacacacagagcacatgcacactcacagagttattttctgaaagctggaaaattgtttccaaggagaaatgtatgatctacagttaaaatgtttagacatatggcaattggataaaataattttttggtgaaaatagaaaaacagatagatatagatgtacattagggtagtgactttcattccttgtacatacacagtgaagtagttctgggcaataaattcttggaaaagtagagtagggattggataaatgtcatagtttatgactgtgaatacatacaaacaggtaaaaactcaagatggagaggtaataataaccacccgataaagagacttaaaaccctttcactgtacaaaaaaaaagattgctttagagttataacttgatattatagtttgattttttaaaagatattcatcgcatttgtggccactatggatacataaaataaacaatgcctttcatttctcaatataattaaatattgtttcctaatatttaaaatcttaactgtaaaaaaattttttttgaatgctatagattctggaactaatattaagattactaaaaaagatgacacagccactatttcttccataggtctcttaaaaataaaggatagttgaccaggcagagttaaggaactatttcaaatcctctaccaagctatatccagtatgttggcaatgtatgagccatcagacctttcctatatcccccagatccatcctatgctgtctgttccacctcttatttcagatttctcatgcctttttctgtgacagactactgcagccaactttgaatttttcctcttctctgaatttcgtagcatgcatactaatttaaaacctctttgttgttcttctaacttttggtagatactccttaaggccagagcaatttgttatatttctttgtacacattagtacacatttagcagtgctggtgggtgatcagtaagcttatggaaagcaagttttaagggaattcaggaaagggaacaattaatagtatgataatggatgtttgaaggaaggggatcatgaatgaggacctaaactaaggaaagtctaggtcttggggaagataaaaaagaggatgttccaagctgagatcacraaatgatctgaggcccaaatgcacatagcctagtgactgaagctgtaggtaacagtgaataattggatgtatgaaccagtgaacaaattagtatattctgagtagagcaagatggccaaatttactggactgttccttgtaagtcattcgttcctcacacattttttagttctctaggatataaagatgaaaagataatatttattttcaggagcaaattctaatggaacagacagaacttattaaaatatgttacctgaaataagaggtatgcccaacacctatggaaacacaaaggaggaagctgctaagaggaaatttgtaagacaggccaaatcctcaaaggccttaaatgcctgactcaactgtttggacattattttggtgattattgaagcaagatgctacatcagaccactttgtgaagctgtaggacagcagtgatccttcctaaggtttctgtgtgaggcttagtaataggcacctctgagagttttcctgccctggccccataattatacttcaagttcagctgaaagcaaaagtcagggtrtggttgggagagttggccatctctaacctgtttggaaataccatctcagaaggtagtaaccctttaatgctaaaatttagtaaatatcaaattgagatgttctagttattatagagacctgaaatatctaccttgaaagaatagtgtttactttgagagtgatagttgagtatatttgtaatctgaaaagcaagagcaaggaaacaagtttgaattttgctgattttttwatggtatataatttcaaagatctataactaaacatagctatttctgtccttaattattatttatttccagtcatttgatccttcaaaaatcacaaggaagaaaagtgttataacttattctccaacaactggaacttgtcaaatgagtctatttgcttctcccacaagttctgaagagcaaaagcacagaaatggactatcaaatggttagttgaacattcttttctacttattgtaaggtttttctagttattggccaaatcaaaattgtgatttaattatgtatggatcttgctacagctgatttttctcttctctcaaataatttaataccttaatataggtattactttggacataaatrtraacttttggcacttattttaaaatgcaactgcaggctttgttcccttactatcccatccattaaatagaaattatggcctgacttgccttcagctactatcaattataatggttacagatatgccccttaacaagctatccatcatgtgcataaattaaagggagcataattcaggtgctgctgcactacaacttaagagtgatacttctaaatgttatttttatccatggtttccattgagttttacccacatttagtatatctttatatagcttatctttatttattatatttcattcccttctttttcttgactatttcaaatgtatttacaaaaggtttgtagaatttttccatagagaaaaatctaattttaakatgaaattctttattttaaaatattattagtttaattttaattttgaccatacatatttgttgtcctctggtagttcattgctaaaatattgatttaaaaacacaaatctcgattccgtggggttttttttttttgagaaaggttatgaatcagtgacatgtagttttataattaaaattttaaataggctcaaatttaatagtgtatcctttagatatactgtgattagcctaattcacattttattgtttaacatttaatgagtgctaagcatatactagaagctacccagaaaaaagaagtctcattttacctgatttgttataatgtaacacataatgagatcttaaagttttgaatgtctttaattttactttaatcaaatgctttttatcctaaagctgttactattaggttctctttccctaaaatgtatgaaaatgtatacactttaagtttcatagttctatttttatatgcatgatatatctttttaattaaaaataaatgccttagagattgtacatccctatactgaaatgtgaatagattttaagttgatatgtactcaatttccatattgaaattaagtatggacttaaggggacattccttttgcccataaaaagattggtcacatgatttcagttggcatttaagtagataattatcacagattatagtcctaagtaagctcttttttaaaaagtcagatagcaagggtttcagaggtgctggcaatgttctgttttttgacctacatagtggttacactgattcactctagttattcatcagactgcacatacatgtttcatatgtrctgtaatatatatatctcacatatagaagtctcgaaacagaattttgtccagaattctgtatgagattatgtcatttgtaatcattacrttgcttatcctaatatgtcatcttgtacatgttttaaaaataaaaaagcttgatttttatgaagtaacttaagttcaaaataaatgagaaaatatgacgtatgaagtcatttaaattctaaatgaggtcataatctcttaacaactcccacttttaaaatattatacaaaacataatataaaatttaaattacattttcaaggacatttttggtgttactcacttcccatcacacttatgataagatccaaaacmcttatcatgacatggaaggccatatatccatctaacacccaaacacctcatctgcctcattttctaccccttttttacaytactttagccactcttaccttcttgctatttgtcagtcatgctgagccccttcttgccacaaggtcttgcagttctctccacctggaataatcttcctccagatatttatatgtactttctatgtacatttgaaccatgtactatgtgaacagaagacttaatattatatttaaatccatttgtagttataaaaggatgaaaaatttagttctatgtcttccttctacttagattctacattggccaaacatgggatttgtttcaactctttagtttatacatttaacagatgcgttcatgcagcacataataacatttcagtcagtgacagactgtatacacatcaggggtcccccaagattataatggagctgaaaaattcctattgcttagttgcccggtagccgtcataacattgtagcacaacacgttactcacatttttgtggtgatgccagtgtaaacaaacctagctcgctgctagtcatataaaagtgtagcatgtacaattatatgtagtacatgatatagtcgtgtactacataatgatgttttgttcaacaaatgaccacatacaatgatggtcctgtaagattataataccgtattttactgtgcttttttatgtttagatatgtttagataaacaaatacttacaatatgttacaattgcctacagtgttcagtacagtaatatgctgtacaggtttgtagactaggagcaataggctatacactaggtgtgtggtaggttatacaatggaggtttgtataagcacacctacgatgtttgcacaacaatgagatcacctcatgatgcatttctcagaatgtatgtccatagttaagtgacacawaactctatatgtatgtgtgtatgttatgtatcatttatgtattttttaatttgtatgtacattattttgctgccctcctccaacccatagcaagtttctccagactattacagttgacccttgaacaacatgggtttgaactgcacaggtccacttacatgaagattattttcaaataaacatactggaaaattttttggagttttgtgacaatttgtaaaaccctgcagacaaactttatagactgtaaatataaaaaaaaaagttggctatgccatggatgcataaaatatatgtagctactagtctatcatttaccataaaacatacacaaatttattataaaaaataaaatttatcaaaactaatgcatacaaacacttagaccctacacagtcccatttgcagctgagagaaatgtaaatgaatataaagatgcagtactaaatcataactgcataaaattaactctagtacatactgtgctactgtaataatttcatagctacctcctgttgctattgtagtgagctcaagtgttgcaagtatctgcttgaccatgtgatgctgataatctctgcacaagtaatgtgtctctcaagtaaattgtgtattgcagtaaaaaatgatctcatggttctcgtatgtttttcatcatgtttagggctatgctggaaaccttgactaacaccatgaaacccacataaagtgccactagtgatgctggaagtgctcccaatgagcagagaaaaatcatgacattacaagaaaaagatgaattacttgatatgtactgtagattaaggtctgcagctgtagttcctcaccatttctgacagttcatcttgtaaacagatgacaagcttatggtattaatactttacaatactgtaaatattttatcttccttatgattttcttaataacttttttctctagctttattgtaagaatacacaatataatacatataacacacgaaatatgtattaattgactttgtggcatctggtcaacagtaggctattggtagttaagtttttggggagtcaagagttatacttggatttttgactacatgggggatttggcactcctaaccctcgagttcctcaagggtcagttgtatgcattttagaaaagaagaaagagaaaatttttcccctttcctcccatgaacacttcggacttgttatttaataatgaaagtagaagaataaacaacaaatttgcatagtcgaagagagtacttgttaactggacaatagatctgtaaaaatcactcagactataacaatataatagtacagagagataaaaggagaatgtgataaaacaataaagtgaaatgataggcagaataagactctccaacatctgccaaattggagttctacaaggaggaaatacagagaatggtccataggcagtattctaagatataaggactatcagtttttcataattaaggaaagataagaatttgcaaattagagtagcatgctaagtctgggcaggataaagtaaaacagatccacatctagttatatcatgataaaactgtatgtagaacatcaaagacaaaattttaagggcaaccagagaaaagatagtacctacaagagagtaacagactgataaacttatctatatcagtagactccagcagaaaatgcaataatagtatcaattaagaatcacagttgagtttttatccaggaagtgaggatgaaatacaatttttcagacaaagtctcagagagtttgccactcacagattctcttaaaataactacaaaataagttacttctctaagaggtaaagtgaacctcagataaaggagtggaattgcaaaaagcaatgaygaaaaagtgaattagcaaacatgttaatctaattacaagttttgctgactataaagcaaaagtcaaacaattggagggcgggtgaaaaaaaaattggagggcaggttaaaaacaaacaattggagggcgggtgaaaaaaaaaagtcaaacaattggagggcgggtgaaaaactatcatggaaggtgaggaggcaacagataagagttacgatgttttagacaatattttaaggtcctcgtattttcaggcagacaagatatctatcagttgacttcttcattgtattttttgttttcttgcctgtaaaatggggaagatagtaattcctacctcagaattgtgaggattaaatgaattaatacacagaaagcacttagaatggtacttgacgtatattaatagtatatgttccatacatgttctagccattttcattaatagcattattaattagactttaagaaaagacataagacaattaaatctgaaggaatagaaaaagaaaacaaagcaaatactagctttttaaaaaaagctagtagttgatacaaaaatagaaaggctgaaatagactttatgcctaaaaggatttattgaaaataatgaggctctttacataagagatagagaaagattcaccactacaaaaataaaaggatcctgagccatatgtgcatctaaaaaactcaaaacataatgaaatatgacaggataacaagggagaaactgataaatccacaatcattgtaggagattttaaactacctctttcagaaactgatgaagcggttaaaaaggaaggayatagacaagttgtacacaattagcaagtttatctaatgagctgtggtcaaaaagatataatacccatataataaagcacatgtagaatgttcacaaaaatgtaaccagcttggagttacagaggaagtctcactgtactaaaaattacagtcatacagctcacactctaaaatttcatacaattaggaatcaataatgaaaaggcagccctccaaaaattttaacctgtatgtttggaaaccaagaaacttctaaataattcattgatcagaaaaattataatggaaagtataaaatatttaaaattgaatgataatgaaaacatgtcagcacttagaggaaaaatttatacctacattatactaaagcagttcttggtggaagctttatacagtcgtcccttcctatctgggggattggttactggatcccactcagtttccaagatccacagactctcaagtcccttgtagaaaatagtatagtatttgcatataaccaatacaccctcctatatactttaaattatctcaggattacttatatacctaatacaatgtaagtgctatggaaatagttgttatactgtattgtttagggaattatgacaaggaaaagtctgtatatgttcagtacagatgcaaccatcctttttttaaacaaagtatttttgatccatggttggttgaatccacagatgtggaatccactaatacagagggccaactgtacttacaaatgcatatacagtcctgtgtcacttaacaatggggataccttctgaggaaagcattgtttggtgattttgtcattgtatgaacatcatagattgtacttacacaaacctagatgtcatagcctactacacatttatgctatatggtatagccttttgttcctaggctgcaaacctatacagtggactactgaataccataggcaatcaaaacataatggtattggtgtatttaaacatatctgagtagaaaaggtacagtagaaatatggtgtttataatcttatgagaccactgtcatatatgtggtttgtcactgaccaaaatgttgttatactgctcatgactgtatttaaaaaggaagaatgattgaaaactattgagtcaagcattcaactcagaatgactgaaaaggaacaacataatgaaccccccaaagtagaaaggaaataatgatatgaagataaattacaaattgaaaacagggcaataataaagaaaagcaacaaatcaaaagctggttctcagaaaagtctaatgaaatgttagccctctggcaagactgattttttttcaagtagcagaaggagcaaacaatatgtaaaagagctgataaactaatatactatctccttaaacctgtgatgagcaatctgaggtgtgggccaaatgctaaacatttttattattgtgaaagaactagtcaaatatcttacctgtaaaatgtagatcaataatattaatctcagtcttttcatggaagggcttatgcttttaaatacttttcagcttttaaatatgacaaggtttaatatttctaagaataacacttaaatcagttatcagactgtcaagtacccagtcaacacaaagtaatctgaatgaaagatgtaaaaacctgtatttttgttactgcttcccaaatattactgttttagtagattaaaaagtgatttcaattttctcagcgataaccttctattcaataatgtaagtaatattttaagaatattattatatttctatctatgggacttaataaaggtattttcattttgagtgaaaaagaaccattgagctgggcgcagtggctcatgcctgtaaatcccagcactttgcggggctgaggcgggcagatcacctgaggtcaggagtttgagattagcctggccaacatggcaaaacccagtctctactaaaaatacaaaaattagccaggcgtggtggtgcacgcttgcagtcccagctactcggaaggctgaggcaagagaatcacttgaacccgggaggcggaggttgcagtgagcagagatcgcaccactgctttccgggctgggctggcaaagtgagactctgtctcaaaaaaaaaaaaaaaaaaaaattaacattgttattttttgtgagttgatcctccaaagaggttatttaccctccactctattaatattaatttggtttattaaaagaatagcaggactgtatcagtatctcattcacctctttgcctacaggcctcaacttgatctacatgcaagtaacctttttagaaagaagttactaacttttgtttgaccaccttgaacaaatcacttgaacctctgtggatcaaggtttttccaactcttaacttttggtttgagaccaaaatgattgcctatagtatttatcaactataaagtatgggtacctagaagcagcatgataccagcctaaacctgtttgggctttacattaatctttttttttttttttttttttttttgagatggagtcactctgtcacccaggctggagtgcagtggcgtgatctcggctcactgcaacctctgcctcccaggttcaagtgattctcctgtctcagcctcccaagtagctgagattataggcacacaccaccaggcgcgggtaattttttgtattttagtagagacagggtttcacggtgttgaccaggctggtctgaaactcctgagctcaggcaatccacctgcctcagcctcccaaagtgctaggattacaggcatgagccaccgcacccagcctacattaatctattaataagcattgcatcatggttaagagcacagtcttcagctaaatgtctgggtttcaatcctcactcactaactttatgggctgggataagtttgtaaccattctgtacttctattttctcatctgtaaaatgggaacaagagtgactatatcagagttgtgcaagttaattagatatcatatgtaacatatttaaagcaatgcctggccctaattaataccatgtgttagccgttgtcatcactattgattgtgcttccaagtattaacaatttgttgaaagctatcttcatttgttagggaaagagctccctggagccttaccagaaagctcaaatacaattatgaatgtagttcagattcagtgatggtacatttatcaccaatgttttgtgaaactgcacttgaagagagtcaaatacacaagtgtttggtcacttttacatataatctcacaagaaaaataccatatagactctatagtgcttttgtatattttcattgtgcttactttttttaatagaatggaatgaaataaaggaaagtaattattaagtaactggaaacctcatttactacatttactactcaatatgttgtattactcaacagtctagtaactgatctaagtattactcttagaaatattaaaactcttcatatttaacagctgaaaattatttaaaatcataagtccttccatgagaagactgaggttaatactrttgatccacatttttacagggtgagatatttgactagttctcttataataaaaatatttagaaaggcattgaatacctagtgaaaattcaaataacattctttactatttattacctaacattttttgctattagtgctgaaatgtgaaaatgaattacaagttaaaggagcaaagtaattttaatacttaattttggagccttactgaatgcaaacagcatagtacaaaattcaggaaactagtattgacctttaggcaaagattttctgaaataaaggtttaaggtacaatttgggttttcatttgtggttttccacaaaacattcattttcagcttttttttagagacagattttaatttattactccaaaactctctaaaatcataatatattgttattcttttccccttacattctttactaaatttttaaccatattaatttattctgtttggaacttaaggataaagacttgtcaaataaggcatagttcataaacaagagaaataactagtgctttaacaaaatttctgtaagttttttctccttttgcattagagactattttggggtaacaatttaattgtgatagggttttttttgttttgttttttttgaggaagacataggtccaaagtaacaatgagaggaattaytattaatcagtttctgaaccagtggactcaatgaaattgagtttcgtttgactgtttttcattagtggtgaacagtttgggttattcattcatttgcttgttcattcataaacatcaaaagccrgtatatttaagacactgaaaatcttaactctactaatatgtgtcctcaaatacttgctaattatatatcaaatgtgtttaaagtacatagtgtatatggtagtataaagtactctagaacaaacaactaaatagctcataaaacagttatctacttgaccattgataagtacaaacattatgttctactagagctataaaatcaaacamacttacatttcaacccagtgggcatatgaaggattatgacttagttacatcctatgtcttcacgtgtgcatctgtcaatttgtgaaacttgtaaaagtttagataagccatgaccttggataactacatggcattttaaatggaaggtarccatttatttattttattgttatcttaaataaataatgagtgatatacttagatctttccaaggatttactaaataaatatgcatttaaagattcaggtcctcaaaaaatttaaataaaactaccatatgacccagcaatcccactactgagtatatattcaaaggatattaaatcagtatgtcaaagaaatatctggactcccatgttcattgcaccattattcacaatagcttagatactgaatcaacctaagtgcccatgaacacatgaatggataaagaaaatatggtatatatactcagtggaatgctcttaacctttaaaaagagggaaatcctgccacttgggacaacatgaatgaacctggagaatattatgttaagggaagtaagccaggcacagaaagacacataccacatgatctcacttataagtgggatctaaaaaagtcaaaatcatagaacagaaaatagaatggtgactaccaagttctgctggtcgggagggccgagtgattgggaacatgttgaccaaatgataaaaaatttcagctaaacaggaggaacaagttcaattattgtataattgactgtaattaataacaacatattatatacttgaaaattgctgagagagtagactttcagtgttyataccataaaaaatgataagcatgtaaggtaatagatatgttaactagtttgatttagccatttcacaatatatacatatttcagaacatgttatacactgtaaatattgtgtcagtttaaaaataaaattaaaaggtacttttacccctaaaatcaaatttattttacaatgatattacgaggaacttaactattttctgagtatcggtatcaccaatcccttgttgttaacttgagaaaaaaaataaaggtggaataatgcaaactggaagcctttatatgatatcattgattaaaatatttgatgaaagtatcctttatctaataaagtttactaatgcrttttaacctaattatagaatyatatttgatttctctttaatataccaaccttcagtggaaattttattcaaaagattattttttcttatatggtattgtgagtaagaaattaggaaaatgggaaatgaaaaaaaacaaaataggatactttttctttgcccacctcccttccatttgtcctttttrctttctatttaaaatttgacaaactaaattctatttaaaatttgatgatttctcctttaactttatgtccttttctttattacacatatatagaaaagagaaaaaaattgaatcaccccagtttaactgaaagcaaagaatctacaacaaaagacaatgatgagtaagtttgttatttttgaaattatatatgtgtatcttgcagaaagacgttcatatttgttaaagtgaccgtttaaaagcatttatttgtagaaattaatagtttatacctgacctgaaatattctttcttaagtaagtagaataccttagttgtgatgtggtttgtgatgttctrtaatggttatatatgatgccttaattttaatactcattgagccctgttctccgagcctatgcgtaatagaccagcgcagggtaaaactgaggaagacacttatttcagatttacatggatggagaagtaatgcgtggtttaggaacaaagtgtcttaacaaatagctggttcaggatggagctagaaacagtgaagccagcagagtgagagatctagaggaacctggaaggcctacatgcgagcaaccaatctttttcaaattgtcctgctggtggttcctttgaatgaagacattatctgcagaaagtctacgtaggaaaaatctgggaagaatacagatggctctccatgtctgtgtattacacatttgtggattcaaccaatgacaaattgaaaatatttcgagaaaaaaatgaatggttgcatctgtcctgaacatatacaaacttttttttcttgccattatttcctaaaccaatatagtataacaactatttatatagcatttacattgtgttaggtattataagtaatctagagatgattaaagtatatgggaggatatgcataggttatatgcagatacaccattttatataggagacttgagcctccatggattttggtatctgcaggagtcctggaaccaattctccacagatattgagggacagctgtatttgtatcttcttcctggaaggattgaattaagcagaacaggggttaaattttcaaagtagtgcatatgtttagctcatttaccatttcagtgtatcttctatgtaccacaccaatggacactaaagagtaaagagaaggaaaatgaagttttccccattgggagcttatgatcttttttttttttttccctgagagtctcactctgttgcccagcctggagcacaatggtgtgatcgccattcagtgcagccttaacctcctgggttcaagcaatcctcccacctcagcctcctgtgtagctgagactacaggtccacgccaccacgccctactaatttttgtgtattttttcggagacggagtttcgccatgttacccaggctagtatcgaacccctgggctcaagcgacccactcgcccaggcctcccaaagtgctgggattacaggtgtgagatactgcatgcagcctgggagcttatgatcttatgctgtaagttaatataccttcctcaatttagaaatgggttatgtttacaaatgtttttggagtcatttacatggaactcagaatgcattttccatgcaaatagtgttataatctgtggctacagccccaagtcagggcacagatctatttatttcataatatagctgaactatatagttttggtagtagtccagattaaaagatgtggaaactgagtgccatttaaaatactttagggacaaagagaagagtttttcaaagaagcctcattgtttggcatctcctccatctgtcctctgtttgcttttagtagctgttttccctcgacatgctgctcctccagctccaaatatttgcgtgtttcagtcttttctgccccacaaatatttttgttgtaaattatttcttcctactcctaatcaaagcttttgtttcctcagtgaactgatctcaactagatattaacaggaaagcattcttttttgtttaacttatttaatgttttttaacataggaaatatatgtacacaggaaaaagttcaaattatacaaaaggatatacagtgaaagcaagtagcaagtaaaaatttaaaaattacagataatcttgtatttgacagcaggtgcctgctaaaccaaattaatttctggtgcagttatataaaatgtaaataggcagcaaaggaggaaatgttgttggacaaaagtgataccagataatcaagcctgttgtttttctccctgaatcaggtccacttaaacttaatagtgtctttccttctttcttcttgtaaacccatcaatttatttagagcttagacttttaaaacaatagctcccatggcagtgggcttcaaggagcaagggaagagcaagaatcattgttatgagtcacataggaatttgcctatgtttacttaatttattaatttctctccatatttgtttctaaagatctctgttatttaagtatatcactccatgaattggtgttataattagtgagtttaagtaagagctgagacattttacaacatataaaaataataggccgggtgcccattattatctactaaaaatacaaaaattagctgggcatgktggcaggcgcctgtggtcccagctacacaggaggctgaggcaggagaatcacttgaacctgggatggggaggttgcagtgagttgatatcgtgccactgtactacagcctgggtgacagagcaagactctgtctcaaaaaaaaaaagtatttctatcaggagactgaggaaagaagattgcttgagaccaagagttcagggctgtggtacactgtgatccctcctgtaaatagctgctgcacaccagcctaggtaacacagtgagaccatctcttaaaaaaaaaaagaaaatgatacgtttcttttttttttttttttgagacagtgtcttgctgtgtcacccagtctggaatgcaatgacacaatctcatctcactgcaacctccgcctcctgggctcaagctgttctcctgcctcagcctccctagtagctgggattacaggcacccgctaccatgcacggctaatttttgtatttttagtagagaccgggttctgccttcttggccagactagtctcgaactcctaacctcaggtgatctgcccgcctcagcctcctaaagtgctgggattacaggcatgagccaccgcacctggccaggatgcatttctgattgtttttttcattcattaaaataactcagttctagctaataaagccatttttatctttagtaatagsttctttattccatttgtttagatttcttttattttttaaaaccactgcataaagacttggattttttgtttttcttaagaaacagagtcatgctctgtcacccatgctgaagtgcagtggcacaatcatagcccactataaccttaacctcttgggctcgagttatcctcccacctcagcctcctgagtagctagaagtacaggtatgttactacccctggctaattcttttatttttttgtagagatgttttcttgccatgttgcccaggctgaacttgcactcctgggctaaagcgatcctcttgcctcagcctgaagacttggattttgtaaatctcaaattaaatggaatattgccaggcatggtggttcatgcctgtaatcctagcactttgggaagctgaggcaagcaatttgcttgagcccaggagtttgagaccggcctgggcaacatggccagaccctgtctctacaaaatttttttttaaattaggtgggtgtggttgtgcacacctgtgatcccagctacttgggaggctgaggtgggaggatcacttgagcctaggaggttgagggtgcagtgagctgtgataatgtcactactctccagcctaagcgaccgggtgagacctcatctcaatcaatcagtgaatcaatcaataaacaacatttcacatttgtggatcagtttttgtttttgtttttgtttttttattttatttatttatttttttttttattgatcattcttgggtgtttctcccagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatctcgcacccttaatccatttaaccctgagtggacacagcacatgtttcagagagcacagggttggggataaggtcacagatcaacaggatcccaaggcagaagaatttttcttagtacagaacaaaatgaaaagtctcccatgtctacttccatccacacagacccggcaaccatccgatttctcaatttcttccccacccttcccgcctttctattccacaaaaccgccattgtcatcatggcccatccccaatgagccgctgggcacacctcccagacggggtcgtggctgggcagaggggctccccacttcccagtaggggcggccgggcagaagcgcccctcactacccggtaggggcggctggccgggcggggggctgaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggagagggagagggagagggagagggagagggtggatcagttttaaatgatcataacattttatgttttgttttggcaatattctttttttttttctttgcaaaaatatcatagctaggagagataccagagacgaagcaaggcatctgcttctagaataattcctgtagcttcagtaccttgatggagtcactgtagattcagtgtttggtcctacactatacaaatttagaaactcaccatgagatgttgaagcataaggaattaatgaatactaatcagccttaggacaaaccgaaaaataatggaaatgccaatttattatgagaactttattgatatcagtagttttctcaggacagcctcttctgaaagtcagtctgttcagatttaaaaaaaaaaaaaaaagttattcactttgggaggctgaggcgggcggatgacgaggtctaggagcttgagaccagcctggccaatatggtgacaccccatccctactaaaaatacaaaaattagccaggcgtggtggcttgcacctgtagtcccagctactcaggaggctgaggcagaagaatcccttgaacccaggaggcggagcttgcagtgagccgagatggtgccactgcactccagcctgggtgacagagtgagactccatctcaaaaaaaaagagttatttaaagatattccacaatctaagaagtagaattaagggagtaagaagttttaacagataccttcatttagctgaattagttgtatatatccttttctctacaaaagatagcactgttatttgttatcagcatgggaaaaattttatctggacccttaccctcacaccatgcacaaaaatcaattccaggtggattggaagtctgaatatgaaaggtaaaagaataaaacttttaggggctgggcacgacggcttatgcctgtaatcccagcactttgggaggctgaggtgggcagatcatgaggtcaggagatagagaccatcctggctaacacaatgaaactctgtatctattaaaaatataaaaaaatagccaggcatggtggcgggcrcctgtagtcccagctacttgggaggctgaggcagaagaatggcgtgaacttgcagtgagccgagatcgcgccaccactgcactccagcctgggtgacagagcgagactctgtctcaaaaaaaaaaaaaaaaaacttttagaggactggaccttggattaggcaaaatgccaacaataaaagggaaaaaatggataaattaaacagctttaaaagtcctttttataaaaagaaactttttagagtgtgaaagtacagcccagcgtgaaaagatttgcaagacaatccaatagaaaaatgggcaaaagactttaattggtacttcacaagagcagattttcatgtaaaccagcaaacatatgaaaaggtactcagctggaaagtgtcatctgggaaaatgcaaattaaaacctccatgaagcaccactacatcctcactagaatgctgaaaatagaaaagaaggaaaatactgggtagatcttctggagtgagaatgtggaacaactggaactcaaataaactgctggtgggagtataagtagatgaaaaccactttgggaaactgtttggcaacatctaaaccaggatatatgcataccttatggcacagaaattccacttcagggtatatacccaacagaagtgtatacatatatttacccaaagacaaataccataatgatcattgcagtctaattcctagtcacctcaaatttgaaaatatccagatgtccatcaacagtcaaatggataaacaaattatggtatttatctaatggactacagtgaaaattatctrtagctaacaacaatggctgaatatcacaaacataatgttggatgtggaaaaaactagacacaaaaggtttcatagtgtataattccatttgtatgaagtataaaaataaccaaaactaatcaatactgctaaaagttagtagttattcttagtttctgggatgttgtcagtgttctctttcgtgatctgggtactaactgcaaytgaatgagctgtacacttatgtgtacccttgtctcttcttttatttctatactaatagactcccaaactctcatgtaaatgaagtcttgtgccgagaccagctcggtcggggagaccctaacccagtggygctagaggaattaaagacacacacacagaaatatagaggtgtgaagtgggaaatcaggggtctcacagccttyagagctgagagccccgaacagagatttacccacgtatttattaacagcaatccagtcattagcattgtttctatagatattaaattaactaaaagtatcccttatgggatgggctgaattaaaggaattaaaggaataggttgggctagttaactgcagcaggagcatgtccttaaggcatagatcgctcatgctattgtttgtggcttaagaatgcctttaagtggttttctgccctgggcgggccaggtgttccttgccctcattccggtaaacccacaaccttacagcgtgggcgttacggccatcatgaacatgtcacagtgctgcagagattttgtttatggccagtttagggccagtttacggccagattttggggggcttgttcccaacagtcttgaacaacaccagcaattttttcagacatgttatatgattaagtagatttttaacttttggactgcatggccttgcctgggacattttccaaactgtgttctataggacatttgtatctttagatatgcccataagtgttcatggggttaaaacataattttgggtcaggcatggtgggtcacgcctgtaatcccaacactttgggaggccaaggcgggcagatcacctgaggtcgggagttcgagaccagcctgaccaacatggagaaaccccgtctctagtaaaaatgcaaaaattagctgggcatggtgcccatgtctgtaatcccagctactcgggaggctgaggcaggagaattgcttgaacccgggaggcagaggttgtggtgagccgagatcgtgccattgcactccagcctgggcaataagagcaagactctgtctcaaaaaaaaaaataataataataataataatttatggtcaaataggtataagtaaaggagatatcttcatcttaaggatttacaaagcatagtaagtaaacatgggtaataatagctagtaattattgaatatttgccatgtcttaggcatatattatcacatttaatcctcttaacaacccagtgaggtagataatgttattgccctaacaacggtgaagaaactgactttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacaccaccacgcccaccttatttatttatttatttatttatttattttgagacagagttttgctcttattgcccaggctgaaatgcaatggcacgatctctgctcactgcaaccaccacctcctgggttcaagtaattcttctgcctcagcctcctgagtagctgggattacaggcatgcgcaaccacgcctggctaattttgtatttttagtagagatggggtttctccatgttggtcaggctggtcttgaactccctacctcaggtggtccgcccgcctcggcctcccaaagtgctgggattacaggagtaagccaccacgcctggccaattttttgtatttttagtagagacgggctttcaccatgtgggccaggatagtctygatatcttgaccttgtgacctgcctgcctcggcctcccaaagtgctgggattacaggcgtgagccaccgtgcccagctgcagacttcttttaatcattgtactagagtaactgacactatggtttactatcttattttgtctgcccagcatctcttcctgctgggattaacattctttaaatcactcgttaccccattccaataatgtggctctttatttaaagactaccaaagtcttacatgaccctaccctggacagttgattggtccaggggtaggcacctgacctaaacacagtcagtcagttatttcacagaatttataaaattggaagtaggaaaagagactacttctcagatggagatcttcaagcacagatgatactggcagccatgttttttactatgtattaatagatgaactggtttgcagtgagagagaaagaagcccatagccagagagaagagaggcattaggcagggtcctgtttgtcttctggcttctttctgttgctccttaagccttgctcaacctcagcttccctttgattatgggagatactctagtatccctccaataagtgccccctttttgtcttaaaagataaatatgtttaccttcagtcatttaccaataaaagaagatacagtatgtaagattacttcagggtttctcaatctcagcactgttgacatttgggttgggtaattctttttggtagaggctgtcctatacattatagattgcttaacaacatccttggcccctacccattagataagttgttagaacacagtgtggtattatgatggccagtatgacctatagatatgtctaatagagtctataaaactagaagatacagtggctcatttctgtaatctcagcattttgggaagccaaggtaggaggatcgcttgagcccagaagttcaaggccagcctgagcaacatagcgagactccatctctacattcaahcaatcaatcaatcaatcaatcagcaagcaagcaagctggatgtggtggtgtgcctgtagtcccactactcgagaggctgaggtgggaggatcactagggcccaggaggtggaggctgcagtgagtggtgatcatgccaatgcactctagcctgggtgacagagcgagaccctgtctcaaaaaaagaaaaaaaaaaccctagaaaataactataatttagaaagcaagatgcttttaaaatacattcttagccagttagaacaaataatctattttctgatatgagaacactaaatgttaatgattataaactactacaaaacaagtttctaaataaattttcttatttgcaaaagctagtgaatagtcaatatccatcactggcctgtaatcccaggactttaggaggccaaggagggaggatcacttgaggcaaggagttagagaccagcctgggcaacaaaatgagaccccatctctacaaaaactaaaaaaatgagccgagcatggtagtgtgcacctgtggacccagctacataggaggctgtttggagaatcatttgagcccaggaggtggaggctgacatctgcaggccgaaagagccatggccttggaagggccataaattccaccacactcttggtggctctcaccctgcagcttggagaaggcgcaatactccattaccactaatataaataatgtttgtaaaattcttacctaataaaacatttaggacaggcatgtctgcttacaagtaaggtattttttgtctgttaaaactagtctgtagcttgtttcatgaatgctttgtcaaattatggaagttaaagtgcaatgatawttgaagactataagtgatggtgtatcttgtttctaataagataaaactttttgcctttgttttatcttattagggaattatatgtcagtgtttgaaacatgctgtgtggtataataggtttaaaataaattctttaaaagaagaatactgaaactagccttgtagatatgtctggtgcacgtgatgaaacgtacagctttattggggttggtggcaatgccctgctggctaactttcaagtgactgggttttttaagtttggcaagtacaaaattctaaaattgggttttcctttagaaatgtgtagggtcgggggaggatgtcctaaccgtatgttgtcgtcatatgtagtttcatccagtgttccacatgtgtgactgctgtttctgagagaagtttccaaaatgtcaccatttctcagaactgaataaacgtattgccaagaggcttttcttaggaatgaaacgtatctgggtaaatgtaaacaaaattgtctctgtcttgacagtaccaaagttcacataaaaggtgaaagctcctggatcaatgccatggctccatggaaggcgatggatagtagatacatattaaaatatctatctgtaacactaatttgttaccattatgaatcctttcrgctgcatttgaggaaaaagtagttggctatttagaagtgtgtacatcattgttagtcattcttacagataaaaacatcttgggtcagcccactctgtccactcttataggctacagagaaaagtcataattggtgtcaatacaagttgatggtttccaatcttaaaaaaaaaatttaattaaaataaataaaaaataaatgttaaatgcagtaaaactacgaatttgaatagaaacatgactcaaatcatttttacaaatacatagttttgtttattcaaacaaaaatcttgagacccttaaaaacacaaaatttatgaagtagagttcatggagaaaagatgcttaagaactgcaaacaaaatttcccactggggctggatgtggtggctcacacctataatcccagcactttgggaggtcaagtcaagcagatcacttgagttcaggagttcaagcctgagcaacatagggagatcccatctctacaaaatttttttttttaattagcaagcctgggtggtacatgcttgtagtcccactactgaggaagctgagatgggaggatcactccagcgcagcagattgcactctagcctgggagacagaaaaataccctatcaagaaaaaaaaaaagaaaaaaatcccacgggtaaaatatctataaataccttttgtaagcttttaacagtttagagacattttttaaactttagattcttaaataattttaaatttacagaaaatttgcaagaatattaaaaagaattcctgaacactcccccagagtcgcaaattgttaacattttgtcacatgtactttcattctctctttcacacatgtgcacacacatacataggtactcaaacttttctgaatatttgagaagttgcagacatccttttttactgctaaatccttcagtgtgtatttcctaagaataatattatttaaccgtagtaaaaatattaaaatcaggaaatttaacattgatataattactgttatctagtgtatagtccaaattcaaattttcctagtaatgttctttattgcaatttttctcttgatgcaggattcaatccaagattacataaatagttcttaaagtttccttcaatctagaacaatttttttaaccttttattgtcttctctgacagtgatatttttaaatagtgtagactgttttttgtacgtcattcctcagttgtgtttgcctgatattttgtcattattcatgttatgtattttggggcaaaaatatagaagaatgttgaattacatcaagagatattttgtcctattattgatgaattttaatcatttgattacagtgatgttyaccaggtttatctatattaaaagtaatcattttccctttgtaattaataaatactttgtggggaggtactttgtcatgtttcacccagtagttttaacatacattgatgattcttgcctgagtcagttattactgtaatgattgccatagtcataattttctaactccatcatatctatatttattagttgaccttctgctggttggccatttaaaaattcatctgttcatagtgatacaaggtttttccttgacttccccttttccatatttctatcccatctcaaatctaaatctctgtctcctaagagcagcaataaatttgcacatttgcttaatcctacatcatacacaaaatacttgcagaattcccatgctcacagcactgctaaaaacaaacctgyaaagcattcaagatttgtttgcagttttttgtctctaaagatatatagtcaaattactgttttcaaaaattatttggattagttcttcatttgaagaagtattcatttgaaataggttttcttgtycgtgaattttacttttttctcatcctttttgactttttaaaatgagataagccatcattatggttctaaaagtcaaaactgttgccaaaaaaggatactcagagtagtgttaatccctccctcattccttctacctatttcttgtgggtaaccaaattcattagtttcttatttacctttcctatgtttatttccataaaattaagcagtttcatttattttttcttatttttttatacagataaggtggcacaccatatgtactcttttcactttgccttttttactgatgaatacgtcctgaaatcaattcctattgatcaatttggagaattttaaatgtaagaatcctctcaacaggaaaatacagttccatgttctaggtttaaaaatgtttttttcttcacaaaacaagtagttaatggcatgtcaataaagcccatttgtaaaaaaacagctacacrttaatattttatgtgaacttccatatcctttatgttttgcaaggaatatatataatttactgcgattggcttttcttcctcttggcaatttgctgctgctgtagctggcattgctatgaaaatgcagtaatggtgactgtcctgtaagttttattttcagataattgtagatttacttgccattgtgagaagtaaaacagagacatcatgtgtattgttttcctagtttcccaacataacatcttacaaaactgtagtacaatatcacaaccaggaaattgacattgactcaatccactgatcttattcatatttcctgttttgcaatgaactcatttgtgtgtgtgtatttagttctgtgcaattttatcacgtgtagattcttgtatctaccactgtagttatgttacagaacagttccatcaccgcgaggatcccacctgttgtataggactttttttttttttttttttttttgagacagagtttcgctcttgttgcccatgctggagtgcaatggcatgatcttggctcactgcaacctccaccacctgggttcaagtgattctcctgcctcagcctcccagatagctgggattataggtgcacgccaccaccatgcctggctagtttttagtagagacggggtttcaccatgttggccagggtggtcttgaactcctgacctcaggtgatccacccacctcagccttccaaagtgctgggattataggcatgagccactgtgcccagcctaggacttatttttagtcactagctcattctctcttacaggcagaagagtaacttttttagatgtgtattttttgttatttctgcactaacccaaataaaatctttttaatagtagtgagttatgccagaactggttttttaaaaatttttgttgttttgttttgcattatgtatgcaatttaattgtgacaaccactggtcagtattctaaattcctcttaactgctcaaatgatggtctctagggataagttagttgaaaatgtttatcagaatcttaggatgaagatataagcctatattccatattaggcctattctgtaggtgagcaaaggctaagaggaaagccaatcttaaaaagagaattattttcaactgtttaaaattttagatatggaagactgaaagctttcccctaaagatcaggagcaaaacaaggacaccagctttcaccactggtgttcaacattgtattggaaattctagccagagcaattagataagaaaaagaaataaaagtcatttaaattggaagggaaaaagtaaaacaatctttatttgaagacaagatgattctctatagagaaaatcccaagagtgcacaagaagctactagagctaataaacagagtcaaaaaaagtttcagggtataagatcaacacacaaaaatcagtttccatatacctgtaatgaatttgaataggaaattaaggaagcagtccattgcagtagcatctgaaaggataaaatacacaggaataaatttaactaaagaggtaaaaaacttgtacactagaaactacaattcatttttgaaagaaattaaagaagatctaaataaaaggaaagatattctgtattcatgggcaagaagatttaatattgttaagatgttaatgctactacccaaagcaatctacagattcactgtaattcctatatttcttttgcagaatgattaaacagcattttttgcagaaatggaaaaacctgtccttaaattcatatgaagctacaggagaccctaaatagccaaacaatcttgaaaaaggacaaagttggaagactcatatttcctgatttcaaaacatactacaaagctacagtcatcaaaacagtatggcactggcgttaacagtagccatagagaccaatggaatagaattgggggtccaaaacaaatgcatacatctatggccagttggtttttgacaaggaggccaagtttatttaatggagaaagaatagtctcttcaataaatgttgctgggaaacaggatttccttacaaaaaagaatgaagttggattcctacctcacagcatatgtaaaaattaaatcaaaatggatcagtgacctaaatataagggctaaaaccatttataactatcttagaggaaaacataatgataaatcttcatgaccttgaatttgttgatagattcttatataacaacaccaaaagcacaatgaacaaaagaaaaaataaatttgactttatcaaaagtaaaagcttttgtgtttcaaagtacaccatcaagaaagtgaaaaggcaaagcacagaatgggagaaaatattttcaaattatatatctaataagggtttaaggtccagagtagatcaagagcttccaaaactcaacaagaaaaaagacaatccaattttaaatataggcaaagacttgagtagattttttttttttttttttttttttttgagatggagtctcactctgtcgcccaggctggagtgcagtggcgcaatcttggcttactgcaagctccgcctcccgggttcacgccattctccggcctcagcctgctgaatagctgggactacaggcacccgccaccatgcctggctaactttttttttttttttttttgtagttttagtagagacggggtttcaccatgttagccagagtggtctcaatctcctaacctcgtgatctgcccacctcagcctcccaaagtgctgggattacaggcatgagccactgcgccaggccttgagtagatatttcttgaaagaacttatataaattgccaataaacacatgaaaatatattaaatatcattagtcattaaaggaatgcaaatcaaaaccacagtgagaccttacatcttaaaccttacatctacgaggatgtctatttaaacaaacaataaaaatggaaaataacaaatattggcaaggatatagagaaattaaaacccttgtacattgtagctcctgtggaaaacagtctggcacttttctcaaaaagttaaacatataattaccataagaccaagcaatttcactcctaggtatatgcccaaaataaatgaaaacagtgactcagatatttatataccaatgtttattccatcattattcacaataaccaaaagacaggaaacaacccaaatgttcatcagcaaatgaatggataaagtgtggtatgtacatgcagtggaatattatttatttatgaaaaggaatgaagttctgatacatgctacaacattgaagaatcttgaaagcattatgctaagtgaaataagccagacacataaggacaaatactgtaagattccagttgtatgcaatgtctagaatagactaattcaaagagatagaaaggagattaaaggttactagaggctggaggtgggaagcatgaagagttactgcttaatggttatacagtttctgtttgtagtaatagaaaacttttggaaatagatagtggtgatggttgcacaacattgtgaatgtaattaatgtcactgaattgtacatttaaaaatgtttaaaatgacaaatcttgtatatagtttatcacaataagaaatttttttagaaaaaattttaagctgaacggaatgcagaaaagctccttgagacagcctgtaaaaatgtaatgaaataaatagagctaaacacgggggggaatttttttttttgacaaagaatgtcaattttatttatattgaccagatttttttgtgatcagtcttcaggaaaaatgtttttaattaatttttatgtgcataagaattgcctggaaatgcatatttctgaccttctctgttagtagttcttggatgcagcccagaaatttgtatttttaaccatttaccaaggaattctgatgccagttgtaactgaattacacttttggaaatattatataatggttgagaacataggtcaaacacacctgggttcaagtcctgactgtgccccttgttataaaacccggataattaaataatttattggtacttcagttttcatagctgtaaaatggagacagtatttcccacagacagttgttttgaaaattaagtaagatatagtttgtaaagtagtaagtatagtgccttaaactaagaaagcattaaraaaawgttaacaatatatttcattgttttcataattcaactgtcatccaaaattatcagtttaggtcaagggagatggagattcagtgacctatttacctttttctgcgtgaatcatagtattgtaaagataaagaaaacctaaggaattcatccctgttatgtacattttaatgcacaagtcttgagatttataaaagtacaatttcttagaggtaataactttcagataatagcttttagtaatagaattaattagtagtgtatttgtggcctttgagaatgctgtattagaatactaaggcagaaatctaaatacaagagtttaattttaatatggaggaagtggagattgggttaggctgtcatgttgagcagaaatttgtgaaagaagattcattaaattaggtacatggagagttaagcarcattgggtgctcagcaaaatcatacttctaatattgactgtcaattctactgtgagacttttttttttttccatagtactgacagcttagactaggagcaatgaaaacaaatagggacatccagggttacatgtgagaaagacatatgtggtggaaagttagggaactgaattaattaactttgtcagcaatataactgatgaatcatggaaaatatataagacaatatgagaaggaagtaaaaaaatgagaaaactgcaggatgggcatacttcacttgaatctagggatggatggtcactggaccaggtcttttttattctgttcattgatccatcaaatagttactgggtccctcccataactgcaggcactttattagttaacacaggttgtaacartaaataaggtagataccgcccttgccttcacggaacttacaatatggtaagggagacctatgtcaaacaattggaagttacaaaaaaggagggaaatcaaaaattttttcaggccattatcatggcttttacagggtttcactcttcttccactatatccacaatgcctacacagtacagtagataccatggcttgcatccgagggaatctataaatcactgggttcctttttcatctgctctactcctttgcttctcattctttcacatctaggatggcacagcaggagctgagttaatgcttgctaacacctgcttcaataaatctgaattagaagcaccaatttaatacaatttctctttgttcttttagttctctcctcagaatacatctgaggaacttaatagagaaaaagtaaatgatgaaactacatttgaagctaagaatggaaaataattgaaagaattgaaagtggccaagataggaagaacccagaactggtacagaatgatagttttgaaagtcaagttacacctgacttgagactgaagaagttaatgtagaaggaaggaaaagcagaattaatggatacatccaatgcttctcatggattttatttggctgatgcacctaatttcagttgtttttcagaataaagactttttctttgaggaatgtgagagaactctgaatttcacaatgcaactcttctaagcaaattggaaaactgcactgaaaatcctgaattttgacatgtagctccctcaagagaaaaactacgagatgctttaaaaaaatgctgctgggtttttactctacgatgaaaaagaaggttaattcaaggaggaccaagacttcagatttcttaggttgtgctacagtagtctttgaccacaatgcagatttgattaaatcttgtaaggatgccgtaaaactggcaacagtcactggatacctggatgtagtggcccattgacatctggatggctcaaagggtcattataagataaaggatttggtccaatttagtctagcgagaggcaaatctatttgagaaagaaatactattctgcaaaatatgaatggcacccaatgatgatacttttactcaccaacttgaaagagccacaataactttgaaattttgtaccataatgaacttgagaaatatattcttcaggcagcttgaaagaaatgaaagatcgttggttttcaggaataaacaaattagtaaaggaacatcaagatgatattaaaaaccaagggactgtatgcaaaccataatgctatgttagggcaacaaagtgaaatttgaaccatgcattgaaaatacagaaaagggctctcagtagcaatgcatatctacttttcagcacaagtaggatgtttatgagaattccattttgtctaggatgaagaaagtggtagaattatttctcccaaaatctgctcagcaaatagtttatctccaaagattatgaaggcttcttcagtgattcagaaagtgtggaaaagaatgccttgaaaaaaaagaatttttcaggatttaacagttgtataacacttaaaaaaccattcatgggaatttggttgccttcaaggtgggaaaaaggtgatttcgtctagggagaagaaaaggaggaggagaggaaagggaatcaaaatagtaataagaagagcaatggcatgtctactagtcctactacttgatcctgcaatggatacaagtgtccttgagaaagcaccttcagcatatcaaagatgttttgaaaacaacttccccagataattgatatttaatccatacaagtctccaagattgttaaaacagtttgttttagcttagcccctcaattactatcttaatttaggagagctgctagtaggtcctttggggatgctacattatacaactttggggggcaccatttacatctaactctatgtgaacagagccccttggagacattcaagatggcagtcctgcgggacctaatccttcccacacaattccctatgggttaacagggagtaccatcagctcattaagatagggtaagacagtttgaaaaggctctactattccagttctcccaggaaagggatgcaaggtataaggcaacaagcccctcagattatttctcgtagcaaagtaacttatttgcctccactttgtactcctagggcactcagtaggctttggcatcatatatgagaagctagaggatccagccttggtgggagtcccttaagtccttgtttcttcaggtctttggatccaatttgaagaagcaggaattcctttatgataccatctctcaaactgaggttctcctgttaagcaatcagggcctcagacagatgacttctgattgaaaatacgtaataaaggaaaacttttaaagaaaaaaaacacccaaaattccactgtcctcataatttttagctttttcataatgctatcaaaagtctcttgtttcttgttcgcatacttagataaaattttacttagttgaaacttactgtacatatacrttgtatatcaaaattttaacatatttgtcttatttttaataacaaaaatgtcaatgactaacactgatgtaatcttgaaaaagcatttaaatagaatttctggtttctctcataaaatctatatggatttatgctgtttgaaacagtacgcactagccatacatggctaatgagcacttgaaatgtggctagtatgaaatgagatgtgctgttaatatgtaaagtatacctggatttgaaaaaagtataaaatatctcaataatttttatattcattatatgttgaaatattttgaatatattgatttaaatacttaaacatgaaaattattaaagaaaatttacctttttattccytttagtgtggctactaaaaattttaaattacatatatggtttacattatttttctatcagactgtgttgatatagattatcacaaacagctgtggggtcttaaaattggaaaagcaactaaaattttaacaataagggaatgtttaaatcatttttagtatgtttactaaatagaatattgtgcagccttcaatatgtggccccccaaaatgtatataatattgtattaagtaaagaaagcacagccagacaccatggctcacacctgtaatcacagtgctttgggaggccaaggtaagaggatcgattgaacccaggaggttgaggctgcagtgagccatgatcacaccactgcacttcagcctgggtaacagaggtaaaccccatttctttataaaaaggaaaaaaaaagtatgataacaaagttacacaatttttttttttaaactagaagcatttttccaaaaagctaactggagatatgttcagaagattgaattccaagtgatgttttcctcttttccttttctttattttcatatttaaaataaagtcataaaactttttttattttaaaaagaagttactaggtgatactgattcatagactcagatcaaggtaaatgaaggaatggtggtgtattagtgttctcaatgtggcattgtggagaaaggaacagccaactatgtcttccatcccactgctcagtgggaatcggaaagtaaaactccaaaagaggggacagttgataatatatattgtgtttgtaaagaatgaaagaacctaagtctaaggtcctttaaaaagagttaaagctctgaaaatgatttgccatgtttaaatgcttccccttgctaagtattgtctttttctttattactagattcatgatgttgctatcaaaagttgagaaattgtcagaagaaatcatggagataatgcaaaatttaagtagtatacaggtttgcattttttcatacttctaccctgtttgaaaaggataaaatsaaagaagtgtcccagattggagaatccaatccaggaaagagtttgcatagagtatgtttaatttacttttcatgggaattttttttttaataggagaacactatttaaccataatattttagtaatatcttgcttttcacatttaaacataaatttatagattacatttagtctttttagttaattataaattgttttttttcaggcatttttgggcttgaaatagttggcctgccagaaacagttaaatatcctaacataaagtttaagtttttcaaatgaaggaaacaatatactgtattttcactagacatgtcagtaatctcatgtgtgtagagaacttaactcattcaagatgactttcttgtaggctttggagggcagtagagagcttgaaaatctcattggaatctcctgtgcatcacatttcttaaaaagagaaatgcagaaaaccaaagaactaagtaagaatttttgagttttcaatgacagtaattttaaagataaacctattaatttgtctcatttacatttgatagacttctttatatataccattactggacatgtgataaaaatactattaccttctttaaataagaagccacatgtcttttatcaggatgtgttattttggggattcttcttgaatgtgaatgaaaagaatgcaccttggaaactggtagtaggcatttcaaatgtaatgcccatttttataatatataataaggtattatattttatatttggtacttataaatatgtattattttgaattatttttttctcatgaagttgtttgttgcaagtattgagaaattatccatattctatgttaattcttgacatgggatttttacttcttttagtgacaaaagtgaataaacaaaaactgtttgaaaagagtacaggacttcctcacaaaggtaagtagttgtgttttagtttattacataaagatgctttcatcccattttgccaattaaaactaatcatcatgaatcctttttagtggttttcttttttcctcagagatccctgttctgaagtatgttcttttaraagatcacaaatctcatttgaaaagctttatattgcatttagcagaagatgatatctgatgagatcaacttctctgatgattgaactttttaaatgtcttttgaaatgcaatcttcaacataagatttgaattttgtctttttattaaaatttctttttgagaatacaaataggagcaacaatgcattaatatactgcagtttttagtgttgcactagaagcattgaaagttactttctaactagtattctggaaactttcagatcattaatatgctttgttctactatgaactcttatgtctgagcatttcacagtatggaaaactaaataaacagtttttaggtttccataggaagtacacattcacaccttcacacctcaataagcaaagtaatcatgaactgtaaaataccaaaacctttagactaatacaggagtgattaatagtacctacatgwatgccatttagcaatttctgcaagtggaattaggccttaaaatgggtggccgtgttttcagcctaccacttttaaataccgatgactgccatttattgagtaactataattacaaatattctgaatactaggatcagcaaatctttacagcaatgtggaaagatagctacactgtattatcattgtcattatagacaaggaacgaagacacaaaaaatattaagtaacttgcccaagacttctacttaggtaacagagcaaggattccaaccaaagaccagtctggcctcaaaaactctggtcttttcattattctgtgttatctcttcctaaaacaaatgaaatcatccaatcatcttagcttttagattcaaacatggcacataattgaaactgcttcacccaatctggtatgttagcctgggtttagaacctttaataagccagtgatcggttggcaatggaaagtgctgggattgccagccagtcagatctaaaggccagctgggtcatggcagggctgcagccatggcaagactcctccaaagctcatgtgggaagggagctgartaggcttcctgagcttttcagttgaacaactaacrtctactgtgatgccaagaatttaagaacatgaaaggtggctttttcttggatgtggcttgggatctttttaaaaaaaaaaaagaaagaaagaaaagaaaaagaaaaaagaaaaatttagaggcaggattgtaccctgtcacccagactgaagtgatgattagtgaagtgggattacaggcataagccaacacgcctggcctcttgtctgttactttagttgtgtmatttgattagaatgtgtaactgggtttcagtggtttcaatctctcctaagttgacaagttttagaggatcacaataggaaagcaaaatgtttattatttcccaactggaagaaatcttgcttctatatattctacaccaatagtgtgatttccttaaaaatctgtaacttcctagaactaactagaattaggcttaatatagttggcctttgcaaacagctttgagaaataaggaagaggaaaactctggaataaataagtgaactgtcaatgctaataatataaagaaaaatttttttaatttatatttcattaaaatatttttccttccaggggaaacttttttcatttccttatggacatctaaaatacataacttcattgtgtgtttatgcatgatcagccttaaaactgttttctattattttaggcattaaggctgacttgcccattaccagattttcccaaaggaccgagttcctgcatagaggagactgttatcactaaaccatgtttgtaaatttctaataatcattgatttaaatgaaaactcagtttaaaaaatatataatacatagtatctatataagtatgttatatactactgtgtgttatattctattctacgtagtcattgtccaattctgtttcttggcaggagctacattagctctttatatttcctgaggtattaaaaacttcattagctttttaactaattttgggaaattcatattgcctaaaaaatagattaaagcttatttttgttgtaatttgattttgagctatatagttttcctgagtgcttttcctacctctttctctggttcctaacatacatattagttttgggggttttttgtttgttttgttttttggttaatgattatgtacacacaaatgtgcacacacatgcaaattttttgtactaagctaacaacttttacccttttctgctcatacattcattttaagaggattttgctaattcttttgacatctcaaactagtttgctttatatgtccctcattttgcaatctggccttgaaatttccactttcttttatttatttatttttattatgctattacacagaattgtttaaattttaaaatgttttgggagtttgtcataatattagaaaataagtaaaataaaaatcatccctataatatgtataggatttgttaaggtaattatgaaaattagaataagccaattacttgtttcactatcaaaagaatgtccttcagattcttctgggtttttggtgggtttttttgtttgtttgttttttggtctttcagattcttaaaaaattttcctggaatagttaaaatagacaataccatgagaatttcaatatttatgctatcattgcctcttctaattggtcttttagttctagtaatatttattttttcatttcagtgggaatttcagttaatgtcagttacagtctttattacaggaagagtagaattatraaaataacactctagtgttttaaataaatagacatctgacacacattcttaaggctttatataacttattcaagagaaatttaaaacatacacaataaaattaaaaggcacactgagattttcatagtgtcataagaactggacctggtaaatcaggggatgccttgatgagagtatatgaataaaagaggatctcctctgctaaacacagatttcttaaacaaaggaaggcttctttctttcttcagttacttaggaaataagcctaattttgctttcttcaataacactggctttatgactattaggaaaataatgaaatgaaaggttctttttctgtaagatttggatgtgaattttcataattattttaaatttgttatgctgaagacttaagacatatgaccattcagtgggctgatacagatgaaatgtcacattatcatcacatggtgaggcatgaaatttatttactttacataatcaacctctacttaaaacaacttgttacagatattccttagtcaatagatggcattatatagtagttaatattttcagttttttctgaagataattaaaaataccatcgttagtctatgactagtacttccaataaacaaaatgtttttgaaaagaatgtaagcaaattgtagagcagttgccaagatatgaaatctagacacttagcttcagtccaaaacatattttatctgttttgagaataattgtgtaggttgcagtatgcatattttaaatgaaatggaaccatctgaactttacattgttcagtgttycagctgtttgtaatagaaaatatttcagaatttccaactttggtctgttttaaaaagcataaactacaatgttcctgtattctttagttaactttctgtattcttacatagtaaaattcgtcttggttatagattttaaagttatcagattcttaracaacaggacaaatttaaaactctttctgttctaacactataaaatagtttgatattgcctcttcattytaaccacccactgaagtattttttaaacataaaaatatgttgttctttccccaactcaggcttgaaaaagtattcatcatatcagctgaataatttcactcccagaagactactacccttttagttttctattttatcttaacattaaacaatatatttttttcaaacagatacttcaattttaaaagcactgaggtttgaagtttagacgtgacgacttttaggagaaacaacagaaattccccctatgctttaacattctgggtttatctggagataaaaaatgaagccattaattttgatagcacaaatayacattaatgtacaactatagtcctcagctctttataatgattcagctatcatgtatgccatatgtgaatcataacctttcctattaataatgttaatgctcttgttttacacgattcgtcattgttttggggtatgcatttcagctgctaaaaatgcttacttgagatttgtctaggatttaagtaaaaataaactgatttattacttttcaaagccttttaaataatttctttcatgatttaaattttttatactttaacagaagtatgataatttttctttcaaataaaatcagtagaaaaaattttaaactatagatttggactcacttaatagcaattaggtgtttaagaggtgtaaataacttgctatcagacattacaaatatccaggtgctcagtatgtgctgatgacaacaaaattgaaaagaaagactgtaataattctgactggttttctctgcagaagatattgattatttgtgtgtggtgagagatttggaaaattcaattaaaggagttgtgcaaaggtttcataaattttccttctacagcgtgtacacagacattgttgcgtattaaatcagtgcagcacttcacaatatattttctttgaaacataaaaataaataacatttaaacagttctgcttactacagaaacaaattttattttctgtgaagcatttagtcatgtgctatcactgactcatacacatttgccagctgtaacaaattttatagacattttccccagagacatatctcacatactatgaatttttaaatgagcaaacggtgaagaagggatgtcagcaatataaaaattgatcagttaaaagataaaagcataagtaaagagatttgtatggtagtcttaataggttttattaaataaaaatactgtaaaaagacagtaatgaatagactgaagactattcttgaggtggagaaaaattattctggcacatttagtagaaattggttttgtgtcacctgacaggtgaacttttttttcccattttttactctcagagtagtcaaaaaagccccacaaaaaaagagttagataaattatctaagtggtttacatattttaaacacaataaagcaaatgtttatagtattatataactagttatatagttaaaagcaggacttggtaattattaaatattaggtgatttttcctccagttcagacctcagataagaggagggtagtcayttttattcatactattcacaccaagtgcttcagccctctggaacctctctttcaggaccccagaacactttgctacctttccctctgcctagattgcttttttttttttattttttattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttactgagaatgatgatttccaatttcgtccatgtccctacaaaggacatgaactcaccattttttatggcttcatagtattccatggtgtatatgtgccacattttcttaatccagtctatcattgttggacttttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgcttttttctctgtcttacaaactcctgctcatcctttaaggtcagcctcagatgtcacaacctctgtgaagctctccccagctctcctaggtaaagctaaattgcttcatctttgaggctcccacaacacttgtctgaatattttaaatgtatcatgttgtagtgcattgtaattgcctggttacaggactctttctgggctcctctttggcagacaaacaaaaagtcttatctatgtatgatagttccagagcctagcacagtgcctggatagagcctggaaagaagttccacatgcagtacagccaatgtgtgatgaatgaaaagaactttttttaaagaattatctaagtattttcaaatacttataaattgctattttcttacctcattaatgtttattgagtgcctaccatgctccaggcattattctagcattgggaacacactgacaaacaaggcagacatagtcctgccctcagggatatagaatctagcacaaatgacagtcattttagtaaccataaagagtgtactaacaatggtaataagcatgtattgtaataaatgtcttggaagttttcgtaataaatttgaaaatgtatattctgaaatagaatcaggctaactatagcatgttgaaatgagaatttatagccttagagctgctattagtataaaacaagacttcaggttgttttaatttcattttgcttcaacatttattctgcatcatatactgtggcaagttgctttgaattgttttctgaaaaaaaaaamctttcttctttcatatagcatcacgtcatcttgacagctatgaattccttaaagccattttaaactgaggtactgtttcacctttctaatttagtttaaccttgtgaaatttcactgtgttttgttcaggtggaaacattttatttacattatcagatttggtattgtcttcctgtaagaaaatagggatatagctttggagctttagttgaacttatattaatctagtcttatcaacaacaggagggcatctgacatcagttagaggctgattggaaagaactgttgagctgacgacgctaactttaaaagtcagagaggacacatttttaactgagtgtaaaagggtccttaatcaagcatctttcatataaatagctaaatagactagctaaatagatgctgacaagtggactatagtttctgtaggacacatctgactgaacaagatataactagtctgttaaatttggaaatgtgctaaattaagtaaataaatctatatttattagttataccttgccttcagaacaattcctattgattcagcaatacaagtaaaaatgatgtgtttataaatagcttattataacaaataagccaaaagcaatatgagtcatgatatattagtgtttagtatacctataactgaaggttcacattaagaactgacattggctgggcatggtggctcacgcctgtaatcccagcactttgggaggctgaggcaggtggaccactcgaggtcaggagttcgagaccagcctggccaacatggtgaaaccccgtctctactaaaaatacaaaaaattagccggctagcttgcgcctgaatcccagctactcaggaggctgaggcaggagaatcgcttgaacccaggaggcagaggttgcagtgagctgagatcacgccactgcactccagcctgggcgactgagtgaaactctgtctcaggaaaaaacaacaacaaaaactggcattaggggctaggcatggtgattcatgcctgtaatcccagcactgtgagaggccaaggtgagaggatcgcttgagcccaggaccagcctaggcaacacagtgacagaccatgtctctacaaaaaaatagaaaaataagctgggtatggtggcgcatgtctgtagtcccagctacttaggaggctgagttgggaggatcacttgagcccacgtggtagaggctgtagtcagccatgatcactgcactcagcctgggtgacagagcgagaccctgtctccaaaaaaaaaaaaaagaattcttagcttaccaggtgttttgcctgctatctcttaggggaaaaaaaatcaaagcacaattaaagaattatattctacctccaagatrcttttctttggaaatggtatctcaagtgattaatattagcttcctgacaagctagtcttaatatttgcaaagcatcttatatagaaaattgtgtccgttttttatgaaaacgtttattctgttgtatgyagtaacaatagcttatattctgttgtttgcagtgagtaatagcttataataatagctaatatttattgagtactttctgttgttttgtttgtttgttttttgaaatggagtcttgctctgtcactcaggctggagtgcagtggcacgatctcggctcactgaaacctccacctcctgtattcaagtgattctcctgccccagcctcccgagtagctgggattacagttgagcaccaccatgcccggctgattgtttgtatttttattagacatggggtttcaccatgttggccaggctggtcttgaactcctaacctcaagtgatctgcctgcctcggcctcccaaagtgctgcaattacaggaatgagccaccgtgcccagccctattgagtaatttctatgtgccagcagtgttataaacactttatacgtatcccatttaatcttcacaacaacgtatgaggcaaatacagttattacttttattttataggtaaggcaattgaggcacaaacgaggttaagtaccttgtcccagaatcacctaaaacagggccaggatactaaactgagtagtctggtgccagtgcctgtgctcttgccacyacccagtagtaatctgtgaatgtcaggtttcactactggccaaggtttttatatcctgttaagtaaggataatatataaatattatccttataaatcctatatgtaataggagatatatatatattgtaataggagatatatatatatctcctatatgtaataggagatatatatatattgtaataggagatatatatatatcctattatgtaatagattatatatgtcctatatgtaatatcctacatatatgtacatatatacatatatatcctatatgtaatatatatatcctatatgtaatatatatataggatatatatatcttatatatatccatccacatacacttatattcattcattataaggttaccattttacaaaatttctgacccatgaaaatccaacagagaacatattaggtggtgatcatagatacatcgtcacagttacacatttagtaaatgaacgtgcaacatttagtgtttgataatctctgtaataaacttrcagggaattcagagtactgagaatagctttgtgttaatggattttagtaaagataaccacattttggggtgttcttttgagtctttgagtaatactttcaagaaactggaaagaattaaggttgagctaccagtcaacttccctttcagtgagaagcaaaagagcaatgacagtgaaattaagtgacttcacctttgaggcatttccctcagttctgcctttcaccatgttttcatctcactttgagcatttccttcattatctccttcgttccctgacttttcactttagtgtatatggtttccaaattattatagtctcctgggctataaacccacaatctcagctgccatacaatgtcccccaagtatactgatttcatcatttcccctccaaagatgtttttcttctacctttctagggattatatcattccattggtcaaattctctctctctttgtccccacatccaaacgctgccagattatattacttctgagaatgcttaattctcctttccacacccactgtaccagtttatttctccattacctctcttccagattatcattgtccctattgtaacctacctgtctgcactttggtccctttcccctacagcctatcctgctactggacaaatgtatgctttagaaggtatcactctaccatatgtatgataaaatccaaatttaaactgacattcaggagtctccctgatctgcccacagcttacctttccagtttcttcattgtgccttattcattccagattacttgccatttctcagacaccttccccagaaagtgcctttctcatgtccttaccttgggtcttgtctgctcaacctagcatgccttttccctcattattgtcaaaattttacccgtctttcaaaacctgcttagaactcatcttctgcataagcttccccaartccctctcccccatattctctcattgctcttttgtatatttgtcatagctgcctgactggtatgcgtaagggaggatgtgaatgaaactcctgattttgtccttatgccctagaaacctgacagtactcctgatatcaccgtggccaacttccctacctgcacaactgctccagccctctgtcacacttcagtgattattcctcttgacctgtaattgttcagtggggaggactgtcccatacarattcactcccagagcctttaaaaagtgaagcctttgtgaaacaatgctagaataagagagaaagtaagggtgacagcaacccagaggccacagccagagtgctaagaccatcaaaagatgggaagagaaaaacattttggctaatgataacgggatattgggatactttagtaacaatgtggatgaatcacttgggtaacacaaggatgaggcttagtatgaacaaagcgctgtgtattatgacagtttgaaacctaataaggacacaaaatataaggcaagttatgataaatgatacaagttcagactcttctaagttctggccaataacaagtacaaacaaggattgtgcatccaatgaggatcaaagtatcaacttgattggtggtggaattgataacccccaacatggcaggctctctagtagaagcttggggtaactaaggtagattgccttaaagcagaaatgcaacctcttctttctcacactaagtttaaatcttgaattctgtgcactttactgaacctaaaagctggatcttttaaatagacccccaagtccgtgtgactgttaatgctgtgaagaccacaagcctgccttttacatgcttgactgcaggtcagcacaatagaatgggttggtctccctactacatgaaattaggaagtattataataaaaaaggtccactgggattgagagtagacagtgatagggaaactacaaggagggaagaatttgtgtaatgttactagtaaaatgtagaccaatgaatgttctggactttggccaatcaaatttgtcacacttccatggagtacagaggaagagttgacagaagtttcttccccttcagactgagaagtataaacattattctctactgtaagtaccaaatgaagaataagcagtgttatgggaattcacagcagacagatcacctcaggatgggattatctgtttgtttgtttttgttttttaaagacagggtctcgttctgtcgccctggctggactgcaatggtgcaatcatagctcactgcatccttgacctcctgggctcaagcagtccctctgccttggcctaggagtacaggcatgagccaccacccccagccttattaggtcatttttaaagawctcttcccacatgccctgtggtaatgtatgccattagttgccaaaggctgcttccttcaagggctttctctcacagaaggrttctaaggctgaagagacatgagcctctaccaccactaggagtccccagagggacatattctgaataggaatctgtcatagtaaatactgtcttttgggcggggggcagctgttggaggaaacacctgctgaaaggcccctaaggcttatagacaaaggcatgtaaataagttttctgtaggccctgttggagttttaaaattctctgagaagtatctcatgtaagtatggtcacataaggtaaagaatactgagtgctatgtcagagtagtcatattgacagttactagtgaagataatcaaaaagcaaataaggccgggcacagtggctcatgcctgtaatcgcagcactctgggaggccgaggtgggcagatcacgaggtcaggagttcragaccagcctggccaacatagtgaaaccccgtctctactaaaaatacaaaaattagctgggtgtggtggcacacacctgtagtcccagctactcaggagactgaggcaggagaatcacttgaacacgggaggcagaggttgcagtcagccgagaccatgccactccactccagcctgggggagagtgagactccgtctcaaaagaaaaaagcaaatgagaggttgccagcagcatctaactaaactakgtaccaaactagattgttattaggtgttaaaatcacttcttaagtcatgtatgacgtgcatgttaactaattcttgataatataattatcttttatatctcacaggcattaagaagaaatgcactcaccatgagcaccaacttctgcatctgcctgatcatatttaaaggaacagagaaatatttgtaattaatctgcccagtaaataccagctcgtagcagttggcaggtgcatgtctagataaaatttcttgcagctaatttaaactttctacacgcaccagtagataatctcaatgtaaataatacatttcttcttggctctttaatgtaagccaacatggagaggaagatcttgacttatattctgtaccacatacacttctgtggacttttagcatttgtgggtagacttaataaagcatgtataaaagtggcacctttggtagaactctgtgtttttctgaaattcagattaaatgtaatgatgagtggaattaagtaccagttttcccatttaaagccccagctgcttattaatttatagattctgtagaaatttttttaaagatttatctagtctattgtgtagcctctatctcaggagtgagtttttattttcctatgcttatagagaaaaaaacattttcaaggttttaaaattttacaccatttataaaatattagagtgtattttttcagtacaaatgtttaaaatatgaagttttttttgaactaaactacaaagagtactgaatttaaagaaaagacctttattaaggggcaatatgtgatccattccaaattattttgaaatattaaatttcagttattctgtggtgttttctgtcatcatcatgtttttgttgtcactcccaaaataaaggggaggagggaatcacagagtatgttatcttgatagtgaaacctctgcttttcttgaccatttctgtaaggaaaactgctactcctttggtacttgccctaagttttaacaaaattagtagaaaatattaccatgtcatttgaatatatcatgaaaaatgaaaactacatgaaaatctgaaacaaaatataacaagttaaggttgaaaattttccactgcgtgcaatggcacaagcctttaatcccagctactactctggaggctgaaacaggaggattgcttgagcccaggagtttaagaccagactgggcaacacagcaagacacctatctcagaaaaaaagaaaataattcactttccacttagagaaattttagattcacctttttaaaatgaaaggtttttaaaaactgttactataaattatataaattaccttcattaattatgttcttcatactgtttaagaaatttattctgatacagtgcttataataggatgttaccaaaaatatactaaaaaaggattattatagcattgaaaactaaccttaggttataagccaaaacattttataaagtaatctatgttagtcaggtaatacagagttaagaagtagattggtttcatatataattcaagttatataggtatgtgcttaatgctattaaaccagttactgtatgtttgacctcttgatatactaagcttttgccttttagaacagctgggtctgctgagaatcatttcccagttcttttcattgtagatcagatgactctcactttatcacccttggaggccacatgaaggacaaagcagaaagatccacacacacaactaatgtttatatgaggggagggggagttgcaggggatatacttgccctgatcttccaatgaacataacagaagagagaccaattgagacttgaaaccattgcgttactttaaccattatttagttatatcctatccatctctttctctctgttgaacagagaggttcctttggctgccctgacttttgtaaatgtttcactcaatttgttgtggtttatcatttggacagaatgctacattggggatttttcgcccccactaagtcctcaagggaaaatgacttctgtatgcctcatatatgatacatgaacatacaccctattctcttcattttaagaagcaaacctaagttttttggcagctgagaaaactgcatttctcagaaatacctcctccatctaaaacgtacttgaacataactttgaagggcttattttttgacaggtatattaatgaagaaagtgaggaatctatctttaatatttttgcataacctatatgtatttatatgaaaacatccctatagccctgagtttagctaagagaaatgctttggaccttgcctacttctgtgataattcatcactggatatttttgatattttgcttttttttgagatggtgtctcactggtctcaagcgatcatcctgtgtcagcctctcaaatacagaccgctgtgcctggcctctgtttctggtattttgttttggtattttggaacctaatccctctaagttcaatataaactcttaaaccggtttttaatagatacgagggatacttataagataactgctacaagtctctataaaaactatagtgcaactcagtatgattagattaaatcatctgaagaatgatttaagaatttacctatatggtaccttacagaatttacctagatgataccttgaatcaggtgcatttcattttactaatatatgtacataatacttttatttccaaataataaagttatgctactccaattatttataacttcctcatcatttatctaagtcaacattctatgttaaacacaagtgtactattacaaaaaatatttttaaaaataaagctacaccagccagccaagatgctgacatttgggcacagtgattacagatggtgaccatggacagcaatgttcttgctgattcggcagtgattcaaggctgctattctgcgttgacctgccctttgagtctttatgcacatttgctttgagaaagaaacctttctagatttttgctttgtctaaacccacttcctttaccagacttagaaacacataccttcttatatcagcctgtgactgtccgtgtctagaaccagtttttttttgtatgtggtttgatttgcactatattaaaatataccaccacttaatatagtttaatggctatcttatgaaagaagaaatatattccttaaaaaatgttgatgggaaaatgattatctttattacagaggctaaagaaaacatatctttatatgagaaactgcaacatggatatcatgtattatttttaccagttgaatactataataaatattggcttctgctaatacagggtgatacagtattaataggatgaagttaacatgaatcaatgctctggcagtggtaaccctgaaccatgtcaataataataatatatatataatgtttaattaaacagaatggttctggaggtttagaaccagtgattatgtgtaatttagaagacttcactcaaaccacttaaagttaagttaaagcttacatttaaattcaggaaaattcatttttaattgtattaaaatatgcattcttggaaataaataagattatggtttatttgccttgttaaaacaatcaaatttgcatgtgtaataaggcatattcaaacttcaagcagtttaaattgccttctcagtaattaaaaagattatcacaaatttaattccctaagatatgacttctaaacagtgaaatacacactacttgcattctaaaatgtaagtttgaataccaaaattagtgatttccattaaaaagaaggggctcaattctcccatgaagctcactatatggtctgatgaaggaagtaggtttagacaaagcaaatatcaagaaatatttctcagttttttaaagacatttaaaaagtgcatttcctgagtaaacaatgggattaaggacatgtttctcttttttccccacttgaatagctgtgaataataaaaccacatgttttggccaagcagtacttagacaagcctccattggtctttggtctccatatacatttattttgtgtagacaacaatgacttttcaccatttcctttcctgtggttccatggttctcaaaatggtaatttcatttatacatagcaaaaagttcacaaaacctttcagcactgttcacattttcacatttgtttaggaaacaatttgtttaggaatacagctagctgattttcttctgatttcttccacttttggaatcccacataataataatgttaaagtataccaagaagaacaggaagttcaagcaagatacaaaacacaccaatacagaaaacaagtccggtagtttctgaggaggatccagtgtgacagtcatcaacgtcagaagcaccatagtgatgactgagataagaaactgcaaggaaaaaaaggattactgagtagtataaaaggtgaaatttaaatgtgctggaaacattgacttgtagctattaaatgagcagaattaaaggtgagggttgagggtctaatttattctggtgtatctcaactttgacttcctattagaatcatatgaggagtttttaaaatctcaatgcccacatcacaccccagaccaattaaatcaggcctcagtactttttaaagctctccaagtgattcccatgtgtagccaaaacctgaggacccctgtcttcttatacttcctaccaccaaggcactgaacaaaggtatctgggacaaatattaatgctagtcagggttaaatttataacatcccctggggtccaacaggatataaaattctaagctaatgggtacaaatgtataggtagctagaagaaataaaacctagtgtttggcaggtcagtaggctgaatatagttaacattaatgtacattttaaaatagctagaaaataataagttgaatgttcctagcataaagacatatttttaaggtaataaatagcccagttaccccgatttgatcttcatgcattacatgaatgaataaatgaatcaaattatcacatatacccccaaaatatatacatctattctgtatcaatttttaaaattctaagctaaccttgagaacccatctgtgaaaaagttttccatggcaaatggaaaattacatttcatattcgctaaatgctttcaatgagtaaagcacacgaaggcacatgaaagaaaatgaggtcctctggcctcaaagagttttccatctactgaggggaatgttaaataaaatcacaaagtcacactggcttaaataccaagctgagtagtaaaaataattagcacatttattgtagttgtgtggtcatcagttagtgtggtcttctctaggccaatgtgctatacaatagaacttcctgcagtaatgaaaatgttttgtctgcactccagtatagtagctgctaaccacatgtggctattgggcatttgaaatgtacttactgtgactgaggaactgaatttttatttaaatttaataagtttaaatttatatatatgtctagtggctaccgtactggacagactgtgactctagactgtgagctcctttaagacaaagaccagcaagatcttactcattttatccctagcacagtacacaggtatacaaaagcagtataaataaatgtagaaagcagtgagaaacagtagtgacttccatgaagtgggtgggacacagaaccctaaaggatgccttaactgctggctacattatgacagtattggtaagatctaaatagagagtaatgcagtgatcattccaaatggaaaagcgaggataggcgccaagaaagcttacaagcagatacaaacaaaggctgccagtgtcgttaaaggaaaaattcctgaggcaaccttagtgggaagtgcaaacatctggaatgaaatctttaaaataaaagtttcaaacttaagaaatatgggactggttgaaatgtcataataccacgatcttgagtcagtgttaaacagaacaaaaaccctctcttgctccaactattaccccatttgtctgctcctatttacacttgtttcccaaaacagttgcctataaacatgctgtgtccagtcttcatcccattcactagtgaacccataccaattgggctttcaccctaatcacgatgaaactgctatagtcaaatatccataatgacctccagtgtagtaaatcccatggtcagttcttactgccttacttgattctctcattagcatttgaaatcactctcctctcactgaaacacttcgttcacttggcttccatgacatcatactcttctggttctcctatctcacccagttaattcttagacatctttgctggttcctcatgtcccctacgtctgcattctggggcttcgtacctattcctcttattaatctatactcatacccttagtgagtcatccagtaatatgactttaattaccaactatatgtaaa

SEQ ID NO: 12545 - DNA, 12551 bp, Homo sapiens
gcatgggcttcagagtcagaagtccagggtctgtaactcaattccaggactcttagaagctatgactctgtttcctcaaaaaaaaaaaaaatgtgaagattaaatgagatgatccatataaattatgaagaacactggcagcatatgataagtatccaatactggcgactcttgctaactctatattgtactacacagtggactagacagatgtggaatttacactcatataccttgtcttgacaaactgctatggcgtttgtttgtttgtttgtttgtttgtttgttttgatggagtctcactctgtcgcccaggctggagtacagtggcacaatcttggtttactgcaatctccgcctcccaggttcaagcgattctcctgcctcagccttccgagtagctgggattacatacgtgcgccaccacacctgataattttttgtatttttagtagatatagggtttcatcatgtggtcaggctggtcttgaactcctgacctcaagtgatctgcccacctcggcctcccaaaatgctgggattacaggcctgagctaccgcgcctggcctgctatgactttttttttaaaagatgccaacttatattagagggtcttagataacttcccaagcctaccaatcacatatttagggttcttaagtaaattcctcctttgtgttttctctttcctcttctgtgtcatactcactgaatcactattaattttcattatgaaaacttttaaatacatacattggagttatatgacttagcaataattacaatgcttctaacaagtcattattacatttgcttatatattcttagagtatattagaaaattcttttacatctctttaaacactggattttcacaactacctggtgaggtaatcagagctagtattaattatcccaattagacaggtgaaagagttctgtcccagagggaataaataacttgattgggttcaccagcctatgagtaccagtctggggactcaaacctaggtgtcagtagtcagtgctattgtcattgaaggtcatttttattattaccaacattaatcttagttttgtctcattagaagagctaagtgttttaggtaatgtgacagctgtactagatgtgcataagtgttgtaggtcacatagctcgttatcaggaaatcagatgatgtctgcaaatactccaatttgctccacaaagcttttgatctgaaactgtagattttagtggttatgtaatacaaagcaggggctctgaaccaggctgttgctggttcttaagaatgatttaaacagcacctctcagagaaatccagagcatgacttgaactcttatatgccacctataaagcagatgaatagatatcgctctcaatctgtataataggggacaggggcaagggaaagcaccaggtgaaggtgagctgtaacaggacaacaaccttctcagcctagctttgcacctcactctaatgtgagctcacctgagcaacctgaacatccatcctctatactcaccagcaatgtgtggacacatgtaagcatgcacctggccaacctctaggtccatgagaatttgcctcaactacttattgaagatgtcctatctgcctgcacctctcaacttctaatcctattccaatgctccttgcactgttatgtttcttgctgacaacccaacagatttctttaaggaaactagaattagaaatagctatggagcacaaagctacccaacagaattgcttggatgcaatggctttaaattcacaaatcttgcctctgaaccaaagaaaagcatactgtatgtggagacagaaagcttagattggtgtaccagttcttgtgcttacagtatccagcaatgttaaataaatagcttaattgagcttttgttcatctgtataaagtggaaagtattcccatctacttcagtggattgatcagaatttccaggacaataataacaatattaatatgaacagttaacacttactgaatgctttctctatcattatcagtcgttgtttattagaatggccaaattaactgaaaattaagcatacacaaatctgccagtacagagtatagactcatttattctcaaagatattaattaatcctcccaataaatgccatgagaaagatgccattgttatccccaccatacagttgaggaaacggaggcacagagaagataaataacttacccaaaaatcctacatttagcaagcagtggagccaggtctgcctgacatcaaagcctatgcccctaaatatggcactttgctgagctacatgtaatctttaaaataacacataaatataaaataaaacataccattgctatatgccatgaaccttttatgatattcaagctcttttaagttgtatggcttgtaaaaggagaaaaaaaggaaattatctaagccaataatatgatgcaggatttcctaacccctgttttcatgtacctctatagtaaattcttctcaggccttatctgactaatgtcaggcaagattccagacctgctggggctagattttcattgcattaacatctctctttcctccaagaagaatgagatggtacaaaataaataaatagcaatcagagacatgggaaatttcccttctctaggagctgtccaaagtcaacactgggtgatttcatttcttccatccagggcactcctgtaatctcaggggaatcattaaacctcttgaggccccagtttccttggttaaaatgtatatgtacataatccctaaagtgctggccaagctcccaccatgagataagaatttcaggccaacctgactctataatggatggccacaggaaagaacatgctagttgtctgtgatgccaaggactgcacacactaacaccacctgggcacacactaacaccacctgggcaaaagccattgggtgaggagctgcatttttttttctttgagacagagtctcgctatgtcacccaggatggagtgcagtggcgtgatcttggctcattgcaacctccgcctcccaggttcaagccattctcctgcctcagcctcccgagtagctgggattacaggcaactgacccatgcccagctaatttttgtatttttagtagagacagggtttcaagttagtcaggctggtctcaaacccctgacctcaagtgatccacccacctcagcctctcaaagtgctgggattacaggcgtgagccaccaggctcgacctaatttctgtatttttagtagagaccgggtttcgctatgttggtcaggctggtctcgaactcctgaactcatgtgacccgcccgccttggcctcctaaagtgctgggattacaggcatgagccaccacgcctggccaggagctgcatttttatgccattataacttttctagttatttttttctttttctccaccagacaggagtcaaaattaaagtcatctctgttttttaagaagtaattccaaaaagaccccaatcaaacctaattccttaggattctgttttctgaaatcctaggcatgacagtccttaaaccagaatgattgctgctactcaccatggctgggccatgcagggtcttcactgtcatgttgcgctggtggcttactttgtgcaggaagctctttctgtgaatgtatcttcctgtgtatgcctgtgttctatcaatgagagtacctgttagttttatagcaatcattgcccctgtttcgattgacctgcttactgtctttaagttgtggttgacccggagttactgacgaatgcaggggtttttttttttattccatttcccgaaggggaacaaaagggggaccctaaagaaagggatgacaggaaaaggaccaaatttttctttccttctaccctacttccacccccattgcccacaaatcagagcaaaatttttaatttactacagagatgaaccaagttagaaattgttgtcaaatcttttttgttcttccacaaattgccaacacccttgtcacggaccatatgttctactttccagtcacgcaatatgaatcgtgatttaaatgggagaaaactcatccttagaggagccttggtactaaactatctttacctccattttatgaatgggaaaacaaaactaaagaaatgaatgacataagtgaaaaattcagaaatgatataccctggtagttttgttatctccctgaactaattattttttaaccccatggttagactcctactggtgcttaataaataatcactattcattgtgttgataaaacaaactgttttcctctgctctcacaccacaaccagcaacacaaaagatttccatgaccatgtatgtgggcatttatctccatcaaccagcaagcaatcaattctgcatccaacgccagctaagcatcttctaatccaattcaattctgacgctatctccaggtaggtagagtcagatcccacaggctgaaggctcagtcccacaaaactgctcccactttaagcaccaatcacaggtccaagcctctgggacttctgactgactggcctcaagttcaggttcccacaaaccgcttgagtttgattaggcttgattaatttgttagaacagctcacaaaacttagggaacactaatttatatttaccagtatattctaaaggatatttttaaggatacaagtcaacagccagatgaaaaggtacacagggcaaggtttgaaagggtcacaagcacagaagtgttctttcccatggagctggggtgcaccaccctcccagcacagggatgagttactgtttacctttcttagaacttccacaagttcagcggtccaaaggctctttgtatcccatcctcttgggccttttatggagtcttcattgggcagacatgattacaacatggaaaactgtaaacaaatgtgattggataaaaagggtataacctgatattaacaggttgaatgaggaaattcagccaggcctgcctgttcagatttttcttggcctctctgagcagccttccttcctcctgggtagaggggaggacccttcctgaattgagggtcttatggcctatgattagacaaggtaaatcaaagaatttctttatggtcagctccaagacaaaaggtgtggggggtgatgttagatgacaggatattttctgtttctatggtcttggggagaaaaggtgggcaggagaagttcagagagggagattcttttttctgaggcctatttcttaggcctaaagtgccccaacattacaataaaagactgtctttttcacctttattgctctgaagctgtctgaagctgcttcaggaaacaaagacaaaaaagctaaataccctaacaaaagatatgcttattatttttatcacttaggatataacgagggctgtgggagttatgaaccaggagccatggacaaatatacatatatgtaaaatcacattgatgcaacacttaaatgcccattaccttggctatctctaagaatggttttttttaaccaaaattaattagcaagtagaagcctttaaatgcaagattggcagccctggcactgcagctggggcagcagagccaggacggcccaggaactgacagactgagggataggcagactgaccatagccgaccagccaaagcccatcagcctgctcaagaacctgctggccagtggctttggtggcatgtgcctggtgttcatggggcaccctctggacactgtcaaggtccgactgcagacacagccaccgagtttgcctagacagcctcccatgtactctgggacctttgactctctcccaaagactcttagaagggacatcacagggctatataagggaatggctgcccctatcatcggtgtcacccccatctttgctgtgtgcttctttgggtttggtttgaggaagaaactatgacagaaacacccagaagatgtgctcagctatccccagctgtttgcagctgggatgttatctggtacattcaccacaggcatcgcgacccctggagaacccatcaagtccttgttacactttcagccttcttcaggggaaaccaagtacactggaaycttggactgtgcaaagaagttgtaccaggagttwcagatccgaggcatctacaaagggaccgtgcttacccttatgtgagaygttccagctagcggaaygtatttcatgacaaatgaatggctaaaaaatatcttcactccggaaggaaagagggyctgtgagctcagtgtgccttgaatcctggtggctgggtgcattgcagggatcttcaactgggcaatggcagtcccgcaagatgtgctcaagtatcccttccagaygcacctcctgggaaatatcctaacagttttggagatgtgctgagggagctgatctgggatgaaggaatcacatccttgtctaaagggtctgatgcagtgatgacccgagccttcccagccaatgcagcctgtttccttggccttgaagttgccatgaagtttcttaattgggccacccccaacttgtgaggcagaaggctgctcaagacttctggatgctggaactgttgctgagaaggaagagtagtgggcagaactaagcagacttggagaatgaggggaggagacggtgggatcagagctctgcgcatggacttggtgagactgttgccttaatgacatcctctaccttgtataagttggtgtgtcatttcgcaacttgaattcattcttgtcaatgtaagggaccttaagaggatttggagatctagtagtttctagaccagatactacctgtggcaagaatactgcctaccagttgacggttggccctaccacacccaaagtgtttctcattaaagaggtaatctcagcttctcactggaggcactttggatgctttcaaccagctgaccaggggctgagatcatcttcaatccctagccaggaacacccacttgatttccagggtaccacctaatcctgggctgcacatggggatttggacttgagccccacatctgtgtccaactggactgggcatatatgcttaggaagagataacctattagctattgatttttgccttttttttttacacaagtaatcaaaagtaaaactagagtagagtagcctaatttcccaagaatgggtgaaaaactttcctttctacacagtgaggacagtcccagcctgctgggataagtgagaaaacccagggtgaaggaaggctctttctgcacaatcttttctcatgagagcgccatatttttgtttccaatttttgaaggaaaaaaattaagcgtttaaatgctctgacatgaaatttaaatgatctgcaaaaagttaatttgtctcagttcagttcaggttgtcaaacatttgttaaacacattctatgtgtcaggcattgtgccctagagatacacagacattccccaaaaaacagtaacttatctttttttacattcattaagattgggtaaaattacacatcatcttttcataaggcaggacacattctagcagggcaaagttattttcctctagcgtaacatgttcgaacaactctttgccattttcttcacatgaagaaaatgaagagaaagttgttcttaggttcattggaaggccctgaaaaaccgatcaaaattctgtgatcacaggccttccatccaccctgctcccctccatgcctgtgcaatcctctgcagctctctctggaacaaccagaagtgtaacttctacaaaaagatttcctcaaatcaccctttcaggcattgttcccttcctcaacctcttgtgccaatacttgtgtatcttgccctcacatacatgttttaggatagttccctgggatcttcatatatttgggtaactttaccctgcttcccaataatctctaccagcctccttctccaaatatacatcctcaaatatacaatctagattaaacagtgtattctatgcaaagacagactcaagtcccctggccaaccccttctagccagactgaaccccctaagcccatcttatggagaattttcaaggcctccccaggagtgaccttccatgtgcacagtgaaggtagctccatgaaatcaagagccatgttttcatctttgcttatatcactcatgctcccaaagcaacatgtgcaatagacctttaaatgtgtactaaattgagtggattgagtcactcattttcttcagtgatctcttttccattcagagctgtacctcaatgcatagaagaatataccagctctcttgaaagaaagaatgaataaatcagttggaaccaagagtaccgaattcaaaacaagaggatttgctagattgcaggggagaacaaaatggttctttatgtaagcaggaggcaacactgacctttggtcacagttttcccccttggggtaaaaacaactcttatcaggatgccagactggtaactggctatcactgagttcaaactaaatcaacagatccagattcttatctcatctagcattcattgagcacttcctataatgtaaatcatgtgctaataccagggacacactaatgaacatatgatgggcacacggctgactatggtggaacccttcactgactggctctataccactcatgatctaagctgtcaccagctttaagagtttcaataatgcattggagccattattcaacacactgacagcgagatgactacagtcaactccaagagcccacaaaaagagataccaaaagactctgttgtcttagcaatgagttacacacagcctcaaatgtggtaaaatactatacttcttcaaacatccaaatcagcaagatgttttcatgccctcatatgtgcttggagccatgatacattttgttggggctagtagcacaggcaatagactgtattattacagtctctaccttaatgagcttaaaatagtcatggaaaaaagtgaacacgcacatataaaccagtaagataataatatgagattgctgggaataatgataaaataaatgtacacatttagtttaacaaatacaacttttaaaaacttttattctcatttttaaaaggggtatctagccaggtgtggtggctcatgcctgcaatccccacactttgggaggccaaggagggcagatcacttgaggccaggagtttgagaccagcctgggcaacatggcaaaaccctctacaaaaaatacaaaacttagctgggtgtagtggtgcacacctgtagtcccagctaattgggaggctggggccagaggatcacttgagcccagctactcaggaggttgaggctgcagtgagcagagattgtgccactgctctccagcctgggttacagagtgagaccctctctcaaaaagaaaaaagaaaaaaagtgcatctaatcaagatatactactgcaacatgacagtatatctgcagttacagaaatttatgccttgaagtaaagtgctatcataacagaaagcatgaaacagtggtcaggtagcacgccataggctggacagacgataatccatgctctacaatggcaaaacatttagttaaaccattgcctgcaataacttgagaggcagatcttgtacctaataaacttgaagctctagagaaagagattagaaaacagaatgttagttgcatgtgtttggatactgttgtctgcatttggccaagtaacacataaaagagatgagctcaggaaagagttggcaggttgataaacaaaaatgaaaggaaatgaagacagttcagaaattcagaaccctaattacccaggcgtggcggtgggcgcctgtaatcccagctactgtggaggctgaagcaggagaatcacttgagcctggaggcaaaggtgagccgagattacggcactgcattccagcctgggcaacagagcaattgactctgtctcaaaaaaaaggaaagaaattaagaaattcagagccctgtaaggttgcaacagaagattgaaaaagcctttgaaaaagaaatgcacaataaaacctttcaaccaagtaaattaccgaagggcaagaattagaatgaagcatctggaaaaaaatgtttaactggataaaaggactcaattaaaagtgtaaaagtatagttctagtaatctgccatcaaatcaagacagagttataggaatgaagaaacaaagaaatagaaatgttctgggaattatgcctcaaaaagaattgactcagattagaagttcactaagtttttgagagagctctagaaattaatcaggaaccaatcctcagtcccccaaccatcaaggaacaagaattaaagctctaagaaaggtatattcaccaacaccatgtcagatgtgaccaaagagattacagggagaaaaaataaattttttaaaccttccaagaagtggagccagggaccacagagtaaaaaggaagtgagcctctcccaaaaagcagaaaactacagaccccacaaactctacatcattcttggggtttttttttccttttaatgcaaaacatttccagtttcagacttttttgaaactactaattcaatgtttcgtatttgtttgagtcaaatattcaaaaccattatgcactttctagaatctccacaaaatcacaattcatagaaactaacccttctttttaaatgtaatgattaggtatgagtgcggtggctcacgcctgtaatcccagcactttggaaggccgaggcgggtagatagcttgacctcaggagttggaggccagcctgggtaacatggtgagactttgtctctacaaaaaaaatacaaaaattagccaggcatggtggtgcacacctgtagtcccagctactcaggaggttgagatgaggggatcactttagctaggaagtcaaggctccagtgagctgtgatcgtgccactgcactccagcctggacaacagatcgagatcctatctcaaaaaaaaagaaaagaaatgattatttgtcagatgaaaatgctgtgctagggtcttcatatgccaatatttgtgagagtagaaattacttggggtataggtaaacaaaacataaaaaacacagaagtcttcctttcccttctgtctctgtagttgtctctcattcattctctctctctctttctcaaagcatgcaatttctgatcttctgatgaaaaaaaagccgggagagatggcagtgagagaaggggatcagaggcaaaagctgagaaaagaaaagtaaggagaaaaaaatacttcggaaaggagtttccccagagtgctgtgtgaggatcccggacggaatacagtttaagtggctggacaaagttccagatcgcatgagggacctctcaattctgaatctattctgtggacctgtgaaggcttttgcattcaagttttatctacttgttagcggaaacatcatttattaaacactcactctgtaccagtctctgtgctgggtaacaggaagaaaaagtgctaccaaaaaaaaaattgccataacagttttctccttccaagagagctgcaaattttatatcagaccagatggcacttctgtcttgaagagaacttacctttttggaagtgtaaagacagagcctattccagggtaaagacagggaaattgctacacataaaaaataatatggtcaggcacagtggctcatgcctataatcccagcactttgggaggctgaggcgggaggatcaattgaggccaggagttcaagaccagcctgggcaacacaaagaggcctccatctctacacaaaataaaaaaaaaaatgctgggcatggtggtgtgcacctgtagtcccagctacttgaggggctgaggtgggagaatcgcttgagcctaggcagtcagggcttcagtgagccatgatcctgccactgctctccagcctgggtgacagagcaagatcttgtcttcaaaataattataataataggaatttcagttaaccctagagagaagagaaatgagagctgccatccagaaactcctagtatctgagatgaccagggaactaagagtcatgagctttatattcaaattgtttcaatgtgtatgttgtgctttaattctttaattaattctttaattctcttccattatttccatgtctaaggtaaacctctttatatacaaaacaggtttatgatgtctacatggagcatatatatatatatatggagagagagagagagagagaggacaacagcctcaggaggggaggcagcacgtatggatagagcaagatttagaatgagaaagttggctctttcttacccctcaatcctgcaatctaggagaatcttactgctcaaagtttggtcctgggaacagcagcatctagcttgttcgcacctgggggcttgttaaaactggagactctccagcccccatcccaaacctactcaatcaggctgcattttcacaagatgcctaaatgattcatatcacatgaaagcctgggatgcacctcattagggaacattagggaaggtgctgaacttcc

SEQ ID NO: 12546 - DNA, 121702 bp, Homo sapiens
gcacagagctgccagaatgcccgtagctcagcccctgcagtcctcactgccaggctgaaagcgggccatgctgagccatgcacaaggccacctggctcacaaataacccaggaaatcagagtacttgggtttttaaattgctccactgtgggcagaaagaaaccctacccagagtcaaaagtgctgaccatgtcattgaatcatagattctctttgctgatgggccactttgcatccgaatactgccaaggcccaaggtaatgggtatggtggtataagactcaaacgagtaagtgaaaatcaatacagatgctctttgacctatgatgggactctatcctgtttaagttgaaaatgtcataagttcaaatgcatttaatacccttaacctactgtacatcagagcttagcgtggcccagcttcaacatggtcagaacacttgcatgttcctacaactgggcaaagtcatctaacacaaatcctatttttaaataaaatgttgggtatctcctgtaatatattgaaaacagcactgaaagtgaaaaacagaatggctatatgggtaccaccataaagtagcaaaatcaaaaatcaaagcatcgtaagccagggaccatccatctgttaactggaagcctcatgtcagctaagagcaataacacgcatttgctaacagcacattttgttacctgcctaattaccggtccgtccagccacttgaggacacactggaatgccgtggattccttccaaggctggcgcgctctctgtgggtggggagggacaagcacgttttgggtgaagatcctgtgccagtcgttcatcctgcccgcctgagggtcccgtgggcttcccggatgatctgtgccagtcgtattcaaataaagagaagagctgtgagggctagagtggtcacagcaatcctgaaggcttctgcctcccactaaatcccagaggaacctccatcccccaaacccacactctgcaaaccccagaagagtggactttgttgctggctggcacccatgctgcctcctctaggaagtaccatttgcatttcaaaaaggaaaaataaacgtagatatatttatttgtatttgcttagaatttatgaaagctgtacaataacacactgtatctagggtgatacaccaggtacctggggtcaacatgggatgattcacttttcctgtgtatccttgtcaactttgaactatgcgaattaccttttcagaaataaaaataaaatggagaaataaaatctacctccagagaaccctccgccccacccctacccccgtgggccagactcagggcacgactctcctgacctctgtggctggttccggatggggacatgaagggatgttttattcagctgtgtaagttggataccacacaaggacaccaggggtgggtggctgctgaaatacagtcctagcgttaagactgtcttgtaggggacccagggagcatgagagagggaatacagcccttgggccaagaggtggtcagcctgaaactgcccggggccaccttaggacacacataaaaacaagcagagaggaaaaggtaggagtgagggccactgggtccccatgtcattattagagacctcagttggtcaccccacgacacttcagctacatgaacaaagtctcttgttgctaaagccatttggggacaggtttcaggtgttaccagcttcttggtgggtcttggcccgttttgagtgttatctgatcctgtccagccagaccgggatctaaatcttctctagccaacacagaatccaaagatctgaacctcaagaagaggttgaattccgtaaactaaaatggcgagtaaggagaaaaagaagtgggtttggccttctaagacagcagctctctaagtacattccccaaacccaaggttcaacaggatcctgtcaggggctctacaaggtcaaaactattttcatgacacccaggtgttatctctttcaccatggtggcatggtggggcagaggcagcagcagggaaagccactggggcctcactcaacccaaggctggttgggttgagtgaggtcctcccaacctctcacagaaaagaacaaggcagcttcaagtaagaacatccttggtgaagccggaaaaactattaatcttattacttcttgacctttgagtacacacgttcttaattttgtgagacgaaatggaaaatacacaacaagcatttctgctgcaaactgaaaggcaacagtcatccccggggaagcctggctgtgactgggctgcatgctgaacacaccgcttttattattcaacaccattttcactaagaagaatgactgagagacaaacatgggtacttggcagacatcttctcaaacgtgaacaaagttagcatgtcacttccgggaaaacaactgcaacaaaaatggagtttccaagcaaaaatgagaattaagaacatttgtatcctctaccatgagcctactagcttcacacttcttcaagactttcctgatgagaggggcagtgatataacgtgatcttctaaggttacaccattaaatgtgtcaatagttggaaggtctgcatgactccgtgaaccaatattttctgaacaatgcgtaatggtacaaaatcctgcaagaagaaaacatccacccaaagtgcaagacagaccaaaggagtttaatgtcagagcacgaagagttcattcacatggtggagactctgctttagaacaaatccttaagaaacttctgctcgtagggtttcaatgcagcagcaaagaatatccacaatgacccaagagactcctccctaactagatcgggatggatttccttcacatacttcaaccaaggcaacacaaggcaacagactgagtacagaagcaaacaggagccttcagctgtcctctcttaaggagactgtaaagatatttgcaagaatgcaaaagaatcccactcttctaaatttttttttgttttggataatatagttggtttttgtaaaaaatgtttttatgttaacatgtcacagccttatttttaaataaattaatatttttaacatttctcagttttaacttctatggcagtaaacattggtagatataactcacataaacaaaagttctttggggtcctcaataatcttttaaagggtaaagggatctgagaccaaaaagtttgagaagggttgtgctaatggttcaccccctgcatgctcccggcatgtgtgggaaccgagaggacatgaccaggcagcctgagaggggccttggcccagggtcccgcctccacccacagtgcacccagacgctgcatccttggcccagggtcccgcctccacccacagtgcacccagacgctgcatccttggcccagcgtcccgcctccacccacagtgcacgcagatgctgcatgtgggccaggtattcctgaggaccagactcagtctggtcctgtgtgaatccagcaggcacacatgctggtttgttcctttttgttctctgtgggctatttttgtcgctcaacttcccttgttttgtggaggaccctgacccaattccatgtatggggagagctgctccccgattccagccagagactgcagtgattgcttcaaggaggaacacatggcccacactgagccatcagtcttccccgggagacttgagcccaggatgtctctcctccaatgcccacaactgcccacaccatgccagcccagagccccaggagccaccacagggagagccgactttggacttctgaccggcctaactggaaaagaacaaatttgtgctacttttaagcaaccaagtctgtgggactttcttacaggagccacaggaaatcatacagctgtccacgacttataagcagaagacacctgaccaataccagctcaagggccatctcccccaggagggcttcccaggtgctcccagggtccaggccccaggctcacatggcccctgtgcttcccttggtcacatcattcgtcacctatcttgtgttgaattgctcgctggccaagttcttgaagaaagaagcctcattcctcctgtgttcttggtaccgtcacaactcagtaaatggtcacggaaccaaacagaagctttagcaaagctaccctcaagcttttctttcccactgatgttttataacattcagaaatgtattcacacacaatgcaggccgtgatggccccaggtggggatttcagagaggaagtctctcctgacgcagatgcccatgctcctcacctgccccagatttctgacccggtgcctcctgccctctccctgggtgtctgcaggactcagtgccacacttggcccaaggacactgctgaaggacgtgcatacgccagtcgaccctcacagggagcatgaagcatgccggccccctgctgtactaggagggcagacactaggcggaagggcatccattccgaaagcacctgccacccacacggaagtcctgaggctcgggatgtggaggcagggcagtcctagtctgaggggccacggaggccgaggtgacacctgagactctgcaggtgggagcccaagcgcccgcagcagctctcactgccatcccagcacctcacaaacctctccgggtgcccttccacctgctccttgctcctttccacctctgctctggcctctaggagtcaaaccaaatgctccctcctcagagcgagagccccatcccccacctccggctgctcccacacagggcaggtgacagaagagccaccacgcttcaccagggctgtgctgtagtcctgcgagactgtgagctccatgacaccaggctgggtcttcagcaaaagtcttttaaggatgaaatacaaatgccctggaggaagtgcagaggggcctttggggccaaatcaacaataaaagagaaaatcgagaaggctccaggtcttgaacccaagaaaagggtacagtgggctctccaggggaaaaaaaaaaagaagaagaagaaaatacacccacttttaatgagcccctgatgcaagacaggaactcacattctatggttactattccaacaactctgccaaatgagaatcatcattatcgccatcttacagatgagaacactgagactcagaaaggataaacagccaatccaaggtcacacagctagctattataactagctattataatagtattatagatataatactgtaagctattataactacctcccactacctcaatcaaggaggccaggagaggccaagggagaagagaggcccagagggaaaaagtaagagcaccaaaggaacccagggctaatgctgtctcctctttaacttcaggacagattcgcagcctccccacctgtttccaacctccaaaatgagagctgtgaaatctccttgagatctctgcttctgctgatctattcagcaactatttcccgagcacttgtgttccagtgcataagaaggctgtcaaatgtgctgtcttcaagcatctagaaagccagtgggggagaaagacaagaaagtgactgtgagcagcaacaggcccccgggagggtgcagaggtgagcagggctgaaggaagatgcagggggtgggaggcgctgtcagggtccgggaagcctccttcccggaatggaaaatgtgtaatgcctgagacccagatgccttggggagcttttggggaagcagaggtctgattaagcactgcctggaattccctcattcatgagcattctttcagcacctaccctgcgcccgggagaaacggtcttgaacacagcagacaagctcgctacccccatagaatgtaaagaaacggggcacaaattagcatacaaaaagacacaagtgtgacctacggaaactgcacagaggaggtgcaacgaacggagccctgggttaggaccgggaggcgctgcccaccatcaacagaaatactcctccttttgccaactacacacgcgagaggctggatttccttcacagacgtccaccaaagccacacatcgcgacacacggaggcagaaagcagcggtctcctaagaagttagacacgaggaatctcgggcagcgaggtgcctgcaagcccgggggcgggcgggagcagcctgcacgcgtggggaagggcacgcgggagcgggtggcgccttccgggccgggtcggccgggaggttccaaggcaggaaaggggcgcagaaggccgggacggcgccgggtacaaagcctcgcagggacgcccgaaggccgcagagccaccgcggggaactgacagccggagccggagctggagccggggggcggggaggaggggcggaggggcgcggccaggcggggtccgcggactccggcctgggaaggatgcgcgcggactagggcgcgggsagccaaggcccagaacatcggtaccgcgctcccttcagccgaggggctgcagagaggccagggggcagggggcagggggcagggggcagggggcaaagggcaagggcagaaaggaacccacgtagccaaacggcacccagcggccccgaccccaagtgtcccgacgasgggggacgcctgcgactaacgcggggacagcccccgccgcgcgccaccgccgcaccccaggcaccgggcccccacgcagggacggcgtggaccaccctacccccgaaccccgaggctctggccaacactgaggccccctgtgcctcgaggccgcgtccaacctcccccgcggcgccggcccacatggttccgcccgccgcgggccgcgttacctaggagaccgacccgccgcggccgcgccggaggccacggagcccacgcttttcagagagtctccactcgacggacccagaggcccggcggccggtgctcaacggagccacaagcctgaggaccgaggactggccgaggggcgcgccccgtccgctgccacccgcgggaggagcctcggaaggcggcgcaccgcgccgcacactcagtccaagaacccgcctcgcgtcactgtcgccgtcagggccgcggagccaatcagagcccaagtcgagggctrcgctttgcgagcgccagccaatcggtgcggcggcgggcccatcctgatttgcatgtccgacgacccctcaaccaatggtaatgtgactggcgtgaacaatagccaatcagaagctggaagaggcgtggccccgggcgtcccacgaggtgaagatgctgctggcggaacctgcaggagctagcgggattcgggggcgctaaagtcgcaggggcagggcgggaaggaagatccggcgcggggcacaggatccggagctggagcccccaggtgagtaccggggagaccccggcggggcgcgctttccaccaagctgctccgggacggcggcggcgggtatccgcgaggcccgcgctgcggcaggcgccgcggtcccgtctccatctcttcttccccggccctgcgtccctgcctccgccgctgtctcacctcctctccagcctcctcacctccttctccatcgtctcccttcccccatccctttctgtctttccttccctgtcctcccgcccgcccgacccttcagctcgcatccctgacccctgcccctgccgccgtccctcttcccggtgcacctcttccccatctctgcccgctccggtcctagcagcctcgccctcccctttcctccatcctcctctcatcccctctcccggcctctgcgcagccccaccggggcgctgctgttcccggtcctccccatctctcctcctgatcgcttctcaaggctcatccgtcgttctcgctgcctgtccctgtgtcgctccggtccctttccccaccctcccattctgcccccagcccctccgacctctccccgcgggcacgctctcaccaccttaccctgctccccaagactgtgaccctgcttcctgcaccagttcctcgggctgtttacagcacacacaccgccacttctgaccctgagcccctactcctatcttaagcttctccctcctgccaggccttggcrcaaagcacttccgcacctccctacctgctgctgctcccaggatgcaaagaccccactgctgcaccgcgtcctgcggcaktagcagcagccggggtacctgcccrccttcccaccccgccaaccagccgcatcctggtgtccctcctcctggcatttgtcctgggggctcttacagggactgtgctttgcccgcagcatcccggggtgctccaggtggaaagccccttagcacctttcctccctggccaccgtctccttccctccccacccccactttcctgctcagcctcactttgtgattcagcatttttggggttggtaactttcttgcttcctgtcgtgatagggacctggctacggagctgaaggcaggggtcttgaccctgcggttagcagggccaccttaggaaccagacctgagctgcctggttgggagggggctgaggagctggggaccgccactgggggttgtcttttcctccctttcatttgtctgccctgtgytgaactgtgtccaaggggagatgacataagtaatagctcttggggaagtgggctattagcatttatggaaattaatacatccacatccgaggagcaagaacaccaagttcaggccacagctgtcccactgtctgtcgtttcaggattttttctttctctgcaacttctcctccccgacaaaaaccccagcctcacccctcccctttccccmagtgccaagagtaagctcctgctctgctaaggaagccgcattcaggccccgcgttgcaggttgcagggtttggggacctacgtgtggagagtcacatctgcccacctgattctcgcctggcggccgtgtctgctgcagagccctgtgcagctcctggccctgtgctctcgcagtgtggggccctaagagtgcacttggtcctccaggtcctgtcattgtctccacggccacactcggcctcagtggcactgacagtgttcgggccgcagcacatccctcgagagcagcatggtaggggcttccctgttgacacccagggccattttttttttccctgcgccagtcagcaaatgctttgkaggtgctagtcaacacctgggggctgagccaggcactggagttggggggtgtcgtgaaaaagygtgaaacccttttcgtgtgtttcttggttgagaaccgtcttgggtctggatttggagcctggatgggaagcagtgtgcacagaagccattgcacccgggaggtgggacgtgggccatggcgctagagagctggaaaggccgagggtgccatgggctggccagctagagaaggcttcctcgctttcatttttcagtcatcttctaagacccaaatggttcaggaggaagcgagtgccacacagttttgatttggcagtttccggcctgggcttggagggaggggcctcccctagaccttcctgtgtgttggtgctctgccgtggtaactgggaacacatcatctgtgtggaaggagagcctgctccctcgcgagaaccaggggaccgtgcttctgtttccagggactctggccaggtgcggtatgtgtctggtcctcggctaagttctcagtgatattcacgccgccagaggtcccagagtgaatgttttcctggcgtccctgaataaggaggcaggacagtgggcagctcggggcggcaattcgagaaggattgatgccagaggtgtctagggccatagaccccatgttcccgccagtccccctcccaccaccaggaggacttgggtcttggcacccagcagccggtcatccttgctctcagaggactaaacggaaggacaggcttctccagggtcaacagaggcagtgacggagctgggttggaccccctacttcctacttatttgagcccagttcatgccttggctgtccgagctgggggaagccagcaccccgaggacatgaccggctgtcccttcagaaggccacttggaggcattgctgacattcatgggcgcagccagtgcccttgggtgtgtccaggtcactggaggggcttttgggactgggaggtgccactaccatggagatttctcagcgactcagtcctgcctggcatgcaggccctggtgcaagggtactgttgttcgtggccttcaaagagatggccccatagttagagaagagtgagggcaccaggtccgtggtgggatgaaggaaaggagggaccctccccacactggaactacactcatgacctcagttcgcctccggcacttgtaaacaaccctgtragggaggctggatagggaaactgaggcacagagcagcagtgaaactgatcctggcctcccagctagtgaggaaaccttgattctgttcctgccctgccagaactctgtgagaggtgccccctccgccatcacctgagctccatcgaatgcctgaaatcctcacctctgcaggagtgagtctcccaagaggccctggaggcccaggcccagaccctgggggatatggaagcactcctttgtcgtggcgtgggaagccccacactgctctttccttggtgacgggtgacccgccatgttcaggcccctcctggtctatcttcgggtgagtctattaagggatacaccrtctccgctcagccagtcccgaggaggcaaagggaacaggaccctcttccccaggagagagcacactgggggagatggggtggcacacctgggcttcgtcctgtcactgcccactggctcgaggctttcctgcctgcctgggcttggsagatgcgtgagactccctgtctcatgggcctgagcagatgctgggccctcttgtcctctgccacatcctggggaactcagatgaaggccagcctccctcttcctgcacacccaccatgggatgagccctgggctcaggcccctccctgcctgagggtgccctgccactgccacacccaggtttccactcagacccctgctggccagcgtctcaggaggctactccctgctctgcgcagtgaccacatggttagccccagagacccaggttctgcgtgtcttcagtgacagagcaaccccatgcccaccctgccggcttccccggcacctgtctccttgcaggcagcctcctccacttctccagcacacaggtacccacagagctaactgctttgacgccatgctggttgtagacaaaacaggattgggaaaaggggaaaagtggagaaatggtggggaccaccttcctggccgtccgcctttacctggacccagtgagaaggctttcctggctgtgatcttgagccctgactgccgagcagccgagatctatcatccaactccatggctgggagctgggcacaggtttcttctcagaccccgcaccagattcaacccattccacgtgggccagttttctggagcaacttcctgggtcctgtagacccctgaggtctggtccgcaggggtcctgagtcaccagcctgggctgtttccctgccagagacttagctctctgagtctctggctctctggcctgctaagccacacggatcattcgtgtctccctctatctgaatgggtgaactggtgcctcaatggtaggagcctggggcttccctggcacacagtgggtgctggataactgtcagttccccctcttccagtcggacgaggcgccccagccaccatcctgcctggagctcaggtggttcctgggcagcccaacggagcccccaggaaaaccggagcagaggaacctggctttccttctgcgtggtttcctgggacctcttggcagtctctcagctggagagccctgctgagtgatttcacagtggagaaggatggagggaaggaaggggaagagagggcaggaggggagagcccgttgccctggtctgcagggaatagcctccctctgagggagggacactccttgccctattctccctgaccttgggcctcgtggagggcctgcaagcctgccagacccccactgcacacctgcccacctgtctgtctgattccagcagcccctgggcaccgagtgggttgcagagccatgctctgagcatgctccccctccttcaccatgaatgtgttttcattttccacccccgggcagcttcatgatctttcattgcaatctyaggccctggtatccacaggctctcaatgcagcctaggacagaagactctagaattctgcctcggagccctgtgatcccaaacactcagccgtggcaggggctctctgaaagtgatattcttgccacccctcccagatgcaggagggtaaggaataactagaatgcatgggcaaggagattcagctcgatctattcattataaaacaaatttaaatttaaaacattgcttaaaacctatacatgccagtgaagggcgaaggtcttagcagcagacatttgaaggaccaagaatgagcaagacccacctccctcctctagggctgagacccaggaaagggatgcagtgaccacatgcctggaatggtcagagaaaaccctgctgatagggaaggagagacgggggcagtggggacatttgacctggaccttgaaagacaggcaggttgtgataggcagagctaggaaaggatggtctggaaaagggctctgcatgggcaaggtcacagagggaggaccaggcaggctggatgatggccagaggcccagtgcggtcacaggctagggcatgaatatgggtgaataggataactaggggagggcatcagggccaaggccaccatgggctggacagtgatggggagggagggaagaggagagccctggagccccccaagcttttctggctgggtccacctgggctgcacagactgaaagaggcagagccagaatcggggcctctggatggggaggactgggctcggttgaccttgggtttcgaggtctgtgtcttggacagcagtgcccactgacattgagaaggtagggctggggttcacaggagaggtgggacctggaggtgactgccacctacctactggtcacagccctgacagtgtcacctgggggtagtgccaagggtcgccaagggtacgggtttgagagggaagatgaaggtcaagacagacagtagggaaccctggattcttccagagcccggggaggagaggaaaatagaggatgaggcaggtatctgctgcatccrgtgggccagctgctgccaaggaggcagcctctgttgagaggggaagcagagctgggctcccaggagcagcgagggggcgcaggaccccagattcagcacyaccagcttccaagcactcgccaaccaacttatacccatctgactgaggcagaaacactgaaagtcaaagtggcttccctaaggcctccaagctactaggcgcaggagccaggaccccaagccagagtcccaccctggtgacctttggactttgccgccaatggctctggagagatttgaccgtgaaaggaggaaaaggaaggtgagggcacagggtggctccggggctggcgggcgtagacgaagccgctttgctgcttaaccgcaactgccagcagcaccctctttcgtccgcccctttagaracgatttcaacggcgcattcttccatttcctgccttaatggggggcatttctggggacacccgtgaactgcgggctggggcttagccttgttggtkgccctgcataggttggctgcgtagtgctttacgttctgtgtaagaattgtggagtcttggggcctgggtgggccgagggtcctgagatatcgrtgtgcccagcaggcttgtagggtgtggcacctgcccagccctcaggggtcctggtgcagcttagcaagctccttggccaccagtccctggtgactcagatcaggggttccaagarcatgctttgagaaacactccctagccctagccgtttcagtctgtcagtgaacctgcccacctctacttcttaaggaagcacacgaggaagctgtttgtgatggttgaaagctccggcgagaagggctttgcgggggtttctgtaattcttgggaacatgtgaagcccacattctactggaatgacctgctgcacttttgtgagcttcaaatctgagatgtgctttcatcctcccgtgtgtggcagggcgccttgttagtgtccaggcctcttggaatgtggtttggttcaggggtactgatggcccgagtgcttgcccacggcagaggaggccaggggtcagtacaggagccagtcctcgccaccctgttcctgaccatacagagtctgtcacctgcctgtgccctgattgtaccccatctgcaccgtgtctgcaccctgcctgcgccctgtctgtaccccatgtgcgccccatccgtaccctgcctgcgccatctgcgccctctccgcaccctgtctgtgtcgtctgtgccctgtctgtgccccgtccgcatcccgcctgcgccctgtctgtgccccgtccgcaccctgcctgcaccccatccatatcctgctctgctgtctgcaccctctctgcaccctgtctgcgccgtccgtgccccgtctgcaccttgtctgtgccccgtccacaccctgcctgcactctgtctgtgccccatctgggccctctgcacgccctacctgtgccctgtctgtctagatagatcctgcagcgcctcccgcctctgctcagccagccccccgcaccccctagagggtattgcctttccatggaaatgagtagcaggtatttttagtcacccagaccaggaggtattcaggtgtcacagacacaaggcccggagccatgttgtccctttgctcctacaaaggaaacaggatgcccaaaacaggacttgtaaatcccaactcaaaacctccccgttccgcagggacacagggtgctttgctccttgaaggagtagtggatgcctccttatttacatccttcgtgcttacaaggcagtgggggtgtccaggggacatcagccaccctgtgctggggcacttcagaggctccggggagctgccatgctctctctccatcccaaaagatgggtctggggaggccactggggcaggcgagcccgctcctgtgaggagtgaaccccaccccccgccgctctgctggtgtgagtgacagttatcaacagaccctgaatgggggcttcccagaaaagaaaaaaaaaaaaaaagaaaacagtgatatccctgggagaaaggggcctgtttacatgaagcctataggccgttggaatctgaagtagcacctgggggtcctggtgacgccagcacagacagccctctccagggcagtgctacagtgagaccagggtctggggaatgtcacttgctcctcattaactcatgaatcgggagccaggataaggtcgctgccctcagggccaacatcagagcgggaggaggtgtatggtccagggcaccaaggcgtcactcaggccaccaccaaagcatcacaccaaagcattgacagcgtccatctcacatcgtcaggaaagggggaagcactggatggctgtggcctcacaggcagggagagtggggtccaaaggcgcagagacagcatggggtgtcagggcactgcagggagagggacaagggcaggtaaggagggaccttggaggccggaacatctttcacggaggcctcctgcttcctctgtgctgctgagctgggccattcatctggcctgggtggagggaagctgaacagggtccctctgcgacctggaggccccaggccctaccctgagcccttggtgctcttggagccctgagctgctccagctgcatgtgatcaccacacacacacacacacacacacacacacactctcccaacacacacacagacacacagagcctgtgccaccagccctcattctctgcctcacccagggccggaaggttctggctaagcctccgggggtgccactgggagggatgcctaggagagggtctccccaaccctctagcaacctgataatcatgatcaccggttgttggagtggcctggccacctgctgggctgtatgggtgctgagggcctggctgagccccgtgatacacccatgggggtgggtctctgargagcagtctgtgtgagcagcaggagaggtggcacctcaggtcaggggacgcttccccccaggctctggaggggacaggataacacctgtccccaggcttggcggaattcctggtctctaacgcagcccggaacacacagagaaatgatccagtgtggggcagtgttgctcacatggtggtaggactgggtcctaggctcctggagccagcggcctcagaaagcccctctaggttctctgagtctttgacactgtgcagcccagactcctcattttatagacagggaaactgaggccagatgactcatccttgacagagccgggatcatggtgcagctctctgactgagccccctcgatgtcctgtagtctctccaagcatgccctgcagtggtcatgactgctgacatctgtccctgcctagactgtgggcctcgtgaggacagaacatgcctgctgtccccatcacctctgtcccccagctcagcctgactggtaatgccccggccatgtcatgaggccttggaaccaagcctaagcttcctacaggccagcaaacatcgtccccagcactggctccctgatttcatctcccctggccgtggcaggcagagagaagccttcagaaccagggaggaccagagggctcctggcccaacggaggccaactgtgacaccaagggatcctccccaaggggtcttccccgccagatacaatcctgctctgagcaccctgaacaacaggcagtgcccaagggaggccagagacagccgtggcctctggggcctggcactcagccagagctggcaggaggcggggatgcacctcctgcagctgaggttgagacaaagccaggtgcctgccacggcagctgtggcctgagctggcatcrgtggctgatggccacagactccctgatgcctgtcatctgtactgagggctctgtcccagcccctgaaccgtacgtgatgcccacaccaccgatgaggacacagcttgtgtttttacaaacgaggcacttaattatgtggaggtaaatcctttgaactgcagaaaccatcccagcacgtccccatcaggtgttcccaggtggcaggcagagaaggccaaggtcccttgagtggatttccaggggagctgaagggctacrgccctgccaggactgggaggtactgggaggggctggacagctgagagcggctgcccccctgcaggaagaggaggcaggcgcttcacccgactctggacgacgctgacagcagtgtcaaggactctgccgtcactgttgtcctttgagttggcagctgccctgtgttgcagatttgctctggctctggccccctgcttcgtcccctccacacatttgttcttagtcctcagctcctcccgtctctgtgtcccgggtgagaacaggtcctagaccttgtctcaggtcacacagctaccagaggacagagctagaacatgaccgcagcagacgcctgatcctgcgccccaggcgacccgttcacggggcgggcgctcgcccttggcctcgctcctgagccacagtcaccagggtgccaggtaaagggaaaccacatgggggcgaggccagcgcacagccccagcagcctggcccctgctggctgcaggggctccagagcctgtgctacaagcccgggtggccggagcctcctgcgggattccccatcccacccctggaacttgctttccctgcttcccacacacagatcctccccaccagagcagggtcatggggtcagaggcagggtccgtgtggtgtggagcaggggttcctccccactcgctcgctcggctgccttcagcccctgcagacacgcaggcaccgtccaccttctccactcttagcgcgagccctgccccagccaggagcactcactgagtggccacattataccctcccgtttgtctatagttcacttaaacattatttcctgggagatccggcagctcttcactcttccgaatcaggctgtgggaaacrtttgtgtgcatctcgctttatttcctctcttgaactattaggataaagtcacagaggtaggattcctggaccccaagctctggacctctactacccaatttcaaaaaggtcgtagtatatagctcatgtcccagaaccagccacgtctcctcgtcgtcgtttcacygcaacctcgccagcaatgagtattttcatttaaaaatgtttttgtctgctggctatgtgattgcagaggcatggctggccccagcttgcagcggtcgcttctgcatctctttttattcagcggggcctttaatggatgtggtggagtaaagctgcctttcaaattgctgccgcagcgctgcctggcaagatgttaatcgttcatgccctgtcacgtggtcatgggacggtaatcctctttgaagccatttgttatttattcttacagtcccccggagagcagggaggagcccccagtgcctggatcacaaacgcaaatacagagagggctgcagacatttcagcctcgaggttggagcagaagcagggctggggcccaccagggtccagacccctagtaaagaggtcacttcccacaaaagaaggttgtttgtctgcttctcatagaacctgctctggttagagggtttttttttttttttaagagacacgatcttgctgtgttaccgagtctggtctgaaactcctgggctcaagtgatcctcccgccttggcctcccaagtagctgggactgcagatgggcattgctgcacccagcttggttagagggtttttaagcctagggggtgcatttgtttcctagtaccacaagcagggtggcttgaaacagcattatttattctctcatggatcaggaagccagaaggcaaggtgtgggcagggttggttccctctggagaccgaggtagcatgtgttccaggcctcgctcctggttcctggtggctgcccgtagtgttccttggcttgtagaaacacccccccgagattctgcccccatcgccacatggccttttctgtgtctgtctcctctttttatatggacacttgtcattggatttagggcccatcctaatccaggatggcctcatcgcaggatttccaccttaattacatctgcaaaaacccttttgccaaataattccacatcgacaggtaactgggattatgacttgggtggatctttcagggaacacagtccaccccacacaataggtttctacccccgagtcccacctccagccccgtctccctccagagtctggctgcttcttcctcatcagacagttccttccctctgtagggattgcatacaagtgttgctggctgaggggtgagggtggagtggggggatgtgggagctgagctgagggatgagggtgcaggcagagatctgggagctgagctaaggggtgagggtggagtagggggacgcgggggctgagctgaggggtgagggtrkagtgggggacatggaagctgagctgaggrgtgagggtagagtggggggatgtgggagctgagctgaggggtgagggtgcagtggggggacgtgkgagctgagctgaggggtgagggtagagtggggggatgtgggagctgagctgaggggtgrgggtggagtagggggacgtgtgagctgagctgaggggtgrgggtggagttgggggatgtgggatctgagctgaggggtgagggtagagtgggggacatggaagctgagctgaggggtgagggtagagtggggggatgtgggagctgagctgaggagtgagggtgaactgggggatgtgggagctgagctgaggggtgggggtggagttgtgggttgtgtragctgagctgaggggtgagggtggaggcggggacgtggcagcccagctgagggccttggagcacacctggtaggaagccagcctgtggacctggagccgactgagggtcccccctaccccccatgagtaggagtgggatccaacctgggtcccctctctcccctcctgctggtgtatttgtagttggaaggcagcacaccctcctggctcagagagatgggtttagtggcccggggaggcacggaagcccaggtctgtcttttcccagcggtcactgtgaggatgcagggcccccacgtggggagacagggcacagcctcccattggggcagatgggggtctccctgcccaggatgccggccggagtttcccctggcagggaccacgggtgctgtgactggagggaggtcccagggctggcaccctggggctctgttctgatgttctgatccattccaccctcacccctcagctcagctcccacatccccccactccaccctcacccctcagctcagctcctacatttcccactccaccctcacccctcagctcagctcctacatttcccactccaccctcacccctcagctcagctcccacatccccccactccaccctcacccctcagctcagctcctacatttcccactccaccctcacccctcagctcagctcccacgtccccccactccaccctcacccctcagctcagctcccacatccccccactccaccctcacccctcagctcagctcctacatttcccactccaccctcacccctcagctcagctcctacatttcccactccaccctcacccctcagctcagctcccacatccccccactccaccctcacccctcagctcagctcctacatttcccactccaccctcacccctcagctcagctcccacgtccccccactccacccccacccctcagctcagctcccacatccccccactccaccctcacccctcaattcagctcctacatttcccactccaccctcacccctcagctcagctcccacgtccccccactgcaccctcacccctcagccccactccactcccacccctcagctcagctcccacatcacccactcctcccctacccctcagctcagctcccacatccccccacttcaccctcacccctcagctcagctcccacatcccccacttcaccctcacccctcagctcagctcccacatcccccacttcaccctcacccctcagctcagctcccacatcccccacttcaccctcactcctcagctcagctcccacattcccctactccaccctcacccctcagtgctctgtcagaagcgctacctgaccacatccctcctctgggctctgagttcccctgtgcaagtggaaccaatctttcccctcaacttcttccaagggccgtgattgaaacccacctaaaatacaatgataagagctgttgtcgagggatcagacagcagcctgtgtaagatgagcactgggttctggggaaggacggtaaacagttcgccttattctgtgctgggcactgtgcttaagcccagcagcgggccctggctggactcagtgtccagagtgtctctgctcagggctggccgagagtcagcgctttctgtccctgtggcggacagtccgacctctccgaggctgccatagagactcatatcagccaggcgagctgggagcgccaccactccccagatagttactgcccgggcctccctgcccagtcactgcatgggggggggctcagctcctgggtgtgagtttgtgccaggctccagagaggtggggaccccagccacacccagggacagggccaagtggccaagagaccacttaaatgccagcgtggccaccccatgtaaagcaatgatctctctgaaattgctcatctggtatacaccaggacactggcctcttcttccttctcccatcctgggatttaagaagttaaaacccaccccctctgcccaggaagccgaggcagcagcttggagccagagccggaggcagagcggctccatccgtggggagccgcgccacctctgcgcctcctccgcgcctcctctgcgccccgcgccgtgctgagtcaggctctgaaacgcagtcatcatcsggaagtggttcttgctgtggccccatccccctgtgtgattttcctaccttggctcacttaaaatttcaatctggctctgagaggagactcagcatttcctttatctccttttactgtggatgcttggaaaggagtgggagaagctgggcgccgcagtgtgtgcgcgtcactgttgcccttacccccgaaggaggggatggccaagagaacctggaacctcccctcccgtccctgtgcccgccgcttcccttggccctcactgatgagcccaacagatgcagaggctccttctctccctggcactgcagccaggtagaggcagctgcagccgcagccctgagaggggctggagacgctgaggcaggggcagtggtggggtctggctcccctcagttcaaagtggcctgcagatgctgcctggagctgtctggtttgacatggctccctctgagggagctgatgagtgagggccaggagcactacttcatcaggcatcccctcacctgcaccaatggggaggcgaacctggagctgggccattaagacccacagattgttttctccatgttgcgaagggcagggcttggatttcacgaggcagatggtgagccaagtccggttccgctgcgctgggtcccccatggcagaaaggacccgcccccccatcaccctgacagtggcttgcatgcccaagagcagccagcayccaggacaggcttccctcgttcctctgttcatcctctttaagaatcactcagagccaggcacggtggttcacgcctgtaatcccagcactttggtaggccaaggtgggcggatcacctgaggtcaggagttcgagaccagcctggccaacacggtgaaaccccgtctctactaaaaatacaaaaattacccaggcatgatggcgtgcacctgtaatcccagctactcgggaggctgaagcaagagaattgcttgaacccgggtggcgtggtggaagttgcaatgaaccaagattgcaccgctgcactccagcctggagacggagcgagactgtctcaaaaaaaaaaaaaaaaggatcactcaggacaccaacatgggctgagaaatgctcctggtatcaacagaactgcagcagatgatgaaaacaaggctgtgatcagggaagtggctgagggagtgaggcccccgaaccrccaccccagagctctgtcccaggcccctggggtctcatgctgtgacctcctgcgccacatggggagaggtcacctgggggacttgtttccgtgggaacctcaggccttgggcctgagtgaggagatgtctgaagcctctggcctgggcsgagagtgagaccccagagcagccctgcccattcctctgggagcagcctcagtgaaagctgtaaagcagggaaattggacacgtccaggccagaaagagcaaagcaaaagtgcccctgggtgcactgcaccccacagtccaacccttctcccccaggagctgcaggccacgctctgagcctctgtttgaagtggtccctgactggacattctcatctcgggacatgagctagggtcacccagcaccactatgcagctctccaagtccccctggccaccccgccctctgtaggggtgctgggccttgctctgcacctatcccttggagtatctgctttccagagcggcaggaggcccgcctggtatgcccatgggggcatccacctgtgcagagtgtggcctctccccagcagatcgctgggtacatgagcaggcagcagaccataagcaggctggctaacgggtggagggggcccggtggtgtccgtgtgcgtgtatgtgtgcacacgtgtgcatatgtgtatgcacacacctgcacacacaccttcagatgcacgtcccctgtctagaccccatcaaagcctcttgccaggactggcctggaacacactgtccagcctgattctgttctctccctggcttctcttgatcaacttcctgtaatgggaggaactctgacacacttcacaaaagggtgtcaaattagttttaaagggaaaaagaactgcagcatgatctggaattcgctttctgccctgcggttccactgtgaaggcaacacgccttcgaggagttgggggatgaggcagtggggccctgtgaggccctgcggtttctatcggagtgctctctgacccccggtgttccctctctgtctctctatgtctttascaggtgtttcccacactttagtcattggcctttcatctcatgatttgggtcatctgtgctatttcttttctttttttctttttttttttttttccgacagggtctcactctgccgcccaggctggaatgcagtggcgcaatcttatctcactgcaacctccaactcccaggctcaggcgattctcctgcctcggcctctggtgtagctgggattacaggcacacatcaccacacccagctaatttttgtatttttagtagagaaggggtttcggtttcaccacgttggccaggctggtctcaaactcctggccccaagtgatccacccgcctcagcctcccaaagtgctggcattacaggtgtgagccaccgtgtccagtcatatgtgccatttcttagcttgcatttcctttttagttagttaaacttatttcttaaataagcttattttaaactgaaacttgatgtccctgcaataaagaaccagcattacttgtcatcaataaaaggtaactggaggcaggcatggtggctcacacctgtagtcccatctgctttcgaggctgaggcaggaggatctcttgaacccgagagttcaagttcaacctgggcaacatagcaagacctccggcccttaaaaaaataaaaagtaactggaaaaataagtggatcaatattaacttcaaggcctgtctcaagtgtggccaaggctgtctcaaggcagcacaggccttgctctgaacagccctggatgagccacagctgtgtctggggattgaagagagtgcccctggcccctccctgctccggtcacccccagttcctttagttcacagccctccatgttgtcaagggctgaggagtccctcctcgtccctgctcaggtgaacacaggaaatggggaagcccagggtggggtgggccgccccatcttccccttagctgatgggcaggctggatgggcagggagggtctttcctgggaaggtagtggcccgggagctgggctggccctygagtgttgaagatttaacttgaaagccatgagggcgctcttccccagaaatcatcgtggaagcggcgaatgagtggcaggaggtgcatggasagtcctggctctgcaggcgagcagcctgccccagctctttcctccttaraattgtgtgactttagccacatcatttagaagacacagatgatagaggtggtagaaatggaaagtgcaactctctacctgctgttgcccaccaccaggacgaccactgcaaatagtgtgggtgacccgttcagacctgggactcagccacacattggcccctgaggcagatgaagtccccagcagatggggagatgcagcattgctctgagggagcagcaggagtgaggacaggagctgccacgtgcacaggagcaggagggaaacaggcaggcagctgtgcccagggccaagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctgtgcccagggccaggtgtgcgggaggcgaggcaggcagctgtgcccagggccaggtgtgtgggagagaggcaggcacgtgtgcccagggccaggtgtgcaggaggagaggcaggcagatgtgcaggggcagagggggttgaaggatggaaaggtagacaggagaggctgtgaatggctctggatgccgagctgaggcacttggacgtcatgctgacagccctggacctccacgaagggcttttgagaaaagcatggcatgaaaagatctgctgttgagaaatagaaacggggctctggtggcaggttgacaaccatggtccaggcaggrgcttccaaggcaagtggtggaggtgggcgagagggagagttccagggatatccgcgtggatggagccaacacctggagcccagggcaggggggtgggctgaaggggcacctgtggggcccttgcctgtggaggtgagaactgcagcttggagagcagcagaattgccccccggaaggttgctaggggaagattcccagagaagctgaaagcagtagtgctcagaggacaatgagctggcctaggatggtggaggtggaggtgatgaaggcagagggggcagaggccatggtggtggtagaggtggaggtgatggaggtgaaggtggaggtggtgggtggaggtgataaaggtggaggtgatgaaggtggaggtgatgaaagtagagatgatgggtggaggtgatgaaggtggaggtgacgggtggaagtggaggtgatgaaggtggaggtggtgggtggaggtggagatggaggtaatggtggaggtgatgaaggcggaggtgatgggtggaggtggaggtgatgaaggcggaggtggtgggtggaggtggagatggaggcagtggtggaggtgatgaaggcagaggtggtgggtggaggtggagatggaggtagtggtggaggtgatgaaggcggagggtgggtggaggtggagatggaggtagtggtggaggtgatgaaggcggaggtggaggtgatgaaggcggaggtggtgggtggaggtggagatggaggtagtggtggaggtgatgaaggcggaggtggaggtgatgaaggcggaggtgggtggaggtggagatggaggtagtggtggaggtgatgaaggcggaggtggatgaggtgggtggaggtggagatggaggtcagtggtggaggtgatgaaggcggaggtggaggtgatgaaggcggaggtggtgggtggaggtggagatggaggttgtggtggaggtgatgaaggtggaggtggagatggaggtagtggtggaggtgatgaaggtggagagggtagaggtcatggtggaggtgatgggggaggaggaggtgatggtgacagagatagagatgattgagatggaggggcagagatcatggtagaggtggaggtgacagcagtggtggtcgtgagctgtgtgtgtgtttctgtgcaggtgctcacccatgcacgcatgcccatgagatgcctggctctccacacacgccctgtgagccaggcatcctctcggtcagggatataagcctgggcctgtgcaggctgccctctcccactgtggatccccttggaggagactgctgcagctgcagggcaccctctgtcgccctaagaggagcagcagaacatgacctcccatcgctccrcttcccactgctctgcttggcttcagcctcatgctggcatctgtgttatctataagcagaaagctgcttgttcagagcgggctgagacaccttcgtgcgttcatcaaaagcgtgctgggcaccaatgaggtgtcagttcctgttccgggcatgagggattcagcaggaaacgagacagacccaccccctgccctcagtgtcccgctggggccagtcaggtgaacagtcacacaggctggggtaggcgcttggcagaagacacacttgtgacgctcagagctctctggagcagcctctccgaagagatgaaatttkagcaggaaccccaaggaacagcatccsaggtagagggatctgagtctgcaaaggccctgggcacaaaagaaacaaccacscaatccagggctggggargagccctgtcagaggacagcaccagcctccccacgtggatgcccgaccagcatctgaggycagacacagccgccactggctccagggctcccccacaccactgcacccacaactcccctgtttcagaaactgaccactcacctctggaaacccaggagccacctgcacccctgtcttccccctacaccccgcatctgtccgaagaccctgcggtctcagcctcttggattgccagccactggtcacctctgtctccccgcccttgcccaggtggccccagctcacacctgcattgcctcggagactcctgacracacccaccccctgctgctgcccrggcccccccagcagtcggttctcagtgatcttgagaagcaccactcagctcaccctacgaggaggcctttggctgttcccgtatttgtctctggacttctctgctggccatagaacaagactgtgctttagagggtggactcccagaactgccactcaccaggtgaccaaggcaggccagctttacctctccaagcctcagttttctcagctgtcatttgtgcctaaaacatagtactaacctcataggattatggggcaaaaattacgctgaatgaacgcacgggaaagcccttatcccgaggcctcattcagactgcactgggtcgccagcagctctgacatcgctgcccacacattaatacagcccagggctgctgctcagatgggtgtccttctcctgcacccactgtactgggagggcacttcctggatgtccctggacccccgccatccaatgtccagcttcagcgtaggacttggtgtccgcaagaatgaggcccacatccaggagcaggccagtttcacrtgaagcccagggctgaagccagaggccacgcrgcaccacgtcggacagtgtttatctgtgctaatcatgaagtaacacaagtgaggtttaaaaatactacgcttatttcatttcagtgcaggagggagaaagaacacacagtctgtatgagcaactcaaatcaaaaataaatgaggcaaaagagtcaccaaaaatagtgtggcattagaracagcagcctgcgtggctcggccagctgtcctcggctctctgccggcaagcagcaccacagagagggctgcgaggatgccttgatggtgtttactccagagaagatgaacctgatgcctgcgatctgatgagaagtcacagttaccagcagggaaggtagcactgaggggacacacagggcacccaaaggtctctggcatcctctcctcctcccgtcaccctcgccaggcagtgaggtcagaggctaggctcgcaggcagcatgggaaccacttggccagaagtttcctctttgacctgaaggagttcccccttccagactcagagtgtccccacagaagggcagggctgtggcttggacccatgtggggctccagcccccagaggagcaggacagcatgtgctgtacacagcaagaggatttgcacttttgccttaattttattacagacggggtcaccttccyttttttttttttttttttttttttttgttttttgagatggagtctcactctgtcacccaggctggagtgcagtggcgggatctcagctcaccacaacttccacctcccaggttcaagtgattctcctgcctcagcctaccaagtagccaggactacaggtgcccgccaccatgcccagctactttttgtatttttagtagagacggtttcatcatgttggccaggctgatttcgaactcttgacctccggtgatccacccacctcggcctcccaaagtgctcagattacaggcgtgagcccctgtgcctggcctcaccttccttttttaatgtgtcagaggtctgcaaattatggcccaggggccagatcaggcccaccgtttgtttttgtaaataaggttttattggaacacagccacgcccttcatttacatatttgctgcttttgcacccagagttgagtaatcgtaatcgagatggactggcccgaaatgcctaaaatatttactgtctgtcccattgctgcaaaagtttgcccttccctgccatagctgcgtaagcaccctggggaagcgtcctgtccgctgaagacagctccagtgtcgatggggcttgggtcagtgttgggtttgctatgctaatattgatttggagctttagagatttttggttgattggttggttggttggtttttgggggttttttgagacaggatctcgatctgtcacccaggttggagtgcagtgtcgcagtcatggcccagtgcagcctccacctccccgggctcaagtgatcctcccactcagcctcccaagtagctgggaccacaggcatgcgccaccacrcctggctaatttttgtatttttttgtagagacggggttttaccatgttgcccagactggtctggaactcctgggctcaatctgcccacctcggcctcccaaagtgttaggattacaggtgtgagccatcacacccagcccctagagatgtttttatttaaaaaagaaaggagattctgcaataatgaggtttctctgatgcaaggaacatcttttgtccagagacatttagtcactcgatgggcctcaaaccccaccgtaaaggaagcactacattccagccaccagcacccacctgctgcctgctgcctgctgacagcttcagctttcagagcgaaggaggcttcccacggactcccaggggccaagcagggtcccccagaccaccctgctgggccaccctccaacatctccgagtgaggggtgggtgggactccacaggccagggctcagggaggacctcgctcctggcgggtcctttcctgggatgcactgacgtcccttggctcttccccagcttccatgagtcacaatggagctatttaaacctggggctgtgagaacatgtcaatgtgtccacccccttgagaccacagggctttcaagacagagcatcctttcaatagaccgtggagccaagtactgaatttgatgaggcgttttcacgaggcctgtgtgaaacacttaaaaattgtgcataacatgtgactggacaggcgtctaccagaaaacagtgcaaggagcttttaagccatgaggtttgcatctgtaggaaggctttggggtgctgctcacacgcggtgtgactcgggcggggcaggcagtagacggcagcggtgacactgcagtgacgctatggagcatggacactaatacgtcccactggacttctgcgtgrgccccagacaggagcttgaccagcgtcaactggacctgctgcatctgatcctctcccagagtgaggttttgaacagagatgggcagaacaccactaatcacaccgctgctgaaataggtctgccttctgggtaccggttatgaaagcggatttgtgtgtcacatccccaggagaggaggttatggtctcacaagaggaaaacccagcagaatcccagagttggctggaaagtcaacaaaccrcctaaaactcacccacaaaataccgtgaccaggagtatgcatggagacagtgccgagctccgtacaggccgtctgacttcagtgagaccccctccccaccaagacagaggaaaagtcctagactcaggcccacaaggatgggcaaatagggctggggacgcagggtgcgtagagcagaggtgtagattctgcaagggtgtgtgcaaagcagataggggagcacaggtgtctgcaggggaagcatggccttcttattgagctttttttgagatgaggtctcacactgtcacccaggatggagtgcagtggcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttacccaccaggcatgggtggctcacatctgtaatcccagcactttgggaggccgaggcaggcagatcacttgaggtcaggagttcgagaccatcttggccaacatagtgaaaccccattgtaaaaaatacaaaaattagccgggcatggtggcaggtgcctgcaatcccagctactcgagaggctgaggcaggagaattgcttgaacctgggaggcggaggttgcagtgagccaagatagcgcctctgcactgcagcctgggcgtcagagcaagactgtctcaaaaaaaaaaaaaaacttggcctcccaaagtgctgggattacaggcataagccaccacacccagccaggcgtggcctaaaaggctgtgttcctggaggagatgttgtcctggaacagggttcagcaaaaaaaaatttytttttagacaagatctcactcagttgcctaggcgggaatgcaatagtgtgatcataggcgactgcagccttgacctgccaggctcaagcagtcttcccacctgagccttgcaagtagttggtactacaggcacacacctgtaatcccatagctgtaaaccacacccaactaattttttttgtaattttgtagaaaaggtgtctcactgtgttgcccaggctggttttgaactcagctcaagcaatcctcccaccacagcctcccaatcccaaagtgctgggattacaagcatgagccactgcgcccagccaggcaaatgttttcatagaggaccagatagtcgatgttttcagcttgcaggaaattcagtctctattgcaactactcaggtctgccatagtagcgtgaaagcagccccgggcaatatgtaaataggtgctgtgtactgaatgtttctgtcccccaagattgatagccctaatcctcaatgtgatggtattaagaggtggggctctgggggtgataaggtttagataagctcaggtcttgctctgttgcccaggctggagtgcagtggagtgatcatggctcactgcagcctgggcctcctgggatcgctcaagcgatcctccaacctcagcatcccaagtagctgggaccacaggtatgcaccacgacgcccagctaattttttttattttgggatagaggcctcacgacaggactagtgccttggtaagaagaggaaaaggccagagctccctccctaccctgtgtggacccagcaggaaggaattctgtctgcaagagagagccctcacctggaaccaaatcagccaggaccctgatgttggatttaccagcctccagcaccgtgagacagaaacgtctgctgtttcagccacccaggttgtggtatttcattatggcattcccaagctcactaagataacaagatagcttggctacctggcaataaaactttatttatggatgctgagattgggaactttatataaattttgtgtgttatgaaatgttattcttcttttggttttctttcgtttaaaactgtaaaaattggactgggcacagtggttcacacctgtaagcccagcactatgggaggctgaggcaagaggacagtgtaaggccaagagtctgagaccagcctgggcaacataacaagattctgtctctataaaaaattataaaattagccgggggtggtggcacacacatgtagttccagctacttgggaggctgaggcagacggatcacttgagcccaggagttcaaggctgcagtgagctgtgatcatgccactgtactccagcctgggcaacagagtaagttcccttctcctaaaaaaaattaaatgaaataaataaaactgtaaaaactrttcttagctcgagggctgcacaaacacaggtgacaggctggcgcagcagttttccaacccctgtcctacagcaaggagggaagccgtcacactgcactctctgctggccagccggtgtgcagtgttgctcaggttctgggtgcctctgtcatttaggaaggaatcagcaccattaaaagagagtggcagggtgctgatgttccagagagaaactgtgccgaatgatggctaattaaggctctggagttgggcactggagcaccggactccctgctctccaaagcccagcttgccagcctcgacctgagcgtcttcactgatacagcaccaacccgaggctggcctgtaaggtttggcgagggtccagtgtcacagcccacgtgcagcacgtgctgcacagtgtcggccaaaattatattcatggcttaagtcagaaaccttgtgtggaaggagggaaagaagcaaggtttgctctcaagaacaaagggcccggttgtagatggggtgagctatggcaggtgtcctcagatgctccagggattgtcctagacagagggactcacttcgttgtcaatctccggagggcggagcaggcccagcaggtgaaagttatgaggaagctggtttccaatcagcatgcaaaggaccatgttgtcatttcagttgtccccagtgggatgatctgcctagagtttcccacaggtggaggtcttgcggaggggggtcatgcatcccccggagccctgtacctggggtcccgtctctgcatgctcggaggcttcacgacatgtaaacctagttatcttggtaacacttgggggatgtgccccctccccacagtcctggcccagaggaatgaagttacatcaaagcaaattgattcggtcgttgatccttatgttgtagaaatagctagaagctataaggagaaccactgtgaggtccccattaaaggagaagaattttggtggtccccagacagggctggctcgggatctcgttctgtggtcaggaccacctgctgcagtacagcctcccacctcagcctctcagactgccaccttctgcccccaatccagcctgagatgcccccagcaccacccctgctgaaaacagaagcagaacctgatactcagcctcttccatgacaagaacacaccaggatcgcgtccctttccaagcagaattttcccgaagccccaccctcctggactcgggttatggaccgccacaggccaccccagctggaagaaaattcaggaaatataggggtcatgggtgacaggtgggccagccagcaaccgtatctaccacatttttaaaatttctatttttattatttatttatttttgagacggagtctcgctctgtcacccaggctggagtgcaatagtgcgatctcggctcgctgcaacctctgcytcctggattcaagtgattctcttgcttcagcctcctgagtagctgggattacaagtgcccaccaycatgcctggctaatttttgtgtagagatggggtttcaccatgttggccaggctggtctcgaactcctgacctcaggtgatctgcccgcctcggcctcccaaagtgttgggattacaggcatgtaatcccacctgtaaacctgtaaggccaccacacccagcctaaaatttttattttcatatatattttttgagacaaagttttgttctgtcacccagctgaagtacagtggcacaatcacagctcactgcagcctcgaccttccaggctcaagccatcctcctgcctcagcctcccaagtagcctggactgcaggtrcacatcaccatgcccagctaatttttttattttattttttgtagagacagggtttctccatgttgcccaggctggtcttaagttcctgggctcaagcgatccacccaccacgggctcccaaagtgctgagattacagagatttcaggcacgagccaccatgtgccatgtttattgagccagcttaaatatttggcttaaacacatacacccaaatgtggagctgctgttgactccatgatgcagaagtttctttttctttttcttttttcccagttttttctattgtggtaaaggtacatataaaatgtgccatcttaaccacttttaagtgtacagtttagtggtattaagtataaaattcaatagtattaagtgtatagttcagtggtattaagtgtacagttcagtggtattgagtatacagttcagtggtattgagggtaaagtgcagtggtattgagggtatggttcagtggtattgagtatacagttcagtggtattgagtatacagttcagtggtattgagggtaaagtgcagtggtattgagggtatggttcagtggtactgagtgtgtagttcagtggtatgagtgtgtagttcggtggtattgagtgtacagttcaatggtattgagtgtacagttcagtggtattgagtgtacagttcagtggtattgagggtaaagtgcagtggtattgagggtaaagtgcagtggtattgagggtatggttcagtggtattgagtgtacagttcagtggtattgagggtaaagtgcagtggtattgagggtaaagtgcagtagcattgagggtatggttcagtggtactgagtgtgtagttcagtggtacgagtgtatagttcggtggtattgagtgtacagttcagtggtattgagggcacagttcagtggtattgagtgtgtcattcagtggcattgagtgtacagttcagtggtattaggtgtatagttcagtggtatcgagtgtgtagttcagtggtattgagtgtacagttcagtggtattgagtgtctagttcagtggtattgagtgcgtaaattcagtggtattgagtgtacagttcagtggtatccagtgggtagttcagtggtattgagtgtatagttcagtggtattgagtgtacagttcagtggtactgagtgtatggctcagtggtattgagtgtacagttcattggtaytgagtgtacagttyggtggtattaaggatacagctagttggtattgagggtacagctcagtggtattgagtgtataattcagtggtatcgagtgtgtaattcagtggcattgagtgtacagttcagtggtattgagtgtgtagttcagtggtattgagtgtacagttcagtggtattgagtgtacagttcagcggtattaagtacattcataatatatgcactaccatcaccaccatccatctccagaacctttttattctcccaaactgaaattctgtccccattaaactggaacttcccattccccctcccctgcccctgagggccaccattctgctttctgtctctaggcacgtgactactctagggacctcagatcattggaattgtacagtatttgtcattttgtgactggcttatttcacctagcagaatgttctcgagactcatccgtgttgtaccatatgtcagcatttccttcctttgtatgactgagggatgttcccttgcatgtgtgtgccacattttgcttatctttttttttttttttttttttttgagacagggtctcgctgtcacccaggctggagggcagtggcgcgatcttggctcactgcaacccctgcctcctgggttcaagtgattctcatgcctcagcctcctgagcagctgggattacaggtgcctgccatgacacccagctaattttgtatttttagtagagacggggtttcgccatgttggccaggctggtcttgaactcctgacctcaagtgatctgcctgccttggcctcccaaagtgctgggattacagacatgagccaccatgttcagcctttgcgtatctttttatccatcagtgaacctgggttgtttccatgttttagctattgcaaatcatgctactgtgaacacacgggtacaaatatccctttgagaccctgtttgcaattatttagggtatatccccagaagtggaattgctagatcatatagtaattcgacttttagttttcaaagaaccaccatactgttttccatagtggctgtaccattttacattcccaccaacdgtgcacagggtccccatttctccacatcttgccaacccttattattctgggcttttttatagcggccatcctaatggctgygagrtagtatctcactgtggttttgatttgcatttccctaatggttactgacgttgagcaccttttaatgtgtttattagccatttgtgtcttgtctttggagaagtatctattcaagtcctttgccgtttttgtaattgggctgtttggttttctgttgaattttagttctctatgtattctggatattaattccttatcagatatgggatttgcaagtattttcactcactctgggttgccttattactgttgatagtgccttctatttttctttacctatttatttatagaggtgggtcttcttatgttgcccaggctggagtccagtggcatgatcataactcactgtagcctcaaactcctgggttcaagggatcctcccacctcagcctcctaaatagctgggaccactggcatgcaccaccatgaatgactaattttttttttttttycgagatggaaagtttcactcttgtctcccaggctggagtgcaatggcacaatctaggctcactgcgacctccrcctcctgggttcaagcaattctcctgcctcagccttccgagtagctgggattacaggcgcccaccaccatgtccagctaatttttgtatttttagtagagacggggtttcaccatgttggtcaggctggtctcgaactcctgacctcaggtgatccacccatctcggcctcccaaagttctgggattacaggcgtgagacaccatgcccagctgccaggctaatttttaaattttttgttagagattgggtctcactatgttgcccagactggtctcgaactcctggcctcaagcaatcctcccaccctggcctccaaagtgctgggttacaggtgtgagccaccgcacccagccagtagtgtcttttaaatgaagtatctctaattttgccactcagcatttaccagtcacctgccttcctggtccaaagaaactttttaaaaaaagagttggcaaatatctgaaaatacaatttatttttaagagccaggaatgaagctgaggtttgagggctggttcagtgtgtctgaaactgcgaagcagccagtgaggttactttcgcatcccctagcttttacctctgctcgtgagattcagcatctgcagctgtggtctgtgatagccgtgaatacagtctgtgtttggagacccacagagtcagggcaacatctccgtgctgggggccaagaggataacggctgttctctggctctgggaggcagcagaggtcacctgtccagagccagagttccatggggggctccagggcaggaggtcaaggtatgtgtgaggaaagaaccccaatttcgagctggacacacctaggctctggttccagctttgccactaatttcaccaagcgaccttggatgttatttaatattcttgggcctcaatttccccatctgtaaaaagcatgtcatagtcagggttgggagcaaggcccagagctggctcaacatgggttgctgtcccccagctctccgtcatggcgcctcgctctttctttttcattttcccattcgttcgccttcctccttctcccttctccctcctgtttgtctctcgacacctctactttcctagtgagcacccagactattttattttcccttccttttcctctttctacctcccctaaccactgtctttatctttatcctgccgggaacacacagcagcacccctggtgtaggcttcagagctgtgtacctatgccaggagagggggtgccagcctccctcctggaatcacacacacgggkgtggcctgggaccagggactcaacacggtgcaggtggcyggcaccatgggagatggaatgttccacccgagtcctccctttgcctggtaccccaaagagcttgggctgtgcccagagtgagtcaccagagagcctggccccaggctcagcagctggcgtaggagggaggaggggcctccccaagaaggaatgaggggcctccccaagaaggaatggcagagcagggagaggccgcggggagggagaaaaaccccgcagagggtgctcttacctctggcccgtcctccccagggccacctgtcccctcaaggcggctgccccctctgtgtcctggcacaaagttgggagatggagtggcagagcctgccctgggcttctcagcagtgcacagctcagagcacactttagagtcagccagccctgagtccagggctctctgacccttcgtgttgtcacctgtagcatgggggggcagcagtaccccttcccagggcagcagggaagataagatgagggagcgcaggtaaaaggtgggcagcccaccccagcacacagccgatcccggcacacagccgatcccggcacacagccgatcccggcacacagccgatcccggcacacagccgatcccggcacacagccgatcccggcacacagccgatcccggcacactgctggcagcagtgaggggagctcttcaacatcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcaggtacctggggtgctccggggatcccgttgtctaggatgggttttctgtctgacgggtgggcagcctcagctccctgagcagggcttaggtcccccgtaatgtccagggttaattgtgccagcctgaacccctgagccccgcatgcccgcctagggattggcctcagcctggggtgagctgaccccaaagacaccctgcccaacgcagcccggcccttcactgcttcctgttgctgctgctggacagagtgggcctggcacccagcagagatgtctgacggccgcacattctcccctggcttctgccttcatccctgggatgatgttgagggagacgccggaagatggagagccatgtggggccacctctgtccctctgcagggggcagggctggcagctcctggggagagccctgcccatcttgtctgctgtctctcgggaggccctggcctggggattcccatctctgagtggaaggcgcgaaggcccctgccttgaacatggatggcgtgggtccccagtccctcctctctcccctcccccttggggctgagcacagggcagtggtgggggataaagacccctcagaacacttccccaccctgcaaccccttgcacagccctgagtcactgtcccagaggggagggcaaggggctccctggtgatggcttcctgcgtcccctctcacttgcctcctccatttcccctgggcaggatatgggtgcagggtgtggtcttggagggaggaggctgtaagcctcctgggggacacagtgtgtgtgtgtgtgtgtgtgtgtgtgtgtgtggacggctgaagggaggaggccgggggcctgggtgtgcggctatggggactgaactgtcgagggctcctgctgcctccgcaggggacaggccctgccagctactgagtgagcagcctgcggcagccctgactcactgcgggtcgtgccgtctgtgcagcactggggtacccaccacccagtgccaggtgagcggccctgcacggcaccgtagtttccacctgtggtcactgagaggcaggatggagctagggcaggcatgggaattttttggctgtggtctattttttgttcattgcagcattgattacatgtgaatgtggactgttcttgcaaaagtctagacctgtcgtatttgtaatcagggaacaggcattgaacgttgctttgaagagattgaaatttctagcttgtgatcttcttgaaaattgttaatgaggcgttgatgtgatgtaccatcaaatgctccgttcggcagtcatgaccttgggcaccgtggttaggtcccaatgcttctgctgttgactgaaccatgtgacatctgtcgccgtgccactggtcccctcggctcaggcctcaggagattggaggagagactgaggtttctctgtgacaaacacagggaatcctgactgggatctccaatctctagtaaggtttgcacagttcttctcctcrcatttctttggctgcatctgagccaaagtctggatggagctgtcggggaactgggttatgttgacctcccaacccctgcccaccctctggggtgtccttctgacaaatgggcctttcttccagatccccatcatgacccaccaggccaacggccccctagggtcttgaccccagtgcactcagagtcagcacctgccttcgttgcagcattgaccctctgccatcagatcccacccagggaaggaatgggctcctgtgtgggckcctggcttctgggtgagaggggaagtgtgtgttgtgtaagtgcccttctgtgtcatgcggttttgagcagttatacctcttcctgtctccgctggaagcacagtcactgccatggctcctctaggctctggcacgcagaacaagcagaccatggttttgtgttatacagtagtcacggcagatacttcgggggcttggcaggggggacctccggggttccagaagcaacatgcaaaataacatcagttcaacaagcaggtgctggagtcctcgccccgaggccttccggaagacacccaggacgtcacacctagcccagaacagcccccctctctccatcccttctgcgatgttcactaggcattaccacatgctggtggccgctctgggtgcggggktacatccgtgaaggaaagagatgaagctccctgcccagaggagctgacctcccagcagtcttacaggatatggttacagaggtgaatctgggggagagtccatcgttggtgttgctccactgacctccaggatggcctccagggaccccgcctcctggtggccactgtccccatcgtattagagttggccttttgaaagctgtgagtccaagttgcctggcaaatagataaggaatacaaggtgatcattcttaagacctcggggatctgcaaaccagccttctggaacctttgagcttccaggatgattcggaatttggatgcagccacagaaagcctaagcgccacaagtcccgccatgacgccctgaggcgtgggttcacacttgggtgtggctggtcacgtctataaaaatgagccttcactttgggaggcccaggcgagtggatcacaaggtcaggagatcaagaccatcctggccaacatggtgaaaccctgtctctactaaaaaatacaaaaaaattagccaggcatggcagcgtgtgcctgtagtcccagctactcagaaggctgaggcaggagacttgcttgaacccaggaggcagaggctgcagtgagccgagatcgcgccattgcactccagcccgggcgactgaagagactccatctcaaaaaaaaaaaaaaaaaaaagatgagccttttctgggaaagtggaaaagacagagaagcctcctgacagccaaggagaccagcagccagtagagcaggtgttgtaacaaggccgaggaccctcagacaccaattttkctggtaagaccgctgcccaggatgcaccgtacaagagcagcttcacctgccttcatgcagatggcacagatgtccaggaagcagctgtggtcagtgactccccaggagtcacacccagacctggggccagagccatccctgcacctctgcctgatgtgacaccagggcggggcacaggctagtcccagctcctgcagcccccgctgcacacccctacctgttagcacactgagtcctccctcattatcatcccattttacagatggagaaactgacacagggaaggctgagagaattgcccaaggtcatagaccagcacatggcagagccagtgccaactccaaagcccagatccgaaccactgagtgggcctaacctccttcccaggaacccagactgatcrcctcaggtcacccaaaggggatggaatagtgtcatcaaccagctcccaaagaagatcagagcatgtgcagtcagcactggcaagatttcagcttagagagagatcctctccagcctcaaagtaccgactttggatcaagacttctcactaaaggaaggttccggccagctcaaattttttgtactccagaatctgcaataaagagacagataatgtcttttgcagaaactggaagtaggtttccaggtacccactggacttataattcaatgtttataagtatgaccctggagattaaatcaaagcagaacttgctccctggagccctggggttaagcgctaagatgaattctgtataatgatgctgctggtagctacagcgagcatttatttatcatgcactcatggagcagctggttccatgtcacagagaagctggggttgcctggtccaggtggggtggctcttgcatatgtagcagggtggactggggcgtgcctgtcccatgatcatggcagaggttcaggggcaagtctcctgtgactgagacatctgatcaccttccggtggccaaagcaagtcacatggttgcacaggagcgcaaggctaggaattcacccctccaacktgtgtgtgtgtgtgtgtgtatgtgcatatgtacgtgtgtctgtgcattgtgtatatgtgttatgtatgtatgtgtgtakgtgtgtgtacatatgtgtgtatgtgtgtatgtctatgtgtgtatgtgtgtaggtatgtttgtatgtgtatgtatctgtatgtgtgtaggtatgtgtgtatgtgtgtgtaggtatgtgtatatgtatgtacgtgtataggggtgtgtgtatgtgtgtttgtgtgtatgtgtgtgtgtatgtgtgtaggtatgtgtatgtttatgtgtgtttatgtgtgtatatgtgtgtatgtgtacgtgtgtgtagatatgtgtgtgtatgtgtgtaggtgtgtaggtgtgtgtgtatatgtgtgtatgtgtaagtatatgtgtgtaggtatgtgtgtgtatgtatgtgtaggtgtgtgtatgtatgtgtaggtgtgtgtatgtgaataggtatgtttgtatgtgtaggggtgtgtgtgtgtgtgtgtgtgttgggagaggcagcaaagtcacacagcaaaggacatggatgctgggagaagtgaggcattgggtgtcagtaactccacctcccatacccttatgccctccctatgcaaatcaggtgccagctccatcaaccagaacatgtgggtaaccataacaggttgtccccacaccaggtcaaatcagaaagtgtcttctattattttgtgtctctgtccttgactcctgggctcagtcctgacctttccttgtggtttcttggcttaagccattcatttatttccttctctcacctgggtgcactgacttcttcccatctcatgcaagcagctcaggtggctccgacagggtacagattccctttgatgctgaggttgaaggaatcagagacagtgcccccaaagctcctactcagacctcccagggcacatttgcgcccaatataatagtcatttaccattaactccaacagagaaattgtggtcccaggccccccattctgcagatgagaaaactgaggctccaagagaggccctcgccttggttggctgtgcccccgggagttttgctccatttatccatttagtctggggctgctcttccttgtgtgtccttgcctagaattatgtatgggtccaccttttccaaaaatctgccagccctggccgggtgcagtggctcacgcctgtaatcccaaccctttgggagactgaggcaggaggatggcttgagcccaggagtttgagaccagcctgggctgcagagtaaggcctcatctctattaaaaaaaaaaaaaaatagccaggctgggtggcacacatctctgatcccagctaattgggaggctgaggtggaaggatcccttgagccccataggtcagggctgcagtgagccrtgatcatgccactgcactccagcctggggaacaaagcaagaccctgtctcaaaaaaagaaagaaagagagaggggcatggggcagcgtggagaggaaactgccagccctaaatctcatgacttaggcttgccccaggagccagagtcccataaaggggcactatgggccttccatcagtccctgaaagagtctcaccagcaatgccttcctggggctatggctttgatgacagttcaagacccccaggatccctttctgtgtttaaacaaacttggcttcctgtcctctcaccaactcttgcattcagagctcaaactggcaacatacttggcctttctagaaaaactgcagttgagaaaacacctccactgaggggtcataggggaaccgaatattcacacagccttcaagaacctcccctgtgattcctggttaatcatgaaaaaaagaaagagcagtggccggttgcggtggctcacacctgtaatcccagcactttgggaggccaaggcaggcagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagcyaagatcatgccactgcagtccagcctggcaacagactgagactctgttaaaaaaaaaaragagagagagagagaaagcaagcaagaaagaaagagaaagaaagaaaaggaaggaaagaaggaaggaaaaagaaaagaaaagaaagagctatgccctggcagacaccaccttaaccaaatggccagacctggtcttgccctcgatgggcaaacttgcttgttcgcccctgcctggacgcatgaaaaggaaaagacctccccaaaaaggttcagctaaattgaatcctgaagctacaatcagacaaatccaaagcaagggactgtcagcaggacagatgacctaaacgtttcaaaaaaggtcaatgtcataaaaaacaaaaatgaaaaatatggggggttgcttctagattgagagagatgagagagaaataaccaatgccatttgtgagccttgaatggatcccagatttttgtaaagctgtaggagttatttttggaataattgggaacacctaatagaggatcaggcgatattgaactaagtatcttaggtacaatgctggtgctgtggttaagacaaaattctcagatgagtgctgaggtattgaggggtggagctcaggggattgctacgcactttcaaacagttcagagaaaagtgtgtgtgtgcatgtgcgtgtgtgtgcatgtgggtgtgtgcgcatgtgtgcatgtgggtgtgcgtgtatgtgtgtgtgtgcctgtgtgcatgtgcgtgtgtgggcatgtgggtgtgcatatgtgtgtgtgcattgcatgtgtgcctgtattgtgcatgtgtgtgtgtgcgtgtgggtgtgtgtgcatatgtgtgcgtgtatgtgtgcattgcatgtgtgcctgtatgtgtgcatgtctgtgcatgtggatgtggtgtgcgtgtgtgtgcctgtgcatatgtaggtgtgtgcctgtgcatgtatgcatgtgtatgtgtgtacatatgtgtgtggagagaggaaaaggggaagagaggagcgggaatgcatacaagtgagacaagaggtaaacaattggtgtatgattgcgatcaagagtatatgggtatttattgctattctaattatttccacttttatgaggtttgaaagttttcaaagtagtgagttggyaggaagaaagaaaatgcccaaagagggagcctaccgaccttcctgggtcccctgtccttgtcagccaaccacgtaaagggaaagagctaggatttaatgaccggattccttcctgggctccaagcattttcacatcttgcttctcattgctccgtgagaagttgggcaggcctttctaaatgctccatgcttcagtttctccaaatctaaatccggaagatttgctccaggtcacacgcagaccaagtggaagtggagctgatgggagggacctagcctgtgggctccctgcttggaccctgggccctgcaccccgtcagctgctaggctcccctcttgggtctggtgtgttkgtttctgaagcctgttctcccaagtcccggaggtgtcagggatcccrgggccacccagcttagctgtgcctgcctccctctgcgctaaaggagccactgtgccagcctggaactcacggcatcccctttaggatgttggctccacagggattggctccttggcagatgcagtcgctcctgattggacagtggtgtctgcagctcgacaaggtggactctgggccagtcggctctgcctgtgtgtcttgcgtcctgaaatgcaaagcaggggctgtggggaaatctcaccaacccctcctcccctgggaggtggcaaaggtggtggactgggctgctgggaccctggggaggaatgaaacagaggctgtgttgatggcctgcagttccttgtaatgtggtcatcaaacggtgtacagttcccgtctgtggctgcaggctggagagctgactgctggcacagatacagcctgacctcgggtcaacacttctcggagtccagaggggtkgggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctcyagtgctctctctcctctggccttcagcaggctgggtcacagaggtatccatccactcattcattcactcaacaaatatctgttccatgtctactaggtgccaggcacagctgggaaccagcagacaaaactccctgctttcccggagccggcatcttggtgggcagacagcataagcgagacgagtaggtggaggagaaggcgtgtgagcaggtgacaggcgctggggagaaacagcccaggggagggaccagggagtgtgggggagacggggactgygatgaaagggaggcgtccagggaagacctccatgagaaggtgaccttggcataaagaggcaaacgtgggagcatgctcaggcagaccacggtggtcagaagttgaattcrggccggaggaggaggagtgcatgaagccctgaggtgggagtgagtctgtctgctgggttcacagaccccccagggagccagtgtggcaggggccagtgtgtgaggggctcagcgggggatgtggctagaaaggttgtggacccactgttgagattggactttggctctgaatggaatggaagccattggaaggtttggagtgaagcagtgacataatctgacttatgttctgggaggatcaccctggccgcgtagagtctgccggcgggggtggaggtgggcgcagggaatgctgtgaggagcagcatgagagccggtggcagctgggcaggagaggagacagggagaggcacggggcccctggcccagggatggattggatgtgggaggcgggacgtgggaggaagggaggagtcrgggtgactcccgggagtgggactgacacctgggagggtggggagctcgttactcatctggggccaccctgggaagaactgggctgggggtgagggcagtcgggagctcagtgtctgacccaggaatccgaggcacacgttccccaccctcatagctgagccacacaggcaggaaataaacagctctggggttcaggggagtggtagagggggtggggtctgcagcatggggacggggttcagagccacgagatgggtggaaatctgaggggctttgtggggatggaaaagaatatattcaagagctgagcaagggcagccactggaggacagcgatgagcaggaagaagcccaggagactgagaaggagtggctggagggatgagaggggagcgtggagtcctgggagctggggaagccgcaggcagcacctctgtcaccccgatacgatgggcaccgctggacctagcaacgaagaggtcaccgcaaccttggcaagtgcagtttccacggagtggtgagggcagaggctgattggagttggtttataagccggaagaagaagaggaatcgcagataagtgaaggaaaactttttgaggaattttctcaaatggaaggcragaaacagtggagaagaaagtgggtctaagaaactgcttttttaggccgagtgaggtggctcacatctgtaatcccagcatttagggaggccgaggcgggcggatcacttgaggccgggagttggagaccagcctggccaacatggtgaaactccgtctctactaaaaatacaaaacttagccaggcatggtggtgcaygtctgtaatcccagctatttgggaggctggggcatgagaatcgcttgaacccaggaggcggaggttgcagtgagctgagattgtgccactgtactccagcctgggtgacagagtgagactctgtctcaaaaaaagaaaaaagaaactgtgttttttgttttctttggagatgagagaaataataacttattgggtgcagctggcagtgcgtcctgaagaaggaggaatgggcttgggatgcccttgagtgggtgtggggctggggacagccaygtgaccatggacactgtggggccggttcactgggtagccacaggagggaaggcaggtggctttgagcacagatcgtgtcgctgtgtgtggaaggtggcttctgattgcttgtgttttctcaggggtctgggaagcagcagtggcagctgagggtggggtgggaagggaggagcagcgaggtgtcccctgaacctgggagagaggatgccgtagagcaggtgcccatagactctttctgtaaaggaccagatagtaaataatttaggctttgccagccagccagtctctgttgcagctcctcagccctgcccttggagcccagaagcagcctgagaggattcgtaaacaggcatggaggtgttctaatgaaactttatttacaaaaataggcagcaggctggctctggcctgcttagactcctggccctcaacctcgcctctaggccaggggtcttcaaagcatggtccctgggcctgcagcatcagcgttacctggaacttgtgggaaatgcagattcttggacccccaccctatgttcatggarccagtgactcagtccctgcactgttttccaacccaagttgagtttgtgattccggaattctggaagttagctcagcacctagacccaagagagagtgaagtgtggggtgggctacatgccctgttaaaggcacaggcatcccagcccccatccccttctgcaaggctgtgtgaggacatcctgcctcccgtgggccrtgtttgcttatgcagcatccatgggagggctccctgsggacgggctgtggtgatgactctgctctcagcagaaccctccactctgaagccctggtttcctgtccacgtccctcagctactcaggggagcctgggggcaggaactccattgcttgtaggggagcctcccacagcagcagggctcagccagtgttccatgcaagaagaaatgcactgtcctccgatcgaaagcacagcatctttaggagtttaacgacagttttttaacgactttagtgagatgatttgatttcctgcctctgagtcatctaagagcaaaatgcgtgagctgctaatgggctcaaagagaggctgcctttgaggcccctccagccccccagtgctgcagggattcaatcaccccaaagccaggtaaccagccttggcctcccaaagttctgggattacaggcatgatccatcgtgcctggcctgaatgagggtcttttttttttttttttttttgaggcggggtctcgctctgtcacccaggctggagtgcagtggcgcgaactcggctcactgcaagctccgtctcccgggttcacgccattctcctgcctcaccctcccaagtagctgggactacaggcgcccgccatcacacccagctaattttttttgtattttttagtagagacggggtttcactgtgttagccaggatggtctcgatctcctgacctcgtgatccacccacctcagcctcccaaagttctgggattacaggtgtgatccaccatgcctggcccaaatgagggtctttaagaataaaactccrggggatcgtcaccaagccccaccacttcctctgaggttagcatagtgctggatcttctctgcatcttctgtccttgtttttggttttcattttggtttacttgaaacaggatcttgctccatcacccaggctggagtgcagtgacacgatcatagcactctgcagcctcaatctcccaggctcaagcaatcctcccacctcagcctcccgagtagctgggattacagacatgcatcaccacgcccagctaatttttttattttttaatttttttgtagagactgggtctctacaaaacaaatgtctctgtgttgcccaggctggtctcaaactcctgtgctcaagcaatcctcctgcctcggcctcccgaagtgctggtattccaggctggtcccattttaccagcaggtctacacatgtgctcacatcgctcactcagaggagacctccgttattagggggacctagacctgtgctgccttgaccccagggacagaggttgtttgggaatcccctcccttactttgatttcttccgaggaagccggcttcctggtgacgggaggtcactgttctggggaaaaagagtgggaaaaacaaagccaatcagccacttggctaagtgtcaggtttcccaacaacttcatgggttgctgtggatgggcggggctgttttgagcccagaccatccctttgcctgtgggtgtgggaccacgtgattttggatcaggggtcatttgtccttccagaagccaagccctgttccaggcatgggggtgcagcagtgagtgagacccacagaaccactgccctcctggaacacaccccccccagagagggaactggggcaccacagacccgtgtgcaggcagcaagggcgtggtgtcggccggggagcagcagggacccctgagccccacagtcggggctcatggcgctgagaagcactgcagcaagggcgcagccagtaggagaggagcygcaagcgcaagcatccgcagacagtgtgagctcagcgtgctgggaaggcgggggcctgggtcaagggccaggcggcagagcataggggcctgrgggggcagtgcctaggagtgggaggaaagagcatgggaccagattcactttggaaatagaagcccccaaccagcagccagccaggtggaggaaggcrtgcagagctgagagggttcaggaggcggtggggggagccactgggaggggacccaggggttcaggtgaaagacagcagtggctcagcccaagggtggcagccagagatgtgggtggacggctggatattggcagccatactcattatcaatgctgctgtaacagytcatcacaaaccctgcagcttccaactgcccagagtgagatctcctggttcttgtgggtcaggcattggggcagagcagggctgggtctgctgttttgggacccctgagctgcagtcgaggttcttgccgggactgggctcaccttggaaacctctggtaggaaaggatccacttccaggctccctcgttcgtttgaaggactcctttctttgggctgttgggctgagggctcagcttctcgccagctgtcggcccgaggctgccctcagttcctgccccargggcctctccaacaccacagcttgcttcatcagagccaggagggacagtctctagcaagacagaagtgacagtcttgccattacctttgccgtgttctgctggttagaagcgacttgctaggtgcagcccacactccaggacaggggctgcccaagggcaggaatcccaggagctgcggacatcagtggcatctgagaagctgcctgacttaggagctcaatggmagcaccaggaagctgcactgggctggagtcagggcaagggacagtgtcagcgatgaccctgggggacagcagtgcagtcaggagctcagaaagtacacagatgccccctgggcggtctcttctgcaccatgtgggcagcagaaactacacctayggtttcagaacaacagttggggtggtgtggaaggacctccacgacatatarggtgggagtgtggagtgatggagtgtggaaacccttctcacagttgtcacctgctctccagcccctcctgagcccrtggacctgcctgcctgccgtgtgtctgtctgtcgtctgtctgtctgtctctctgctgaggggctccccratgccctgaacccagacagcctcctcagcctttgtgatcccagagtctcccggccaaacctggttgatcttttttaaccaccaccctcttcccctcccttattttgcttttcttccagaattttcccactgtaaaaaaccgagcaagtctggataagtgaggctggctccatgtatccagaatcaacgacgggctccccggctcggctctcgctgcggcagacgggctcccccgggatgatctacaggtgaccccctgccccctcayccaggccccctcccagggtcagtcctgcttcgaggacgggttcccaaggccactgtcctcccctctggaggtggaagggcccaagcagggcccacaggcttctgccttccacggggttttgaggtgcacgctggtgagcgttttctccaagaaaggagcaggggctttaaaaacccaagtgggaaagaaaaaccaaaacttttccagggcgtttgagccagagtagactcctttcttgtccctgacccttccgaaatatctcgtttgaggttaacagagcggccggacagtgagtgcacggccaaccccggcatcctgttcctcccactttatacatcgcagcccctgtggccctgccagtttctcctgagcgaggatgacraccttgcaggcctttggggaaccacgtctgccggtttcccaacactggagggagtgggggcggccaaatgctcctggggcatcctgaccccctccttgtggaactcacttccgcttgcagccctgggtgtttctgtctgcaccataaacagcgctgaacatcagcgacagctgcggagggcgttcagtgagagctgagcctctggggacagagcatagaacccacgaaagacgcaggcacaggcagtaccccagcagcccatcagtcttgggaagccagacctttccggataatcactggggcctgagccagagcccgtgtctgtgacagccacagggaaaggcagtgtctgtcctaagaagagccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggccygggggcatgggacattggtggttctttctgacctgcacctgctkgggttgatgccaactgtggactctctctcttctctccctttctcctttttctcttttctccattgctgtccgaagtactcggtatgggagtcccaaaagacagctccagttttacaggtaatgagtcttcattctccctaaaacccagcgagccgaaggccagggagcgggtgggaggactgcacccttgccgagcagggtgtgctggtgtattctctgaagccaaagcccccgagacccccaggctctgctcatcaccctctgtgcctacccacaggatgctgtgcaatgtcctgatggaaaatgtgaagtcaggttaattgtatgtgttggtctgccagaagtttgctttgatttgagcaaatgggcttttgatgactgccaagctctcagccaaatctaccgttaaagcttcactcatcaggcagtgagggagatgtcttcctgtggtcaccagcttgccctgcttccattatcagagtacaggacgtggcgagcccatccgttccccctttgcctgtgggtttgacctgatctggaactcacagagctcctcaggctcattgaaggttaatgcctgcttgggggtgtgcagtactgataygacgtggatcagtgacatctttctgatatgtttttctgttggtgaattaacaaaccgggcacctggcgagagactgtgccccagcaggatgtgacatcaagatgccaggcttagggccctgcagggtgctcttggggagacccgttcctctctctgggctgcctctccctcacctgtaaggyaggggatgcatgttcttggtgcagcctccaaccctaggaagtaaaatgtcagggctgcctggagcccatgggcagcagcctccccatgccttgggactgtttggggaattggcacggcttctggcagcaggtccctggtatgcattgctgcatcttggcggtcaggccgggaggtctctctattcggacccggacatctggtaacagtgctttggggatcgttgccaatgtgccaggcagtggtcatggaggtggcaatgtatttccatgtagcttttctctccccgcgcccccactccccacccccccccccgtttgccagccatagcacctctgatggggaccgtggacctagatgctcagagtgatctgtgccacgccttcagtgcctcctcggaggtcctgctccttacagggagctctgaagacatggccaactcttagawcctactgaaattttggtagataagattttgcttaagatagttaaatctgaactccggcttgcaaatgctttccctggatgaaatgtttgtattgtgatgtatgtacacatggtataacagatcctaacaaacatatgccgctcatcccaggggatttcatcagtgaaacaaaacatgtacctgaactgcatcctcagagagccgggagcagcctcagtcctcagaagggaaggggtgaggtctgatgagcagrcaggaaaatcccaggtgcagacctgccagctcaaaagggctgcccacaggtacagaccatccagctccaagggcctgcccctaggaggggccaagtaaattatccagtgaccaagtgagagccttccagcccactcaaggccctcaaaaccccacaggctcaacatgttgtcccccccgccgggatccctgtgcttaagaaccttcatttccaggtggccttcctggccccaagggaagctctgaagcttaccctctaggctctcagccccaattctggtgcccacaggctctggccatcctacccgttggatctccagggggtcacttgggtgtctcttgtgggggctctggagatgacctctaagggctagggtctttgtttgttaacaggctgggggccactcctagtagggcaccctcatcacaccaagcataccactaaacatggctattggatggttctttcagttacttaggcctggccctctcacagggcagaggcgttcaaggcatgtgccctgcccccatgcagctcccaggcaaggaattggcataggacactgtgccaatcagctgtccaccaagtgctgcataacaaacaactccaaaactcagygccacgcagcaatcagcatctcttccttgctcccgtgtctgcgggttgaccaggcagctcgtctaagctggcttggctgggttygtctccaagctgcaagttggatccccrtgtcctccatcttcccatgcttaactggggcctaycccaggcatgtccttcccatggcaaaagtaccagaggaaaagcagaaacatgcagggtctcttacggcctatggttggggtcagagcgctgtcacctctgctcacgtgcttttggccaaagtaagtctcaggaaccagcccacagtcaaggggctggaaatatatygcccccaccagtgggaggagctataaagtcacatggcaaagggcatgggtacagagaggggtgaaggattgggagcaatacttccatgtaccccaggtctcaaatagccctgatgatctccagaaggcagagcacgtcacaggagaagcccaaagagcatttggggtccaaggaaggaggggccacagccagctgagagccaagaagacttcacggagaaggcagcaggggcttggatctggtccttgaaggctgggcaggattcaacgcagaggctgggaagcatattccagtagatacaacagcctgagccacagctcagaggtgtgcacagagaacaggaagtgacagttacccagcctgggccatcagggacatgatggagaataaagagaggctggctgtagaggtggatgttggtggggggcctcgaatgcctagcgatggggcacagatgcactcagagggcactggggagccatctrtggtgtttgagcagggcaggggtcagagatctgctctaggaaggaagcctggtagcagggagtaagacagggaagagagaggctaatgcaaggagaccagacagtgcccaggaaaggtgcaggacggctgagctccaggaactgcacagagagagaatgaaggggtgcagggcctgaaaaaaggacgtcagaagccacgtccacagggcttggccactgatgggcaggtgctgagacagaaagggacagagaggagcagtggacccagggaaggagagggcctcattcggagcatgttaggctgcagctaccacccagtagtgaggcgcaggccccccgaccagggcgacatgtggggatctgacagagtgggcttgggcctttggggacaaaycatttcaattgccaaggccttcgcagctagtcacccgcagccagrcacctccagactctacgtgctctcccagcctcccacttcatttaccttccacactgcgactggggcactgatttcctgtcccccaccttcccccatggcagctaccactgtttgctcattcatcatggggggacggttctgcctccattcaaaatcccacattcactggcgcgctttctcagccggaagatgatgtcacgctgggactttgctggcatcctgtgacacgcagtgaccctgggggtcatgaccctggggttggggctcagcacttagcctcatcccagagctcagccttgtttggcctagtctcaaagcatttcccaaaccccaggtcaggacatgtgccgtggagaagggctcctgtgtccctgcctggagtgagtggcagtgtggagtccaaatagcaggttctggggccttcctgccatttatagctaccggtagtatcagatatacccatctcgggtgtatccccagaggacaggaggagcatgcgcgtgtgctgagcagaggcctctccagacccccttggctgtgggtggtggccccatacgacggggcccccagctcccctgctgcagacacagttcagagttgagtggtatgcggaagccacaggctctgtgtcccgcactcagataccaaagagcaaggcctgcccctttcgacctgtgggtccaaaggtttgtgtttctggcacgcggggatggtggaggcagcaagggtaggcctgagggacgggcaggacctccccctcaccttgggctgcaccccaaccccacgcaccgggagtcagccttgccaggttgcagcacggaactgcacttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcaggtgagtcctcccttcagccgctaccttcctagtggagatgccgcttgggggcacgcatccgcgggaatgaaaaataacagaggagaccatattttggggtggttttgtctgatccggaattagaccctccgtgtttttgcaaagcagaagaccttaaaaaagagccagcctgaggtaaacttggaatgaccgtgatggatggggtggtgggsggcaggtttcagccgggcagcacctctcgcttgagtctgctcacagcccagacctgcccaaggctgactgttttcccatctgccggagacacgggcgtctagctcgtacctcgctgtgttcaccattgattaagattcagcattttccagttttgcccagagcgctgtcagggaggtttggtcttgtctgaaatgtctgtgcaggaagcacgtgctgagggagccaggggctgcttgtttgggcctcagtttgctgattgtccttgagcgaaaatcattctgtgtttgcactgaagcaatgccgtgtcttgtagagccgcaccccggaatggtagcagctccccttccatttccgctttggagaactctggctgggctctctgctctctggacaggtgtcaccattcagaagagatgctcagggttccttctcaatctcaggttgtatgctttgttggctttcagtaaacagaacaattcagaaattccaggtagaggagtctggggtgaggtagtgattcctactgacttaatgaggttaacatcttccttgcatttttccatgtcacggtgttaattcacgtgaattcccctgggcccctgatctacaggaatagatttgcaccaggcaggcccagcccaggaaagaacttgtgggttccacgtaattagcaatggctrttgaggaggggctcgtttttcttggtaccagggtggtgagggagtgtcagggctcagagaccctcactctggaaagcggccgggatttgggatattttgaattggaagtcaggggtcactgtgctcttgagcacaggagaagtggggaccctgaggcaggagcccggcagtggggccactctctcctccctgcagtgtcttaccggggggcccttcgtccaaggacctgacgctgctagagtctcggcaaaagcccagaatagagccccagtgtgagggagtccagaggtgtcctctgtccccaggcaccgctggtaacgggcagagcctctttgccttctgcctgtacctatccttcttcccctggggcagccctcccagagtcatgagccttcaggaccacagggagcccccgctgtacagagtcctggcatgggagtcccccccacacaagagagggtgacctgcaaagagctgctgggtctgaggtaggaagccagccccgcccccaccaacagctgcctggcactgccaggaaatgcccaggtatagccctggttggccttttggagcctgggccttggttactgttctacaaatatctgagcccctcctctgtgcacgggacactcccgtgggcactggtcagggggcagtggcagcaggcagaagagtccttgccctcctggacccaaccttcaggggagtccagcggccatgggctcctcatggcaccagccctgctcctcaccccaccaccccatgccaaaggctgccatttctgtgcccgcaagttccctggcccaagccctgccctggcaccatggggacaagctcgtagcaagaggctctgggctccctccgtgccgcagggctcccacctgcaggtctgctcccagggctgcaacatgagctctaaggaaagattgcaagcgggcccccacagggagggacgccctctaaatcctggccacaaaacccattctgtcctgccctctctcccctctcccactcacatccccaaactcrgccttccaccatcttgttgtgaagggggcgattattcacatctgtgttctcttcccttaagcattttctagggagatttggtgtctgtgtggctcactcctctcactcaaacctgtggtcacaagttccttcccgccctgcctgctggcccctggtggtggatttttctttccacagcatttatcataattggtgtcttatcccacgccccmcaacagactgtcttctggctgcgtcaccaactcccacccagttgtccaaagcctcatctcatgcagcccacagcagcctggtacaacaggcctctgcccagcctacctcacagatgtggaggctgaggccgggagcggtcaaggtgcctgcctgggccacaccatgagcaggtgacaagcagagctgcccctgtccagaagctgggcactcagccaccccgtcctccagccccggggccttggctatatttctagagccaaaccagacccggattgctttttgtgagtaatgtcttgaaagctaatggctattgatctcagcctggtcgggccaggcagggaacttgcgtgtctgaggctggtcctgcctttcagaaagagccctggggctacagcctgcccagctggccttctttctaaacacagacctcagggaagtgagggttggcccccatttgccccacaccggactggcagctagccacrtggccacctcagaagcagctgcctgccacgcgcatggagggaagggagtggccggccagtaggcagggaagggaagctggtgctgctgtctgtgggtgccaagggcctcatttcctaaggtgaacctctcctggagtccgggcctctctgccctccagagcgattctcctggaaggcagacggctttccatgccagggtacccgcctgctttagcgtccagaggtccagcagccaccacccctcccagcatagaaatgagcagtggtgaatgcaactcctggcatgggaaccccccagcaagagaggacgacctgcaaagagccactgggcctgaggcaggaagccagccccgcccccaccaacagctgcctggcactgccaggaaatgcccaggtatagccctggttggccttttggagcctgggccttggttgctgttctacaagtatctgagtccctcctctgtacacgaggggcactcccatgggcactgagcagggggcagtggcagtggcaggaggcagaagggtccctgccctcctggactcaaccttcaggrgagtgaattcagcacacaggacagctagaaaggaatcagcaaggtggatgatggcgagcgccatggagacagatcacagcaggaaagaggcacatggtgtggtttgtgtgggacagagggtaggatgggaaacgcagcccccccacccccgggagccatgcccatcagacagaggtgcagaggtgcagacagcacagcaggctccccaaggacgactggttgctcgcctttagggagggggccatccagccctgaccagggtggtggggccaaggcctgtgtggacactgctacccagctccctgtaggggctcctcgggggctccttgcctgctggtctctctttagctcttctctgagcccaccttccctacctcaattgcatgttcatgcaacaggcatttgtaggctctgctctgagctaggcctcatgctgggcacaacagggcagacatgaatgaaggtccctgcaaataagatacagacgaatacttgcagggaaacccccatgaaagaggcagctgtggggctcctggaggtggcccccctctctgggtgcacatataggcagagcagtgaaaggtcagcaggctggtcacccattctggaaggaccccagcacatggggctcatcacaaactcctgccccttgtgggtctttcctttggcccctggagctcaccccaggaaaggcccagcctggggcaactccaggacatctcaacccccttcaaggaccgtgctaaagcctctgtagctgcctcagctcccaggatagccctcccagctccttcccagggataatcgaacttttcctctcttggggcagaaggtggggacagtgctggttcctttccagctcccaggccaggttccaggatcccactgtgcagctgacccagctgaaatggtgacttcccctctgcaccttctctctctggtgatgatgcagagctgcagtgcaggccacctgggccatggccgaggctgcagtcaggtggggtgagggtcactggactggggacctcctttgtgttgagcctgcctccatgtcctcattgcgctgtcacagactctgcagggtgaggactcagccccgaggctgccctcactggtccactcactgttgtgcacatgaattaacaccagtggttgcgttctggacacacgctttctcccttggccttttaattgtccactatctctcagggctcactcactcactatgttgagatgcctcattcttgacagcagcacaaattcccactatgtggatggactgtcacttaggtaaccagtttccctactgatggacatttacattgcttttagtttccaagaatgtgcattcatcatttcagctatwtttcagtggttcttcacatagaaactttgaaactcccctgtcccaactaagcctatttccccaggccactctcctccgcaacctgcttaaatgcattctgctcagtttttcttttgcaaaaagcatgaagcccaaagatctctgcggtgcaatgatgcgttcaacaagcagggaatgtgttgtatagatagcatttccctttacaaggctaagagcaaataggaccttcccatgttggggccacctggcatgcgggggtgaggtgcctccctggcataattacaggagagtttacttcagcaacaggtgtgccctgcgctgctttcccagggacagcttttgacccagttttaccctgggaaccacctcaagagaccaccatgacatggtaccgcagtcaccacggaacagcaaccctggtcttcagcatttggggggctcaggctctgcatgctctctgtgctcccgttttcatttggacacttggggtgcagctgtcctgcctggaatgcagctttgcctgtgcttgtctcacagatgcaggggrcagaaaagggcagcttagccagagttcctggcaagcactgctttgcggactgagaatctcatgccaagaggtgtttacatccaggggccgggtcccactcctagacaccaagacctggtggtggcactagttaaaggatgtttcgctgcagctgccccctgccccagggccagccatccagcctggggcacgtggggcattggcacactgtctaactcatcaccgtctggacagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccrcatgcacggcctttccctggacggctgcaccgcccagcgcacaggcatgaagtatcggtaagggccgggcaggggggcggtggggtgggaagtctgatttcagccatataaatatgtataaaagggctgggcacggtggttcacacctgtaatcccagcacttggggaggcagaggcgggtggatcacctgagatcaggagctcgagaccagcctggccaacctggtgaaacaccacctactaaaaatacaaaaaatagccaggcatagtggggcgcacctgtagtcccaactactcaggaggctgaggcagaagaattgcttgaactcaggaggcagagattgcagtgatccaagatcataccactgcactccagcctgggcgacaagagtgagacactgtctcaacaacaacaacaaaaatgtataaaggaagaaaatgaggccaggcacggtggctcatgcctgtaataccagcactttgggaggccgaggtgggtggattgcttgagcccagaagtctgagaccagcctaggcaacatggcaaaaccccatctctaccccaaaatacaaagaaattaggtaggcatggtgccatgcacctgtagtcccagctacttgggaggctgaggtgggaggattacctgagcccaaagaatctgatgctgcagtgagccgtgatcgcaccactgcactccaggctgggtgacagagcgagactccattgcgcaaaaaaaaaaaaaaagtttagtaaattctccatggggtaaaaatgtgtgggtgtgtttctccatggggaaaaatgtgtttctgggtgttggagacccctgctcttaatgataggcacgtaggtctgaattttcttggaacctccaaaggacattctttttagtgcgcttgtctttgaattcagcacctcggacagcgctctgctagccaccgttctctggctggtgtaaatccctctcaattgcaaattgacagctttatcttctgtgcctctcaggaacatgcccttgtgagagccattcagccaaagaggaccctccccacccagtccttgtagagttgccagttaaatttgaagttcagataaacgcgtaactttttagcataaatacgttccatgcaatatttgggtcatacttatactaaaaagttcctcattgtttatctgaacttcaaatttaactgggcgtcctgtgttttatctggcaacactaaatatctggcttccgtctgagacagaccctagggatcatctgcgtgctctgtgcagagtggagtgcaggccaggaccgctcctttaacgttttctcctgtggacggcgtgtttggtccttcagcccattgtttgaatatgtggttgtaatttagaaacaaaacacttctcctgtgagtccattagatggcagtgtttttcaggctttgtatcctaaatccagctgtaaaggaaggacaaagggtccgctagtttggccacagctgacctccttgttctgctggaaatttctcaagaaggagacgctgggcattcatgaggggctggtcattgattccttttgtttattcagtaaatgtttattgagagtctgcttggcaccaggcgctgagccagatcctggagctgctgcatgaacaagagcaaccaggtccccaacctcacggcagccatggcctgggggtgtggggggcagagaagcagcgagcttgcacggagacaagttccaacagcgaccactggccgaggcagcaaagcaggacaatgcaatgaagaaagaccagggaggccragggggaaccctctgagagagggatcatctgaagatgtggagaacattccagcccaagaggagaggggtctggaatggatgcctctctcagctggaggagcgaagagaaggcccaggcggctaggctggagggaggaaggtggaggacacaaggcgatgatgcaggaggggccagaccccatcctccaaactcagggaaacctcagctctctcctatgtggacaggatttgtgatggaggatagtttagtgggttaaatcaagaccccccaaaattcacattcatcctaaacctcagaatatgacgttaggctgggtgtggtggctcacgcccgtagtctcagcactttaggaggcagcctgggtaacatggcgaaaccccatctctaaatacaatcaaaaaattagccaggcatggtgacacatgcctgtggtcccagctacacaggcggctgatgcaggaggatcacttgaacccaggatttcaacgctgcagtgagccctatttgtgccactgcactccagcctgggcggcagagtgagaccctgtcttaaaaaaaaaaaaaraagaagaagaagaagaatgtgacattatttggaaatagggtcattgcagatatcattaagatggggcaatggggccatacaagactagaatggaccctaattcctacgactggtgtccttataagaaggccatgtggtgatagagagtggagtgacgggtccacaacccaagggactctgaggagtctcggtgttaccggtggagggtgtgcagccaggttcctggcatcttgaacaaagaattggacaaaacgcacatacaaagcaaggaaagaatgaagcaacaaaagcagccgggtgaggtggctcacgcctgtaatcccaacagtttgggaggccaagacgggtgggttacatgaggccaggagttcgagagcagcctgggcaacatggcaaaagcctgtctctactaaaaatacaaaaattaaccagtcgtggtggcgggcacctgtagtcccagctattcgggaggctgaggcaggagaatcacttgaacctgggaggyggaggttgcagtgagccaagatggaacaaaagtacactccacaggatgggagtgggcaagcggctcaagaacctggatacagaattttctggggtttaaataccttctagaggtttcccattggttacctggtgtacatcttatgtaaatgaagtagtggcctgtgatcattctgattggttgcagaaagtgaccaattagaggctgaaatgaagttacaaagttacacttctatgcaaatgaagacttggcccacagccagcctgattggttgcgggaggggacaaatcagaggtattttccatttttcgtctgccacacagaaaagggggcgccatgcaaagagagtagcctctggttcttttgttacttgggcgtggaaagttggggttttccttttgacttagttataggaaatcagcgggaattggccttcagttccctgcctccagaccctggtctcctgccccaacaggagccacgagatgctggaagggacaggaaaggacacctcatgagggtgtttggagggaacactgcccacacctggacttcagactccagaagtgggagagaagacattcctgttgttgtaagtcctctaatttggggatctttgtaatggcagccgcagggaactaacacaggtggagagaacatatcttttatttgcctgaagccccgaggaaaatgcctgagcagcctcggagacactgcaggtcccactgtggggctgaaacgcccttggggatctcgcttctcagggagtggaggagaccagaagacaaacgcttttttttttttttttttttgagttggagtttcgctgtatcgcccaggctacagtgcagtggcacagtctcggctcactacaacctctgcctcccaggttcaagcgattctcctgcctcagcctcccaagtagctgggactgcagggatgcaccaccatgcctgactaatttttgtatttttggtagagacagagttttgtcatgttgaccacgctggtctcaaactcctgacctcaggtgatctgcccaccttggcatcccaaagtgctgggattacaggcatgagccatctcaccccaccaacaaagtccctttagcagttgatgggccagaggttgttgttacacccaggtcagggtgaaggtggggcggggagggtggtggcctcactctatctggtgaatttcattttgctgcaccagggytgacggggtgggtgggatgctccgtgactcagaccaccagttattaaagatcccagataaatttattctgtgcttacctcttctccgtcagcgactgggctgggtcaccattaaacttggtcttaaatatgaatatagaaaagatgatacctggggataggcactgcccggtgccgcaagaaaccagctgtgcccctggcctgggcatttcatcagctgaactgagctgtagctgatggaggtggacggcagcatgcctgttacacttccccagtttttttttgagacagagtctcactctgtcacccaggctggagtgcagtggtgcaatctcagctcactgcaacctctgcctcctgggttcaagcgattctcctgcctcagcctcccgagtagctgggactacaggcgcgagccaccatgcccggctattttttgtatttttagtagaaacggggtttcaccacgttggccaggctgatctcaaactcctgacctcaagtgacccactcgcctcggcctcccaaagtgctgggattacaggcgtgagccaccgcgcccggcctacacttccccattgtttaaactgtcctcaattattgctgttaaaaagaattttaagatgaatttttaaatccacacagcccctgtgtaagcatgagggagcagggtgagggcagctggcctagcacacacttcccctcccctgtggacgttagggttcagagatgtggcctcagaatggcaggccagaagctgtggccgggcccacactgtgctgactggacaccagccctcagttcagctgtgttttcctctgctccccatggtgctgggagtgaacccaaactccccgcaaggctctacgtggccctagcctgcctccttggtttcaactcggacccctctccctcccgctcaggaggctctggacgccgccccttccttctgtatccccaaaggggaactcattccatccacagggtcatcgcactttctgttccctcttcctggaggctgcctccccagacgtggcctggttccttcccattgtcacatctaagcttggtccccaaagagactgtcccaagcacccactctaaacaagcacctatgaagtcatcagaagcccctctcctgagtgagtgtcttcctcacccctcctccatctcggttgccttgctctttgcccatctgcactgctttgagatcagagctttgtctgtccctggcacccggaacacccccagcctctgtgagtttaggtcggaaggcgctgcgtggtcttggtcttaatctactttccaaagcacatgtctcgttcgggctgcrtcctagatggtgggaagacaggactgactggaagctggtctgaggctctctctgcagtccagatgtggatggcagggagcctctgcggtccttgggcactgacccttggtcatgaactcctggcagggcaggagtcctgatttcctgtgctttctgactctagatcccaggctcttaccacaagctcaggttcaccaggaagtacttggttggttgccaggttcattgagcagactgtagttgctcagttaaccataggccatcacttccagctgggaagagctgggaatccaggtgtgtcttaaaggacaggcgggaaggagggcactgagggcaggaggaggggaaggagaaaaacagcagagaccaggggggatggcaagttaacctgtctacaaggccaagtgcatcctgggaaagaggggtccccaaggaacggggtccatcttgggaaagatcctgttttactttcctgaggctgctgtaacaagctgggtggtttacaacagaagctttttctttcccagttctgggaggtgaaagtccaacggccaggtgcagccgggccatacttcctccgaaggccccagggagggtcctttttgcctcccccagtttctggtggtgccggcaggcctgggcattcctcagcttgtggccacatcgctccaacctctgcctctgccgtcccatggccattttctctctgtgggcctctgtctccaaatctctctctccttataagaacaccagtcatggccaggcacagtggctcatgcttataatcccagcatcttgggaggctgaggcaagtggatcacttgagtccaggggttcaagaccagcctgagcaatgtggcaaaactctgtctctacaaaaaatgcaaaaaatggccaggcatggtggcaagtgcctatgatcccagctattcctgaggctgaagtgaggatcactgagcccaggaggcagagtctgcagtgagccgagatcgaaccactggcactccagcctgggtgacagaacaagaccctgcctcaaaaacaaaaagcaaaaaacaaaaacccagtcattggattgaaggctgaccctaatccaggaccatcgcatcttaacttgattacatttgcaaagaccttgtttccaaataaagtcacactcacaggtatcaggaattaggatctcaactgtcttttggggacacatttcgacctgccacaggccccaaggattgactcaacaccttgagcctgcggggacatccctgagtgtcctgggaggaacccgggctcccaccggctacctgtgtgacctcagacaagtcccctggcctctccatgactcgatttccttacccggaaagtggagaccggggtcactacagcagaattgtcctgaggactaaataagctccaggtgacataactcaaagctccaggcttggctcattgtgggagagaaatgcaggcccttcccgtccctggaaaagggaccttcccacacagcagtcgctgtccaggcacytggactgtcccctgtctatccatcttggggtctcactcgtgcacctagtctcacttagagatgtagttcagtgccgcgcagacaaggggcggaggcatcaggaaggaacaggaggagggagggaggcgagcagccagtcattccggaagagctgccgggccagacgcaggggctgggagaaagccagctggcaggcccagtgctctccttgagggcctgcccaggaccacggctggcagctgtgtggggcytgggtcggggctgggagggcttctgctggcagcgggcaccacattggagcctcggtggtcatggtcatcccaggcctggaaacagcatccgtctgcagccccagcctctccagccccagcttccctaaagggacagaacagcccttccctcccccacagggctgctgcaggagaggtgggaggaaaggcagagagacccagactcctgcactgggtggttgccttgtaaccgactgatgatgtgctaggtgtttctggagctgacctggccacaggaatcacgggccatacctgtttttcctgttttttgttgttttttgtgttgagacagcgccttgctctgtcgcccaggctggagtgcagtggtgcaatcatagctcactgcagcctcagcctcctgggctcaagtaatcctccagcctcagcctccctagtagctgggaccacaggtgcgcaccaccacacctggctaatttttgtgctttttgtagagatgagtctcactaggttccccaggctagctgggaacccctgggctcaagcgatccacccaccttggcctcccaaagtgctgagattataggcatgagccactgtgcccagccacacctgttacactaccgatccccaggccccttcctggaggtttggggcatcttcccctggaggctcttcggacaagcaaggagagggagcaccacccatgtgctggcgccgtggtcattgttgttggtcttgttacgtctcaaagggtgcttctgaggacagaaggaggaagagaaagagaggtgctcgcttggggctggagagttgcatgggaaacagcagcaactcagagcagagccggccatctcacagccrcgggcctctctcccctttctgggctcctagagttggaagtgagtggggccatgaggtcctggtgagcaagaggaaggaggaggaactggctttgcagaccgtgcaaagccggttcccgggaagcacacacatggcctgcaggaggccttgtcctagcatcacctgcagcttcaagcacagtccactcagcccaaccacagaatgggccccgccagtgggatgtgcgctctgggcaaggctcacatgtcctgtcatcggtcctgtggcctcctccttccctcggcctcccactgtccctccgtgtcaagtctcccaccatctgatgcgccctctggcaaggccagtgagtcaccctactccagacacagaacctgctgctgcctcacaggctcccgccatctgccctcctgcctctgctctcaggagaaggacactcctggaattccacatggatcccaccttctccctggagccctgccatactcctgggcaccgctgatgygctctcctgctggctgacttggccttgaacacgggtggctcaggcctttcccagggacccttgcttcatgccccagctggaggaagccacactcacagcacttagcccctatggggtcttcagctcttactctcctggtggactcctcctccaggaaggccaccggccctgcctccctttgttcttagaaactgctcctttggggcagcccctcaactgttcaacatcctctgcccttccttgggcaagaagccacctttgggtgtaaaccacactccgttcagcacggacaaggcggtctctgcaggatgcagaccctcagtctcactctcggaggagctgctggaggctgtgcttttaaaagccatgtcaggccaagcgtggtggctcacgcctgcaatcccattactttgggaggcccaggcaggtggcggatcacaaggtcaagagatcgagaccatcctagccaacatgctgaaaccccgtctctactaaaaatacaaaaattagctgggcatggtggcacgtgcctgtagtctcagctactcaggtggctgaggcaggagaattgcttgaacccaggaggtggaggttgcagtgagccaaggtcgcaccactgcactccagcctggcaacagagcaagactccgtctcaaaaaaaaaaaaaaaaaaaaagccatatctaaaaccttctccagaccttgagccctccacaggcctcgttctgtgcatgagagggcatccgcccccttccactgcgagcctgttgccattgtaggggaggagctggccggccccagctttccagcctctccaggcccaagggggaggagtggaccccaggcactgagccggaagcctccgctacagcagggatgctgtctgtggtgcactccagggacacagagcagagcttttaatgggggtggctgctctccagtgaatcacagcaagagctagctgcttcatcttatcaacagcaggtaccggagagacagaaaaagaaccagaaatgggttgtaggttgaagtcaaccagccacgctccatgcctctgaccaaagcctaccagcactgggccgggcggtggctcacgcctgtaaccccagcaccgggccgggcgggggctcacgcctgtcatcccagcaccgggccgggcgtgtccccacacatgaatgttccaggcttcccttgtctggacgatgtgatcagggagacaccatcccagattctggctggtaacagagcaggcctcctcaaccctggyaccattgacacttgggctggacaattctctgtcatggggcagcatccgtggcctctgcctactgccagtagcacctcctgcccagttgggacaaccaaaaatgcctccctatgctgcccagtgttccctggggaacaaaacccctcccaggtaacatgcactgatacagagtaatcatctctgccaccaattttcacagattataacggaatataatgtgcataatgcaaaaattatattgaattctttttaaaattaccctccaccccaccttattccaaaaaggattgtaggtgacgttgttaaattaatctgctaccatgaaatttttaaaataaataatagcaaatatggggaaaatggaaaataagggtaggtcagtaaaataagtcggtggtaaaaataaaataccaaattcacccactagatgaccaggcagtgactggtgagggctgtgtgttttatacagactttccggcaaagaataaacccactgattgcttagaagtccagtgtcagccaagcgcggtggctcacgcctgtaatcccagcattttagaagcccaaggcaggcggatcgcctgaggtcgggagttcaagaccagcctgaccaacatggagaaactctgtctctactaaaaatacaaaaaattagccgagcgcggtggcacatgcctgtaatcccagctactcgggaggctgaggtaggagaatcacttgaacccgggaggtggaggttgcagtgagccaagattgcaccattgctctccagcctgggcaacaagaaaaaaaaaaagaagtccaaaaaaaaaaagtccagtgtctctaaaatttctaccttgggttctcaaaaaagaacacaatgtgagctaggaaacgccattcccccagtaagtgggcatttgtctagcagctgtttgtgtcccttagtatcatatcataaggaacataaattagtctttcctgggtccattgatccaatatttattgaaggcttttgggcacgtgacatggtgctggacggtggagacaccaagatgaccacatgcaaactgctccccaccccctggtgtccctgggaagaacatggtcagtggcgctcggagaagggaggggttacttgtgctgggggcctagcttcatagcgcacacacactgtctgagctgatgtcacaagtgactccgagttcaaaggcagagaaacaggaaaggcacttccacagggaacagcaggaatagaagcccagagggttttcaggcaggtgacttttttgggggagatgggaacagctttattgaaatataattcacgtgccatacaattcatttaatgcaattatatggaattaagtgcaattcagcagttttcatgtattcagagctgtgcaaacattgccacaattttaggatatgttcatcaaccccagaaagaagccccatacccttcaactctcactccccattcccaccccctgcaaccaccaagctttctgtctctacggattcgcctatttggattttttttttttttttgagacggaatctcactgtcgcccaggctagagtgcagtagcgcaacctcggcttactgcagcctccaggtgcaagcgattctcctgcctcagcctcccgagtagctgggattacaggcgcccaccaccacacctggctaattttttatttttatttttaatagagacggggtttcgccatgttggccaggctggtctcaaactcctgacctcacgatccacctgcctcagcctcccaaagttctgggattacaagtgtgagccaccgtggatatttcatatgaatggaatcatacgtgttctttcatgaccgtctttaacttagcatcatgttttcaaggttcatctgtgcctgtgccagtaattttttttttttttttttgagacagagtcttgccctgtcacccaggctggagtgcagtggcatgatctcagctcactgcaacctccacctcccgagttcaagcaattctcctgcctcagcctcccgagtagctggcattacaggtgtgtgccaccacagccagctaattttttgtatttttagtagaaatggggtttcaccatgttagccaggctggtctcaaattcctgacctcaggtgatccacccacctcagcctcccacagtgctgggattacaggcatgagccaccacactggacacttccttctttttatggctgaataacacttcattttctggagagggctayatcctgtttctccatttgtcggttgatgggtgtttgggttgtttccagtttggggctattgtgaataaggctgctgtggacatttgtgttgaagtttttgtgtgggcgtatgttttcagttatttgaggacatagctagcggggggattgcctggtcatgtggtgaggccgatgacattttacacttggtgactgaaagtctcgtgagtctccctgaactctgtgctgcttaacgtgcaccactggggtaagaacacccctggggaagagtaagatgccagccattgtgggatccgatgttgccagcctttgtgggatccgacggtttaccagagtgcagagaatgcgtaaggaagaggtagaggatttctgcgtctcactaggccagcatgcgtagcaccacttgaagctcttggtagaaacgccgccttccgggctgaacaccgccttctgggctgggcctcagagccactgattccgtaggtcagggggatgcccaggaccctgcctttgtaataagttcccctgacatgatcagatgttgaacagccctgtcctagacggtgagcgccatgagagcaggtgccttgtgatacacagtaggcacccagaggctctttgaacaaatcaatgtgatcctttttataaatagggaagggggctgttgaaaaattctgttagatagtctgagcaaattccatcttggccctggctttgcacatttaggggaagtagggatgctaagatttgctgctggtcacaccctataaagagcctccaagtagggagaagggtagggggcaaaagacttaacctgagccctaggtaggggccaaaggtggaatggttgccatctgtgcctcttcagcagcccatgagctcccgggaggccagggctgtggcctttgaatcctggggtccagcctcaaggaggggtgggctgtgcatagggttgcctatcccccgtcaccccaccaccttccagtgcccttagtacctcctggcaggacaagagggggcccagaaggcagctctgaccagggtccacctgcagggtgtgagggggacacttgggatcagagggcagagccagcccctccggatgctgaagaggatgaagtaaagtagggcaggggcttcattcagccattcactcactgattgcagagtatgtattgagcgtctgctgtaacctaagttttactgggagtgttggaatctctctgtccctttgacccccgcgtttccttccttgggccatctktgtcataaccatcaagacgcagtggcttcttcacatttctggtgatgttgcttctccatgtgccaatcccccagcggataccccactctccggagggagaaccccaagcaggtgccgctgggcatgcgccagggaggctgtgaccggagcargcactgccttgcttggagctggctgcctacaagctcagacatccagcccgcagagtccaccctggctgcagcgcctgcccaggcctcaggccagtcctggctcagcagctgtcagcccggagcagccagcgatggcctcaggggaccagccaaggcaggcggcttgtgcatcctgcttcattaataatgaatggccagacgctgcccgcgcctctccctggtcgcctcattgacatggtgggagcctcagccgcccacagcgcgcagagccaggagctggatcccaggccccctcagaaagactcaagaagccccgagaagcagctgctccccaagaccccctgagctgctgccccagaagagcagtcacagcggccctgcgcagccccccaggccatcacctccggctccacaagtgacaccagagagagccctcccttctccagtccaaggaaggygggtgtgctcatcacccgtcactcatcatcaggagtaactcacagcccagccctgcccaacacttttggagactgttgggctgaggacttgggcagccagggctggttgagggtggggacagaggaaggacctgcagagacgagagatgtgaggggaggagaaaatgcgcaccccccaacctccagccgcgcttccagcaggtcttctgtacctcgggcctggaaatgtgactccctccctcagagctgtgcagccttcttccccaccgttgccttcggaaatcctcactcctcaaggaatgcctgcagcttccttggcttctggataaagtctcgtcctggtcgggggagaagagtttcttggggacagatggctcctgagcccaaggggacaggggacgcagccaggatctgagcacccggcctcagcatgcaggtgtccttcgtttgctcggagcacagcctcaagggccggggccctgaggatcggctgggccgaccggcggccagcagtcccagcctgggctcccgaggccgcttccgcgccgtggccatggtggcccggagcctgggacagctgtcggtgcagagcctcccgtgtgccggtgacaccagcgtgaagcagcaaaggatgaaatataggtacgggggcacacagctttgcagggtgggggctgacctcccggcctccccaactccccacctcctcactttcgagagcgcataaaatctgcaaatccccatttgtcagacttgggcagtttgtgctgagggccrggaggggctgtgcttagtgcttggtagatgatgagaaacagcgtggagaatccggtcagtgctaagtttctttcttcccagtttcagggggagatggtgagggcgccgtcttccttccttctgcctctgttttctttctgagggtcgtttacaatagccaagccaccaatgctcccttttcctggggaaccctgaggcatgggccacagggcccccccaacatcctcctgccctcccctgggcacacaggctccacaagatgccctgggggtggtctgatatctttccagccaggccaccatgacaaacatccgtttgatagtgagggactgtggggtgaaccctgtgatggaatgaatcttccctcctccacctgagccaggcccagggcccaattcctctagcaggcgggactcttgctccagcaggcacaggcagccaggccgcatctggagtttcccgatggtcagcccaggcaccttgcttccctccacccgggctcagcccccatctggctcccggtgctgtgacttgtatgtggggaggatgscgaccactcatgtcaggagcagggcctccctcctcttccctgccggggcctttctccaaggctgggtgaatgtgcccaggatggaaaagggagggtcccagctttgtacaaagggtcccgggagcagggttctggggcacccttctgggggccggccttcctcactccccatgtaagtctctgagtccagagccttgattgcgtccagaaccatcctccaggcataaaggaagtctccacaacacgtggtctacagaagctggaaaagctaaattargtctctggttcccaggtttcctgggaaagttttcccaaaacaggaaccgaactggggacaactctgcttttcagtgacctgaaactggagtgcaggccaccagcctcagaaacagccacaaactgttctcattgcatttgggaatcttctgggtttatagctggtatgggtgccaacctgaaaagcattgtgagtccatcctgatgcctgagctgtgtggcttaaacctctacaaaaccaatgcctgagagttgggcctcgtgtgaaaaccgtgtcatctaagccaacccttgctggaggtgaattctgggatgactctgggggtcctgcatccacattcgtgtctcttccttccctgcgtcctgggagggtgagacatgctttaatgaacctctgggctgaaagtgtccaatcctctaagcttaatgacagtccagaatggaattctctgttctagaagctctggggtttacatcttttgttaagtagggatcaaaagctaaaattagagccaggagaggtggctcatgcctgtgatcccagcactttgggagactgaggagggtggatcacttgagctcaggagatcaagaccagcctggccaacataatgaaaccctgtctctaccaaaaaatacaaaaattagctgggcatggtggtgtgcacctgtagtcccaactacttgggaggctgaggtgggagaattacttgaactcaggaggcagaggttgcagtgaaccaagatcacgccacagcactccagcctgggtgacagaatgagagcctgtctcaaaaaaaataaagctaggagtaaaccgaacatgtatatgtatattttttggttcagatacctattgccttctgcaacttttatgtcagtcctaggatctcaaaggagttaaaagcgggactatttctaaacataaggcactatgtaattggaaagtgtggctgttaacactgtttccctcctaaaactcattgaggagtggctctcagagggtgaatgctcaccacgcccatgtgtgtgcttatgtgtgcatgcacacacgtgcgtgctggaggcagggagggcaagacagggcagtgaaggggggtgttcatcaggctggcaggtttgcagtctgtggaccagagttcaaatcccagccctggcactctctgactgagggcgggtttgcagtctgcagaccagagttcaaatcmcagccctagcactctctgactgagggacccccatctctccagtggagttgcaaacaccgccttatacctggccaggcctgggagctttccttgctgctgtcacggcgggagggtaggttcatagccctgtaggatgaggtgcagtttcacaggggctgagatgggccttagaatccaaagcctgtgccatcgggcacccccgccccgggcctctcccatcccactcatgcggtacctgcgtcatgagttgctgcacagggactgtcccagggccacagccagggtgcaagaggggggcagcagggactgagggggagcctgatcccagcctccctgtgactctggcctcctccctgggaagctggcccttcccagtggtgtgctccaggcacagctgtccagtgacacgcacagtccacaggtactaggaaactaaaggtgcatggccagtaccaggcgccacattcttgcccaagggcctaaggcgtgctcagtgtaggatggcgggaggccaagcctgataagtaagggaggggccagcacttggtcccgagagtctgaccccagggcctgggcttctcacccctgaattactacccaacatcgtcccaaacaagcactccctgggaccctgccactgccagctccaattagaagacaaagactggaagcccagcctgtccttagggagcctggaatctcggagcagggcaggcgtgcaaacatcatcactgcacggagcagacaggcgagcagggcactaacaggagccaccccatgtgccttcctccgcaaccagctagccaaggccacggtgcttgcccttcacctgatcacagttttgtcctctgcccaggtggctccaatgaaaggccccaaactcctctttgtaaaatgacctgtcatttcccggagccttccagctccggcccttcccaagtctgaagtgcagtttttaggggtgtgcagcagccgggggctccacgatgggcatcagtgctcccctccggcagaggttatgtctgtgagtcctcactccaggagtccagaccccaggagagacatgaggcaaattaatgaagaccgacagtatttgggtttcgagatgttgaccacctgcttcattaggatgtcaggtttcaacgatggggaagaaatcggtagaaaatgatctctgtgtctgggaagtttcaagtacagcagggagcagccccatccagacccggctgagacgtgtgctccccaccccacacgcagcagccatgcttacaaagcgttcagcctggaggcgccctgtcccttcgcatcccttctcccgaggcctggcagyggatggcagaaccaataccatcattttcrcagggaaacaagttgagcagggtaattgyggcatcacgtggtgccctagttttgttaaattagtcctgtgggtggtgggtggaagagcggctgaacccagagcccactcggggaagtgggcccatttcccaacactcagaccaggaacagatatggaatcaggggcaggggcaccttttgccagccctccccaaactggtgaccaaggggtgcctcttctcttcagccctgacctggccttcagcagagccttttcaagcaactgttccccacagtcactcgtggaggtggttttgcagaggtgggggccaggcctcccttctcgatgcccagacatatctagaccagtggggtccagggctctgtgaacacccagacattgcaagcaaggttcgttctgagggcattcgtatctaggcatatttccaggctttatctgtttttgcaaaggggttatgaccccaaagcagctgagaggcactgatcagaacctccagccctttgcttcattattggactcctactaagcatttataatttcttaccacagttactttctagccagcatgggggaaattacstaaacttctaaactgaccaggcttatgtggaatgtattagtggtacagttgggctgttctccccagcagccacagacacgagttattctgggttggaacatgccagcaattcagagggtactatcaagagtatttcactgatgtataaggaggaaaaaggaaacttcagttcctttttaacatggtaatagttaaagcttatttgatttgtccattgtttttgaataaagaaaaggttaccctcctgctctctttgggaaatgagacacatgtgagtcagtgtcctgtggccttctatcctcatggatcttcttctgtcctcgtggcagccaccgtgagaaaggcagcctcgtgagcccattctgcagatgagaacactgaggcwtcgggccactccataaaatgcccggtgtcctccagccaggaaagttgtaccaggatttgggctctggcttcagagcctcagcccatagccgccacccggtgcgcccctttcctgaaagaaaactcagcttttcttatgttctcctttagggaaaatcccagctctgcctacaggagcaataktgctggcagctggagtggttttaataggaaattgaaaaataaacctaggcaattttaaagtaccttcagtttggtgacacgttcaactgttttcaagctgcttacaaatattatatccactcatgagttaggagtccaggagccttataaccagggaaaccgaggctgagagggacagagtgggctcgtgtcagaagtcgggggttcagaatgaggcttgagccccatgccgccttcccaggggccaggcttggacaggaaagaggataaactgaggacatcgcatcctccgaagttggaagtgtcatggccccagggaaatgcagggcccttgggccaggaggctgggcctcacccgctggtaactcatggctctcactccccaccgcctagaaccagctgccccttgaccagatgctggcagctggattccacaagggaagtggaatctgaccccagatgggtcaaggcctggctgcagctgtgagatccacccggccacttgtcaacctcaccatctgggcagatcacgccctgcttaacaggctggggtgtgggatgcatgccaccatggtggggaacgtgagctggcagccaactgcctgggtgggatccagctcctccgcgtgctgggcaggtatcgtaacgtgggaatcgatgtcacgacaagcaaggcgcctgctgcgtagggcacctgccgcttaggactcctgccaccgcgtagggctctgctgcgtaggactcctgccgccgcatagggctctgctgcgtargactcctgcggcgagggctccctcctgccgcgtgggctcctcctgccgcgtgggctcctcctgccacrtagggcacctcctgccgcgagggcacctcctgccgcatagggcacctcctgccgcgagggcacctcctgccgcgtgggctcctcctgccgcgtagggctcctcctgccgcgtagggctcccgggaggatccggggacaggatgcctggggacygcctggcctgctgcaaccctgcaggctcctaggcaacctgtgccaggacatacgggcatgccrgtcctcagcagagggctgccaccctccttcacctcctaaggacagtcatgatggcccaaggcctgttcctgtggaccctgggatgcaccacagtgggcaggtgcctcagtggccccgggaaggagcccgggcagctgtgcttggttaggaggcctacgctgccaggctctgccgctgctgttgggcctggctgtggctgtaacaaaggaagggctggccttgcttgagaactggcagcccyaccatggagctccccgcaccccgagggacagatgcacaggccatgtggtccagtgaagtgggacgatctcctgccccagtcgctggagacaggaagaagagacacaaaatcacaaatgcagccttagagaggarggaagaaggggcttctctgcaaggggcgccgcatggatggtgccatgggggtgagaccagtccagtttcgccataaaacagacagcgtccctgtgcatttccatctgtccttgagaccactctgcagacccccactgggcaccagcagggcccrtgccagcagcatggtgtgggccgggggcagttggcactttacccccggggtgggtgagcagaggcacctctctgaaggtccccggtgcctttcggagcctccaaacacacattgactsttgggggagtgggtggggggctggccctggcgggaactgagcctggctggcagggtcctgcctgggtgctgagaactcacgtggcgtttgtttttcaggaacctgggcaagtctggcctgcgggtctcctgcctgggacttggtgagtgtgggggtcccctccgtcccaccagggaaacaggctgtggggaggccgggcatggactgaactggacaccccttgggaggcagggtggcccaaaccttggcactccccagggagtagctgcacccagagcccaggattcaggggggctcggttgccatggcaacaaagaggcaggtgggagsggggctgggatagagggagagagacacagtctcagcagaggaggtgaggcggatactaggggcccctccacacatggtccccaccccacaccacaaaatcagaggcccttagggccccgggagtgcaacgaagacaccttaccttccaaggcaggctcagctcgtgagtccctcctggagcgccattggatttggccctttttcctctcctgtcagatacaaggcctgtttccagaatgtgcagtccccacctcccctctgcatgcagtacacacacccccacacacacaccgcccactgcagtacacacaccccgccccccaccagcacccactgccctgacaccgccctccccgctctgtcccagcaggagcacgcagacgcggctgtcagacctggtgtgttttcagagaggcatcccttgtgccatttcttgcggcatgtccttggaactagagctgcctcagtacagctctgaccagcatttcaaaagccccagacctcctggacccatagccagcagcccgctctagagacttttgtcccctcagtttattgaccccaggagagcaggactttctctgaaggccagctgtccacacacactaaggacaccctggccacagagcagcacagagggacacctgtggctgcyccctgtgccctacagcctgaggtctgagcaccgacgggataatctggcttcctgccaggttcctaacttgagcccctgtgtctccttccaggaacatgggtgaccttcggaggccagatcaccgatgaggtaagatggggctctcccagcaccccagaacccagcacgrgctcgccagagcacatggttaagtctgccgcgtggaccagtgagcacgtgctcccgggagccagcgcagcagcctccctccctctttctgttttgtgagggcgccctgccccaggggagagtagaaaggtgagccaggtggccatggccagaggggatgccgagtctggtgccatcacccagcagtggatgcctcgggcctcagcatgtcccttaagctccccaggactcagatttcccacacgcgtgacccccattccacagttaacgaggagaattcagggtgcacacgcttcccaaattctgaagccggatgcaggtcctagctgcccccatggaggctccagtaactgtctgtcttggtcattgggaatgcagcccctgcagtgtcacaagctgaagaacctgagatctgcatttcacccaacatccactgtccatttcccagctgccgcgaaccgtgcggatcgcagtcagatgtatttgctggggctcatgtccccacaattggaacaagaaagtgaacactaacaaaaagccagcttgtatgccgccagcgcctctgggtctctcggaaggacagggacggcacacgcccagacatgtgtgcttctggacagtgaggcagcatctcagaaatgagagcagtggcatttgctcagacagctctgggcatctgcacaagaagcagttttcacatttatcctacttagcactagaaaggttgcgtttaaaaattgatcagcgaattgatgtgagaccttgttagctgcgattgctcagtttccaagggaaagctttgcttctatcaaaatttaaatgcgtacagtttgtgtttgaggtcacttttatctttaagacactagctggccgggcgcggtgactcacacctgtaaccccagcactttggaaggctggggcgggcggatcacctgaggtcaggagttccagcctggccaacatggtgaaaccccatgtctactaaaaatacaaaaattagctgggcgtggtaggggcgcctgtaatcccagctactcaggaggctgaggcaggagaattgcttgaacccagaagggggaggttgcagtgagccgagatcatatcactgcactccagcctasgccgtagagtaagactctgtctcgaaaaaaaaaaaaaaagacaatagctggttatagaatgatttgccccttgctttgaagttgctggataggcgctatctcagggtgaagtctggagttattaaggcaaaaggaattgccttacctcagcccaccagattggttcagttggagccctggggcccatatggttcaatctgaatcagccttgcctgacttggcctcgtttccctttcgatgtggtttctaaaccaggatgggagaattctgtagaacggcataacttcatttccaaacaatattagctgggtggcctgtatgtccttgtgggaaagataaaaacaagcagacagactagacccatccaatgagatgacgttttcaccagcaaaccaggcatacccttagagcattaatgaatggcccagtggcagccccgctggcccaggcctctgcagtgtctccatcaggaacacagtgatggacatgtgtgaagatattggaggtcatttctagatgacaccaagctggaaggacagagaataaaatagatggcagtgtcagggttctgaatggttgtggcaggtgaaaatggcttagcaaaggagcaagacaaatttttgtattaatcctatagttagtgtcaaaaaagaaatcaatacatctagaagggggggcccgcctggctgcggttcagatgaaaagggtttgtgcacttcaggtgctgcggctcagtccgagccagcagggaagcaaggaccgtcctggactgctttttttgtttttcagttttttattacatatatgaaacataaaatttgccattttaaccatttttaagtctacagttcagtggcattaagtacattcacatactgtgccacccttaccaatatctgtttccaaaatatttcatcaccccaaacaggagctctgcacccttaaacaacaactccccatcccctggtcacctctagtctacttcctgtctctatgaactctgcacactgtttgtataaataaagttttattaggacatagccacgcccatcatttacacatagtggctgctttcactccacaagggcagagctgagtaattgcaacagagactctctggcccacagtgcctgaagcatttactatgtggccctttacagaaaagacttgacgtctcctgttctttgggccgcagcagctgtaccctgcactatctgcagggctgctgtgtgaactgctcagcccagttctatgccatgccagggacaaaatgaaagcttgcccaggggtggaacaaaccacctggtgaggcaggaatgacagccaccctcacatggcacagggcagagtccacagtttgtaggacaccatcacactctcagccagtgctcacaggagcccatgaagggatcaaactatgctaggaaccctaaaatgacgtaatgcctgtcggagccaccacggtggtttcaggtctccagccctcccattgttaggtgccctttctgtggcctcacactccccattagaagcatgtgttcaagacaagctggacaataaaaatttaatagatgtaatggttgagaacctaacacttattatctcacctaatcctctatcaacccagggaggcaggtgctattcccagttcagggaagctgagcctctggctataaacaggtgcaggggyctcacctggcckctggccacagggggttccacctggtgctctttgcctcaacgcttgcggccagtgctcagctgtggggtaaccgtactggggtagggacagattccttgtccccccagatgagggtgacagggaggtggcctgtatgtctcctgagcttccttctgacttcagtgtctgggacccagatactggaaggaaccaaaaagtcacaacataaaggctgcgtaaactgaaccaggatgcagccacagagcrgagggctttagaagtcatgttttaggtctaggggcggtggctcatgcccgtaatcccagcactttgggagattgaggcgggtggatcacaaggataggagttcgagaccagcctggccaatatggtgaaaccccatctctactaaaaatacaaaaaaattagcggggcgtggtggcaggcacctgtaatcccagctactcaggaggctgaggcaggagaattgcttgaatctgggaggcggaggttgcagtgagccatgatcgcaccactgcactccagcctggatgacagagcgacactccatctcaaaaaaaaaagaaaagcatgttttgaagaacagcatgggaaaggcccgtgacagccaatggaaaatgcagccagcatagacagcagtctgtggagtagagctgcagttttctagggaaagggcagaaaaacctggaagagaaagtacagcaaaatcakagccgtcaaaacataaataaataaaatagtgagaaagcagagccccacagtgccgtgagtcgctccctctctttcctgcctctggtcctgccaatcccaggcgccaccctggatgtagctggaattgtatggtggcttcgtttttgctgagggacaggtgaggttagggttggtgtctgcagtgccggaccctgctgatccggctgtctgcacgccttcgggggtctgtgatgaccacaggtttctgtgattggccgggctttcctcccaggagggagccaggtgtgttcagggccaccgtgctccggagcggagagcgccgagccctttgttcttagtctatgagcaggagtgggaggcctcccggtgggcagagcagagccaggagcatccggggccccgcctcaggcttgcggagcccctgcctagcgccagctccctgcctgcttccagcctcttcccagtcactgtctttctagagagggcgacagggtaaagaggcaggcaagacaccgtctccagtggtcgaacagcatgctgtggagagggtgcgagctgcctgtggctgctgtaacaaatagccaccaatgcgcggctgaaaacagcagcaacgtattctctcacagctctggggtccagagatccaaactcggtacccctgagcctaagtccaggagtcagccgggccgggcttccttctcccggccaggacctttcccggcctaagtccaggagtcagccgggccgggctcccttctccaggccaggacccttcccagcctcttcagcgtctggcgctgctggccttccttggcctgtgcccgcatcccccagtctctgcccctgtggatactctccgtcctcctcttctgtcagtcaagtctccgtctgtctcgtcctcataaggtcacctgtgatggcactgagggcccacttagctaagccaggacattctccccactgcagagtactcacgttaatcccatctgcaaagtccctctttctacctaaggtcacattcccaggttccagggacgtgatacctttggagaaccattatttagttgactgcagagaagaaagtagaaaaaggagggcaggggggcgggggtcctgacgacagggtggtcaggaagcagaagcgagcaaggamgccacgtggtggtccagagaaagagccttcgggggccaaggggacaaccaaggcacagccctaaggccgagtgttggggagaaggggatgcaggggatagagctgggggtcagggtgcagatctggtggagactttggctttgaccctctgcgagatggaagcccctggagggcttttgcatggaggaaatttgacctgatttaaaaggtctgccaaggctcgccctggctgctgcactgggaatggcgagtcatgaggatgtcccagagttcagcgtgtgcacgatcccatgtactcggaaggcacatcctgatgtggcagggctgtcgtggagcctgggaggccgcatttctgatctcatgctgatgctggcccatggaccacsctttgcctggggaaggtgcagggagagaggatggaagcagagagctaggaggctattgtgagaaaccacccaagagccgctggaggctcagagcagggtgggcaccrtggaggtggggagacgggtcagattctggactaatttgcaggggaagccgcggcaggggctgaacttcaggctccagtgatgggaggattagtcaaggagggctccccagggtttgacckgagcacaggtgagcgagacctcccgggagctgatgctgccgcaggctgccctccctggcccacaccagccccagggcctagagtgcccctcccccacccacyctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagatygtgccactgcactcccgcctgggcaacagaatgagactccatctcccaaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataycagagaatgatgggtgctggggctggaggcagggagcggggaaggggagttactgttcaatgggtacagtttcagtttaggaatatgacagggagatggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttytaggatgtattgtgagtgaaaaaatcaaagtgcagaaacatatgggtagtgtgccacccctcctggaagaaagatgggggataagaaaatacatgtgtctgaaatayaaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgrgaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacarcaacagagccccgrcaggtggatcctgaaaaccgacggcctccacccccgggcttcctgactcaaatcacagccgctcactaaccggggctcagcttcagctgtgctgtatttcagtgtctgagatgtttggggatgagtgccagygtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactccgtcctcactctccatacctcctggccacaagggcttctgagttcagaaaggagagacgcagccctgtgaagccacccctggctggttttctgtcctrtggtttttgagggttattaagaattattcaccccacgctgggcttgttgctggtgaggcccagtgctctgagccgcacctggggaagcgtgacactcagagggaagcagccctgtycgagagccagaagctcaggggcacctttctctccggcctcttggagggagctgtcacttgcagaggggctcccctcgctccatgagtcccaccccacgaccagttctttgctcatggagcacaatcgcgtcctgacagcagccatggagcaaagtctgatgcacagcgcatttagctcgggcagtcattcatcsatcttgcccatgaggcagccaccaccacagcagtgccgctcagggccgggagtatgtgccgttrgagaaacactggacaagaggccagaatggatgtcacccaccatgcaccagctgtgggatgtcagttgctccatctacaaaaataacaattcagtcctcatgtgcaggtgctgggaaagattcaatgagrtacaactgaatacaccgccctggctttaaggacatagactcatcccagcaacrtccacagagcccctgctggggactgccttggtttcctaggactgctgtaacaaagtaacataacctgggggcctgaaacaacagacaccgttctgtcaccttctggaggccagaggtctgataccaaggtgttggcagggcmaggttccctgtaaaggctcgggggagggtccgccccatgcctctttcagctcctgggggttgccaacagtccttggcttgtagacgtgtcactctggtctctgccttcgtagtctcatggacttctgtgtctgcattttctctccttgtaaatcaccagtcacatagggtgtaggacccaccctaacacagtacgacctcatcttcgctaattacattgaagaaggccctattcccaaatgaggtcacctctaagcttctaagtagacatgaattctgtggggatactgttcgacccagtacaggtgctaagccctgtgatgaccccaactgatggggtccctgctctcaagaaattcacagtccttggcagtttcttcattccttttgccttctttattcttctcaatgggtttgttactgagagctgcctccatccctgtcctgtggcaggagagggcaaggagacagcccacaggggagcctgtcgggcccgggagggcagggcctggacacggggaggcctcccaggccgagagggtggtgctccagagcctctgggccccacccccggctggcaggacagtgtcggttttctcgtttcagatggcagagcagctcatgaccttggcctatgataatggcatcaacctcttcgayacagcagaagtctacgcagccggcaagtacgtgtcttttcacacgggaaaamgtggttcagaatgcctgggcagagccggagctacagggattcctgccgctcgcgttcccaagagtgctcacaaatgcaycttgcaccctgctttcatttttaaactctgaatggctttaggaggtgctattttcatggggctggaattgcagaacacttggacactgatcacttgctgaactccccgtggagccaccagggggaccacagtccctctggtgccaaagatgctgtgctgggtgagaggcgcratggagctgctgtcctgggctctcctgatgtgcctgacattttgacatttcatgtctcacttgtgcaactagggctgcagggcctcagagctggggagggcaggctccggccragtgctgtggggagcacttcccatcttggcggtgaactttcctgctcaattatgtaaaagctcagccttcttcagccaggctgttggcttcaattttaaagactggctgtaatcaaatcatccactctcctgcatcgggtttccagaagtcagcttttgtttgtgaaatcatttgttggccctctcttcatcctccttctgcccycctcctgcctggggccagccaagttcccgtcagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgcygctgggaccctcaaaccgcctccagcccccatctgcagcccttttggccctccggatggcacagccccctcccactccctccatactggcagcagcttcccatcaaagtgaacygctttccagacagatgagcccagcggaggggtctgaggtcaaaaagcccagtgcagatgccaagccgagaggcacctcccgtcccgagccccccacctctycgctgcctgctttggcctgggttatgctgccctgaagaatgtgtgggaggcagctccgtgcagcctccgtggatgaggccgggcacaccccatgtcacagcagccacactccgtcctctgtcactcgcagtttccatgttcccctgtttaactggacacccagagctggtgagctgggcaagttccctgggtctccggcagcctcgggcctctcggaagccgcttgccagaagaccggggagtcagggagcagcttcccctcaggtcgccgtttctgtggaatcccctgccctctgctcctgggccggccactgcggtccctctgtccagctcagagctgagcccccggtggacgcccatcagtgccctcacaggggagctgggcgctgcgtgccggggataggcagggagaaactgctttggggagtttgggggaggctgagaggcagcttgcagggggccaaacccgtatcttcccgaggccccttgcttctcctgctgacactaatttgcacgcttctcagagagctgcaggatttctgtgtcccgcgaacagatgtgagtcctaccaaatcacagccagagccacaagccacaggcttagataactcactgtctgctgctcctctgccccagagatcgctgctagcttttctctcttcctcctcctttcctgatccccaaatcagggaccaaggaataaaaggaagaggcctagggctgagtgaattttctgtgtgtcttgaccataaatgaggagcattcagagcgcatgctaaacagcttgcaaatcagagcccattatttctgagtggatgactcaggcgcttttataattggaatgtagcacagagtatggatcattctccgtctgttgttttgctcagaaacattttgctacaagcagaaagttcttcaaagttaatccagtgctgcagtgccaggcaaggctgggacggccgcccatgcccccagctggcctgggtttggtgcaggacccagtgatgccaaacaggacagacagtggtccgcctagcatctgactctgccgttcagtgcaggaaatgagagggacacgtgcacccacacacatgcacacatgtatacacacacatatacacaagcatgcacagatctgctggaaatccagcccttgaccctgagtacatgttgattgtctctcaaaacagagcgtgacttgatgaataatttacctttgaaaaaagatacttgtcccggcgcggtggctcacgcctggaatcccagcactttgggaggccrmrgygggcggatcactcgagatgaggagttcgagaccagcctggccaacatrgtgaaaccccgtctctactaaaaatacaaaaattagccggrcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttccttctgtgtgagagctggggccgccactgcttaracacgtgtctgcaggggaacatgccacagccatcctagtggggggcaataacacagctgctcccactccctcgggccaaccctgtctgtggaatgagctactgagccaaggcgggtgttaacagcctggctctctggccccagtgacattttcacagagggaaccaagtggccagtggccacagtgggtctgggtttgatttttctgtttggctgtgatgagagctcggtgtcttgttttgcagggctgaagtrgtactgggaaacatcattaagaagaaaggatggaggtaacggccctgctctctgcggcctgtccctggggtgggtgcgggcgaactatcccrgggtcagcctcgtyrgcctgtcgtgcagtgtcgtaaggcccrcaagtccccacatctttcttgctgggaagtggagaggaaaattcagttctccaagaggaggaggtgactctgcttgagaaagaagttgaagggaggccgaatacactgtccacccccaccctagcctgcccactccgcctctgtcccaactcatccacagagacccagagcaccagggtccctgcttgcaaagtgtcaggccaaaaagagcttggcgtgagaacgggcctgggtacagcaaaggcgtgctgctacagaagatgtgggtgcaaagcrcttccacttctttggctggagcacttagggtcaggggagccagggggccagagaagggagtggctcagagagcttgggggcctggggttggatcccaccctgcaccttgtccacaggatcttcgcggcrtctcagcctctccggagctcactgttcccatctgtaagagggtgtgtgtgggaccgttccggcagggcyatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctgaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgtattagcaaatcccctgatcacgtctttggcgaatgtgcatggaggtggtgtggggtgatcccccttcctggaggtgacgctgcctctgccagagctctgtggccgatgcttcggggcagaggaggcctcctactccagcctcgtgagctgcttccctgagcagcccgggacccgggtgggaaagaagctcagccatggggcaccaggaggtcattgtcaccccctgggtgggaagtactccctcctctgggaggggtcaaggtcaaacgtggctgggaggggccatcattatcccccatcccaccaggacaaagccactggtatgggcatttgtctcgtgtggacttagagcagaagaacgaattacttccctttgcgctgctcaagcccaaatcctcagaattctctgcctcagctactcaaacccagaaccccactggcctggccacacttgggctccctatgcctcccctccctcctttggtgccccccaagttaccccgaccaggccgtccttatgcctcccctccctcccttggtgcccctcaagttaccccgaccaggccgtcccacacagattttctgcaacacgtgtcacattctgtagggaacgttgcagagagcttccctgcctgcctcccacctacatctttccatcctcaactcctgccagatccccccagagcccgcccctgccccctggcccacaccsggcctcctccagccttggctcttgccacttcctctacctggatcaaatccatgcacccctcatagtccctgagccaggcccccctcccacatcctgggcggaaggcatctcctccrgactccggtcacactaggccccccactgtccaactcccactgcctgaytcacagttactgcctcggtggctgcctcctggctccatgaggmgcccacgcaccccggctgggcacgtggtacacatcatatgatggagaagtgcccatttcatgcccyaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccaccaagatcttctggggcggaaagtaggtgcaacagctggcgatgcttccagccccggcccagcagccacggccccgtgctccccagagacccctgacctagaaggctcctggggtggcgggaggacagtcctccttgagaagggagagtggtcggggtctgtcctggacaggccccggcccagtgccatttcctgtccccagcaggggcagagctggtgtttctgcagccatcagctatgcctggtgcctgtccctgttaagggacgtcaaatccagaaaagaagctgtggccgagtttgccttttacaaaaacctcgcttaactttccttttwactcacatggattattttttcctggtcactatggtaacatcataaaaattatagagaaaacagaaaatttgtgaactgcccaaacccccaaagcactccaaattccctgggccgcctgtcacccctgcaggtctccaagtgtctagctccatagtttctgggctggacacacttgggctcataggaattataactacgattcattcattcattcttttttttatttttattttgtttttattttttatttttttgagacagggtctcgctttgtaatccaggttggagcgcagtgccacaatcacagctcactgtagcttcaaactcctgggctcgagcgagcctcccacctcagcctacagggatgagccaccatgcctgactaatttgtcctttttctctctctctcttttttttttttttttgagacagggtctcactttgtcacccaggctggagtacagtggcgtagtcccagctcactgcagcctcaacctcctgggttcaagtgaccttcctgcctcaagtagctggttctacaggcacatgccaccatgcccagctaatttttttatttttatttatatttttatttttgtattttgtagagatggggtttcatcatgttgtccagcctggtctcaaactcctgagttcaagtaatctgcccacctcagcttcccaaagcactaggattgcaggcgtgagccaccacgcctggcattaatttgtccttttttaagatatggggtctcactatgttgcccaggctggtcttgaactcctgggctcaagtgatcctcctgccttagcctcccaaagtgctgggattacaggcgtgagccactgtgcccagcctgatgtgttcttaatttaaaaaataataataataataataataataagtccaaatcaaacagacgggttaggttgaaaatcaaagccccccaccccctgctgctgcccccctcccctctgagccctgtgaccaggcctctccctgggcctctgggagttcagccctgtagcctcggstccctacccccaaagtggaatccgactccacacggcatttgctgaccctgtttttgcgtctaacattgcatcgtaaacgttttttgggaggggccagggtgccaaaaccgctggtgacatcacacgcggtyggcctgttttccagggcggagacggagcggggcctgtccaggaagcacataatcgaaggtgaggacgcrctcgggcacctcagggcccccatacctgtgggatcatcctcggaggccaaagtgatggcagcacagggcccgacccccccagttaacccactgagggcccaatcccggggcacccggtgctctggcctgaccttctccttccacccaggtagcacagcgggaccctgcagagaacgagggcagcccggtggctgagcacagaccacagaccagcctgggtttcaatccaggtttggccccacactggctgagtgggtcttcagcaggggcaccctgccccatgcctctgccacagtatctgtgcaatagggacagtaagagcgcacccggcgagggtggctgggatgccygcagcgcccaggagaaggtgccacacagccyggggctcagcactcgcaggcaccggagcaaggcaccggggtgtctggctcttgctgtatctttattgtcttcatgcctttcctgtccgtgttcattttcttcgaggtaatagatcattccattgaaaatcacctggcggggcaagccacccactcccatcctccccaccccaacccagcgtttcactctgccggctgtgtgtcctgagctgctctaagcaccagcgggtggcttgggcgttttagacactattgccattgtttttgtttttgagatggagttttgctcttgttgcccaggctggagtgcagcggcacgatcttggctcactgcaacccccacctcctgggttcaagcaattctcctgcctcagcctcctgagtagctgggattacaggtgcccaccaccacatctggttaattttttttgtatttttagtagacacagggtttcactatgttggccaggctggtctcaaactcctggccctcaagtgatgcgcccgccttggccccccagagtgctgggattacaggcatgggccaccacgcccgaccatagacactattgcctttgatgggacgggcagcaggtgtagccctccctccacatgtgatagataaagtcatctccctgttgtaatacacagtggcctcagaggagggtatattgtctgagggaggaggggcttccccttcatttagwcaaggacacgtggcctgtggtcccccgatgtcctcctgaagggaagatccccccactccctgtgggatgtgcccccacctctgccgtggcatttcacsacctccatcagcttctggaagcttccagatgccagaggcctcttctccatctcttgttccctgagccgggcatggatgggcccaggtgcctgtggagatggagccacagcagtgacgcccccccacctggtcctcccccaggtctgaaagcttccctggagcgactgcagctggagtacgtggatgtggtgtttgccaaccgcccggaccccaacaccccgatggaaggtaggtggtctgcggcggcgccaccggttaggcctgggcggggtctgaagggtctgaacctggggttgtagaggccgccagcatgggccctgctgggcaccygggtgagccgtgagaggaggccgggtccagggtggggggcgagggggcaggcctcccctcagtagggggtgaactcagcctctggctgcagacccctcgccaggtgcacctggcacctccaggctgagtccctgtcctggctttggacccaggccgatccgccctccgagtcagagccgcagtggaactgtcccctcccctctgcggctgctattttgcagctaagtgaagtcgcagtgtggggactccaactgcagtgttctctccaatcaccatccattgggaagcttggggggacttttttgctctgggggataaattactacatagaggagaagaagcgttcagcgctttgaaaatcggttttggttactttggcgttttttattctttctactcctgcgatctcagccccctccgctcccccatcctcctgctacaggcgtctttccatgtgtgctttgctgctgcagggacttgaaagttaaattgtgttccagttattgttttttatttgttcatatacagcacgcacgtgcgtgtgttgatatatttttttcctttttaactaaacgcgtgttctgcacggtgatttgtgcctccccgctgtgccttcgtcgtgccacgcctctcagtgctcccagctatcaactctggtctctttaaatctttcttctatcaccaggggacccatttagttcctccaagtcaaggacattcatcatagaaggtacacagtgcccccagcctgactattgacttctgtgtccaagctgcattttatgagacagtatttttatttacatgattcttttaccccatgagaaacttctccataaaatgcataaagaggggaaagagcaccctatgagaacaccttgcaagtgaaggaaaagcaaagtggtgttggagcccctcgcccccagccccccatcccctygttcctccttcctcccgtgcatggcccccacccctgggcttgcactgctgagctccgcggcggccgggggtcctcttgatctgaggatgctgtgatccccacctggagccttgaccctggatggtgccatgggaagggttggggaagaccaggtttccacaaggagcaaagccatcagggaccccaaaacacgcggccccccaccgagtcttagctcctccatggtttatgtttgctaagctcctgtctctcctggaggcagagatcacctggcttgtcacgctgccccgtccacagcacgctgctcctcggacggcatgctggctgcgtgtcccctctcaccaggttgccaaagcgctccatcaacgtggaatcattttcctcctgaaagaataaccacaggagccggcagccttctgaaaccagggggtggcctctggccacgcacagtctctctgccctccccacagctaacggccccaggaccccaccccaagggcaggtgtcgatctccctgggcctgggcccctgtctgccaactggtgctgccacctgaacccccatgtattatttgtgatgcggcaggagatgctgtgagttttggcagcagctagaaggattcagtcttcctacttccgttcaaccccattaaatattgaggtgaaggacagttgtccctaattgtccctgggtctggggccactgatatcacacttgggcacaagtgcagggtgctccctcatgtgggctccctgtccagcctgcttctgcccagatcctccagggagcccaggggcctttgcctaggactccccacctcaggacagccagaggctcctgccccgtcagccccgtctctccatcactgcatggaaggggcgccgcagggcagcatgcggtttcactggctgggaccttggagacctgagacagctgccggggagggagagtgagggaacggggctggccttgggggccttggcttccctctgtctggcatgtggacctaagccttggctgagaagaatcgggaactgatgctgcatgctcacaggtgccccgagagtgtttctaaaaaaccacaaggccgggcaggccaggagcccggacctgggcaggatgtagtcagagattctcctgggaccctctaggttctcctcaaactttcccaaccaggcacttcctgagggtctatcggagttggcagttaaagcaggtggcccagggaggtggcccagagagttcagactccctcccagatctccacccccaggaggggacagagaggattcccaggagctacaacctctgaccttggaagtaagcagagagcagggctgggcctgcaagcgtggaagccaagggtggtttgccaggggtcctgggtgagtctgccgagaccaccactccagaaaccccagtggcctcagctctagcctttaggaggccccaggttctgctcagggtggacctcagtaaaggggcactcagggagcgacccccaaaacagaagtggacgggaagccagcactgccactttgtggcctcgttgccattccaggggggagcctgcagaacaaacccagcatcttccatccttccttccttcccatcagccccactcccagcattttcaggacctcagcttccacgcagcatgggcaaaggacaagcaggcactgagggagagccagggcttttccagggtcaacgttgttgctgtctttagaaacacttgcactcccactcactcccacactgcctttggcggtcgaacttgcaagcactgtatccgacccgtgagaagcctagcgccatagtccctcgcyctgcaaagctcagaggcttctgaaatttgaaatttcgacgccaagttctgtttttaaaatcacaatatccccatgaggctgagagggagctataaccagcagattgctgtgtctcaaarccatgtttgaatattgggaagaatccactgtgtcgctggggcgagggtccctcctctcttctttaaaaggccagcgtgaagtctccgcgatttcatcctcagggccttaggagtctccgccgtccacgattcaggttgttcccagggctcatggagcctcaaaactgtcctactccaggccctggcccctcacaggaggagcacccagacccctgtggccctgggaccaccccttgccaggggacaggcgggttgggactctggcctggtgctgggctggtttgagaacctgggccatggtcttacaaggctttccacgcccacttctcagtctcctggacatgacaggaaacatgagctcagccccgaagccctattctccgggaccatatggcgccccaggtcctgccacatctccttatccagcccactctctgttccaattagactttggaatagcccgaagtaggagaccagaaacgcaaaaacacatgtccctcctgccgccaatctgactgtaacgttcatgcattcacctggtccttcctgagtgatcggggccctcgaatcttccccagaccagagaacctccagttctagagtccagagccacattctttgattgtcccctctaatctaccatagaaacatcacggtccatccataacccatttttcaacatttccataggcctgtaaccagtcggggaaattgttttcacgaccaacttctaggattgtggttcacttttctctttcatcccaaaaaacccctcccacacccaacttcagagccaggaagtacactgcttgcaagacatcttcgcagcccctgtccctcctcccagcgtcctgcctgtatttgcagaatgtcccraggctggccctgagcyctggctgccccccacctgcggtttccctttctctcacgacagagaccgtccgcgccatgacccacgtcatcaaccaggggatggccatgtactggggcacgtcacgctggagctccatggagatcatggtacggtggccgcgcagcatgtgtgtgtccaggcacagactcccggcaccggctgcgtatggagaccccaaagctctggcggggtctgtgcctttggtcccaactgcaccgatgcctgggtgctaagggagggacaggatggtggagtgtggtggttatgtctgtaggccttgcagacggggattctgcatggatcccagcgctgtgtggccctggacaaatggcttaacgtctctgagcttgtttccccacctgtagaacacatctgctaggtgagcccccatggggccattctaaggagtccctgagagagccagtgtgaagctcttagcagatgccctggagctcagcaagcactctggggtgacaacaccgtcagctgtttccactgggctcctgagacgtgcccggtgctgttagggtcaagggttccacagggaccctctcacatgcaatcctcaccggtgcctttaccaggtgagtgccgcaggcagcccatttttcagatgtggacactgtggcacagagaggttcagtaacatgccaaggtcacacagcttgggccaagattaacatccaggctgtgtggttcagagcctgggctgctcataactggaccctccggcctgggggtcccaccacccacctccttttcccagctcaccagggcctgcctggctcccagggaagctatgagtgtgagcagtggggagcccgggctgcagctgctgggccagcctgctccggggacaccttggtgccctctccatggctgccccggcagccycccgcctgctcacaggcaagggccctcggggtccctttctgccttcacaggaggcctactccgtggcccggcagttcaacctgaccccgcccatctgcgagcaggctgagtaccacatgttccagcgtgagaaagtggaggtgcagctgccggagctgttccacaagataggtgggcaccctcgggcccctcgccccgccccaccccacccctgctctcgggcccagggcttgactccacctgcttttcctcttcaggagtgggcgccatgacctggtcccctctggcctgtggcattgtttctggcaagtacgacagtggcatcccaccctactcaagagcctccttgaaggtgaaggaacagcctggtggggagggacgggcaggggataggcattttggacgggtgggacctttgggccgactgctttggtgctgggcaggggttccgggagctgcagctgttcccacctcggtctgctgggggcgggctccttggcgtgagaacatggagcccctcctggcctgatcccatgtgtagaggggctgcccagcctgtggcacaggcccaagtggagaggccctttcacatccccccccctgcccccaccacatccccccatctctaccccctaccacatcccccacctctgccccccaccacagcccagcattcagaactctgagacccctgggcctgggctccgagatgggggctgcaaagccacatggaggtgaccctgggagaggcgcccctccccaccacacaacctctgagtggggactcaggagggtccccagactgcaggatctggagaacaaggagcaggccaagaaagtctgcccagccagcagtctcagcactggggcccacagccctgggttccagggcaacgtggcctggcccccgactcctcccatcccatggcaaggtcagggcccccctccaggaggccctgcaatcctctgggggggatggccaggggagagagcactcccctagggccaggaggttcttctgggccacgggtggcagccgagaccccaggctgccaagtttcctaagagaaggaaggccagcacctcgcctccttgtcctgacttggggttgggccagcaccacagtctttgcacttcagagcctggacaggccccgctcatccaccagcccgtgcccggcccactgcccactctcccctacttgagaggcctggggcaggggcactgccctggcttcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccataggtaacggtggggtcgccatggggccagtgcccctggggagaacctgccccarctggccgtaggtaacagggtggggttgccatggggccagtgtctccrgggagagagggaagggatccctggacatcatcccccagccagcctcgggtaatcgggctctaaggggcatggttgggaccccatgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacctcttagacaaagcccgtgcccagcactgcagggcttcctagaccccctcagayccccagaccaagatgctgggtctctcggcccagtcagaggcaaggcagacccatcaggggyycctgtggtgggtgyttctccctcaccttgggtctcgccgccacagcctggtgcctgaggaatgagggagtcagctccgtgctcctgggggcctccaatgcggaccagctcatggagaacattggggcaatacaggtaagagtgagaggccytgctgggcagagggcccatcccagcccgagccccgtccagtgcatcctcccaggctcgtcctgcgtgccaggctctgttctaggcactcaggatgygcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgcaaaggcccaaaaaggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccaycggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggcgaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcrtcttccattatccacgagattgatagtattttgggcaataaaccctacagcaaaaaggactacagatcctaagccgcccccgcccrcctgctcggacagtttccgttccctcctagtctctgttcgctygcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccagrccaaggcctggttgggtccttggggcgggcagggccrgcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcrcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccgtcagggagggtggctggccccatccccactgccacccagccccacycactgttggaagagggaccagcgcgaggtggtgcccagggtgggcactgctgcttaatgcgaggcacacctggggcagctgagccccccgaaggctgcgggtttgccaaacacagagaggccaggccccagtgtcaggatgcagtcagcctctggcgcagctctttccacgacctggttcctggatgtcctgcttgctccacacccatctacagggaggatgtgagggggctctgcctcctagggccaggtcccccctctcrggaggrggtattgggtaggaccatccaagaaagggcagaagaccaagggcagtcggggtctagaaaggagggcgctggccctgctggrcgcttcggagcccccactgtttcccactcagctttgtgctcagatcccaggtcccaaggagtgacaggggcttcctcccaccttctgtccttgtccagtcatgtaaataatgtgctwtttctctccccgagtctttttttttwaacctaccgtggttcctcagctaactgcattccctacccaggcagagactgtcctatgcctcgagcttccaaacgagactcagaccgcgacacagccmccgtatttatggaatgacaaaataaataaagcccaaacccatcggtctctgtgactttttgctcctctcatttcctcagggtcagggctgggccagggtgacacgggaggggaggaaaaggctgccagcagcagggcctggggcatcccccaaaccggagcctgcagccaagggcaggtgggttggaaagggcccgtggagagagagcggggacagagaatggggacagggtggtcagaagacctgtcccccatctctcccaagcgattcagccaagggagggtgcgtgcctcccctgccgcccccaacacacacattctctttcaccaactctgagggcccaaagctgcttgctgggaggctgctgtccctctggggacctggctggctgctgttctcataaggacagaggtccaggcctggggaagctctcatggtatgtgtttggggtacaggtgagaggggcctcaccccagcacacccctgtttcgggctcccctccttcccagtgagcccctgcacccgtgaaatgaccatcccaggcaagagaaggcttccggacacgcccccaccccccaccactcctccctggccccagcccccacccccattctaaatcttgaatcttaaaaagaaaaagcctctgattaaatcctttcccaaaggatttattaaaacacagaaaaccaaaacatacacacagagtacaaagtaaaggtgattgtgttggctacagcctctgtccagcctcccgtgggcgaagaccagacaagccacggctcacaggggagcctggcttccaaagctggacccgcccccgccggggccaccctggctgggactcctggcgcgccctgcacccagcccagggccctccctttgccagcctggggctgtgcctggggaaaggggtcggccccctcttagctgggcctgggccggtggagtctgctccctccacacccctgaactcagaccccacgggccagtggggaccctcccttcctctccaggggtgcttgggctccaatcgctgcttgaggagttcaggacacacacacacacccaacgggccctttctgggttatcgcacctaaaaaaatactttgtttaaaaaaaaaatctgaaaattaaagaaaaaaaaaacacaacgccagtgagtttgggctgatgcaccacaacctgtaaactttcagacacagaaaacaggacaggaaccagctgccgaggccgaggcgggccttgcacagaagagacttgggggaggggccgaggccaggtcaccaagacggtgagggcagaggggcgtgccagcctcggcccccacccacgccctgtcccctgcccacagaccctgacgcacactggaggctccaagtgaccgacacttgaccaagtccatctggcttctggctcccatgtacccgagcccactctccactccacctccttgggcctcaagtgtcctgggatgacaggagtgagggctgcaggtgtcaccgggccaaggcttggtcagctcctgacctcggcaggggagcacccgggggactctgggaaggcagcccccaaaagcaggaggacttcaatcatagggggcagggaaagtccagcctgcccctgggggaagccaagtttgcaaaaaacgcaggagcttcggaaggtggctttcacgggggacgctgcttctgcctcaggcgtgtatgagagggccctgcagacgtgctcactccaccccgagtcacctgagcccatggggcaatgccttccaagaccttggctcaaacatggctctgcagaagccctactcagcactggcttaaagtggctggaaatttccaatcgcagactggcactttgggctcgcgttcatgcccgaggaccctgattctaccagcagcaaaaaccaaacccagcccaaagacgccaaacatacggacaccaccatcaccacttttggcagagatgactgacaaaccaagaaggacattctcagatcttttctcctctcccaaactggtcagccccaaacccgctctgactctagtagcccacccctcccgggccccggggtgctggccacggacagcaccaccccttctggaccaggcagtgcagggggcccaggcccaaaggagccctggccaggctttcctgggtgcccgagtctaaccaggcagaggagaagggagccctggcgaggcctgggagggaagcagagaggaagggacagagcaagcctgcctgagaggaaggcgcacaggggagggaccatcagcccttggggtggagacacagacccctgccctgaccgccacaggcctccagtcctgctgctcgggacctatctgctgtgggccaaggaaggtgggcactgctcccaacgagggccaaccccagtgcttgccactgcttgtttggggacgagggcacgggagtgagcttctgacccgagccaggaccctttgccaggaggcaccgcagagcacacaacacgcatgtggatgaaccataacatgtgagcccgctgacaatcatctccactccagggtgctccccactacgcccacgtgcagtgtcagggtcgggctggccttgcagacctggatccagactggagtgtgggaatgcgccaagaggaaggacttgtaggtcccgccctccggggttcagagacagcctcattatgagtgaggcatatagggcttagggagggccaggcaattgctccagtgtctgcaacacaagctggtgaatcctgacccagccctggccccctcagtcccaggcaggccctctccaaggagctgagccccagcccgtgtgcacctccaccccaggcccagctgggtttttcacgcagccctttcctaacattcccaggattctgcaccccaaggcaccttccctgggaaggtcccagtacaagactcagaaacgccttccaggtcgacctggggccaggagaaggatcacacacaaacaggcctagggagggcctgacctgctccccatctccgtccccaacttggaggggcagggtccgggggagtgggtgggattccaacaacccacatgtgggaagatggttttgggatgtcagggcgctcctggcaggaaacaaggcagcaagcccttggtgctgcggctgggaggggtctgcagagggcactgggtccagtccccctccaggcagaactctccccacgccttccaagagtgcagcctcaggcaaaaagcccccgggaaggcctttccagggacaggggaatgggacaagtccaggcccccaggggcagcccggttccacctccggaggtgggcagggtaggcatcccagggcacagggcagggggccagggtctcctgggccagctcagggcccatgaccctccttgctggggcgcagctatcactgcccttaaccacacctctggcagaaggcaaacccaacgcagcagtggctccgaggcaagtgctgccccccccccagcccaccctccctgggatcatacgcttctgcctgctgtgaagagccggggccacaggccccccactggtaacagagtccagggccttcaagatgcgctgggccggggacagacacctgctggcagaggatccacctccccacaaggagagagcaaacacctggcggcctccagccttggcaggaaggaggggaaatgtcagccagggtctcaccatagggctggacagcggctccccaaacctgccctgtctggtgctgggaggctccaagcgggcagggggccaaatcagaaggggctgtcacacaggtgcagacaggtcaggtaggggacactgagggctcctagggcaccgggcgccatgtcctccccagctgggctgagtccacagggcagtgccaggactaccttgggtctggaacccatcggtaaagagacatcagtgctgcaggttcgaatcttccatacgtcatccaacttttatcaagacaaacgtgttcaagtcttcaataggaaagtgcaaaagatgtacaaataaatgaaatctcttctaagaagtcgtctggaaaaggtggcgagggggcacgtccggcgtggttgtgggggcaacgctgtgtggaagaacacttgaattatgatgaggtggcacttctgggctctggcccagctgagctgggcctcgtcctccatgtgatggcattactaggtttccctttttgtcccaaggtggcgctggctcctaaaaaggtggcagcttttctctcccatgtgggtcgggcaggtggcccggcaggcgtggctgcaaaacgcaaatcagtgggttaagcaggtgggcagttatagggggcatcagggtggcacccaacagcctgtagctgcttctccacctatcacaaccaactatgatcggggtgccccccagccatgacctcccagccacaggctgccgggccaggccatgagctacacccagagtgccgagagcacccaggaagcagcagtgggcaggggcagccagccaggaagcccctctggagcctcctccagcaagacacggttcccacagggacagacacagcgtagtggaggctggtggccccagagaagaccagaatgaactggcagtttctctgaaataagccccctctcctggccaatagcccccacaaaaccctcagccaccctcctggtcctgggcaggaagtgagggtgtaagacaagatgtgatgtctgccaccagcaggacagcaggggcaggacagggctccaggcgggggcagcagtctctgacttccgctgggaacatgtgtgcaaatgagaacacatgtgcacacacaggagctcacccaagtccaccgaccccttcatgtcctgccaccccagcctcccagtggacagacacgctggccacaaggtggtcccagggccaagggggcaaggtagaggggctccaggcaggtgggtggctctcaaagccgccggaggcagtaaaagctccaggacttagggacgggagtcaagtgcaggggcagggctgactgtggccaggcctggtttgccagcaatggggtggcggggaggaacacagcacccagcagccctcacctcagctggaaatgagcgctgcaacacagggaagtctcgaggacggctagatatctgtcaaaaaaagaggagagccgggcttgcctgacgttggcagcagcaggcaggccgggcccggcgggcacccgtgtgcatgctgcccggagcggacgggcacctaccggtcacatagggccccaggggcatctggttgtagttgacaatccctcccggtccagggccccggaagttgggcccaaagttgttgctgtacatctgggaggagccgaaagcgccctggaggcaaggactcagcttcacaggtggtctcaggccccccacccagcctccacccaggggcacgccagggggctcgggccggggcacacaggccgagcctgacctgctggatggtggggtccccggcgcggttggtcaggcggctcaggatgctgcgctccgacatctgcagccgggcggccaccggggggatgcgggacagcatggatggcagccgggtcacgtcggccttcatgtcgctcagcagctcctccagctggttcaggactgtggtgggaggcggagggatggtaggatgcagggatggaggggtggagggatggaggagtggaaggatggagggatggaggggtggaggggtggaggggtggagcagtggaaggatggagggatggaaggatggagggatggaggggtggaggggtggagggatggaggagaggaggggtggaggggtggaaggatggaggggtggaaggatggagggatgatggagggatgatggagggataatggagggaagatggagggatggaggaatgatggagcgatggaaggatgatggaggggtggaaggacggacgaatggaggggtggaaggacggagggatggagggataatgtagggataatggagcgaagatggagggatggagggaaggtggagggatgggggaagat

SEQ ID NO: 12547 - DNA, 44867 bp, Homo sapiens
ccaccaggctcagctaatttttttgtactttttgtagagatggggttttgccatgttgcctgggctggtctgaacacctgcactccatcaatccacccacctcggcctctcaaagtgctgggactacaggcgtgagccactgcacccaatctactaagtcttattcattctttctaactatatattttttgtacccattaaccaccaccttcccctctgcctcccttaaaatataatttggtaagtgctatgctctgggacgtcccagcagcaataaaagaatgggagagaagtgctaaccccaaatgagggagagagtctgcccaaaaaaattactttggggaagtgaagaccaagttgagatgtgatgtgatgttagcaagaaaaaggcaggaagcaggggggtaggtgagagccagcagaggtctatgcaacgattcatatgtggaaaagaatacatggcatgttcagagaactgaaagaatcattgtggctggagcatggggtgggtgatgtggctagagaggtaaactgaggccaatttttgcatggcctcatacatcacagtgtggttttgactttatcctgaaggtaatggagtgtcattaagatgaaaaattcctattcttcctttcctttgcctcattttttgctcacattttgtagacacacacacaagtggctttaaatcctttcttgaacaaagtgaggacataaaccaacaaattcactaaataacataattacagctagctcaagtgatgaaaatccaacatcatacagtcatattaaaataacatacagccaaaaagaatatctacatatgcacagagtgtgcttgaaggataaaccagaaactggtaatagtggttgcttctgggaggaaacttgggtggctggggaacaggtatggaaggagagcttttactgtgtattcctttttaacactcgaattttacgccatttacatatctattagaaactaaataaaacataaatagccccaatctgggaaaaaaacaacaaatctatcactagttgtaggctccctcctgccccatttctcaaccagataatccattagaatgccagactagagtgacagcgtattcatataaaagtagaaagctcgaggaagtcctggagaagaaaaaataagcaagacttgatgatgggcagaatgagggacagaaacagaaagacaatccaaagcaaaccttcgcgtgtgctctcaggaaggtgtttacatgtgttcagtcttggctccatcgtctgtaatatagtaataatgacagcatttgcattatagggtagtagtgggagttacagatgctagatgctggttactaaaaggtccacaagacgtacttgataaggaaagtgacacacagaaaggctaagtaacctcaaagagattccaatctggtatggaggagacagataagtgaacaggcaatctcagcaggctgtgataaacgcctcagaggaagcactgggtgtgccacggaatgtgcgggaggcaccctgtcttagcctgggttccctaggaagaaagccggaggtaggttcttgagtcagcgagtgactgaggaataacctcaggtgaagactgtgagggagcgaggggagcatggggcggggaaaaagtgagacaaagatatgtgtttagctcaggagttggcacattttggccttcagacccaagctctatttctgtaaaagagtattttgtgaacacagctatagttctattgaaataagtcacattcatttaatcgatatattatctatggctacttttgcactatgaaggcagagttgagtgattgcaagagaccatatggcccacaaagcctaaaatacagactggttcttttcaggaagtttgcctcagcctgattccacggggagctctagagcaccaatgggatcatagagttggcccacgtgtaggcgaggcgcctggctcacctcaggacctgggcttggaagagaacttggggttcaggacacatccagcctgggaacatcaatttgggagtagtcagaataaggattttttttgtttgttttgttttttagacggagtcttgttctgttgtccaggctggagtgcaatggtgcaatctcagctcactacaacctccgcctccagggttcaagtgattctcctgcctcagcctcccgagtagctgggattacaggcctgcgccaccacacccagctaatttttgtatttttagtagacgggatttcaccatgttggccaggctggtcttgaactcctgacattgtgatccgcccacctcggcctcctaaagtgctgagattacagacgtgagccactgcgtctgggccagatggttttaatgactagataatgactttagagagaagggatcctagaactgaggcttggggcaatgtttatagttcaggatagaggaaaaggaagaggatctaggtagggagatctagaaggagaaacctgtgaaataggaaaaaatgaacagcaagtggtttcctagaagccaagtaaaggacacccaccttttaaggaggaaatgatcagctgtgacaaatgctcttagggaagtggtcagtttgggggcagctctggggctgtatagctgcacctaggagcccaaaaggagactgggcctatggtgggggagagaagcagcccaaatatgtaaatacatacacatgcgcacgtgcacacacacatatgcattcatgccatgcacatacagccacactgttgtctatttttttttttttttgagacggagtctcgctcgtcgcccaggctgaagtgcagtggtgcaatcttggctcactgcaacctccgcctcccaggttcaagtgattctcctgcctcagcctcctgagtagctgggactacaggcgcctgccaccacgtctggctaagttttgtatttttagtagagacggggtttcaccatatttgcaaactggtctcgaactcctgaccttgtgatccacccatctcaggctcccgaagtgctgggattacaggcatgagccactgcgcccagcccactgttgtctttatttgggacttacggacattagagattggagtctaggctgatgtacaaagaagaggtctgagaacatggaggttaatttttgacgagatcagtttcagtgaaattatatgagcaaaatatccagattggaatgagttcaagagagggaagaaattgagacagcaaagtacaaacaacattttttaggagttgtgctgaaaagtgaaacagaaatggagggggagctagagaatggcatagagtcaggagaggggttttaagatggaacaaattgcagcatgtttgcatcacggtagtggaaaagatctactagacagggaaagactgatgacgcaggaagggacactctactagacattcttgagttgatgaaaggatatggcacttgcatactagacattctttgagttgacaaatggatatggcacttggagcaaagaggaggttgacctctgggagtgtgggcagtttgtccacagtaacaggagacaacgcagagcttgtgcgcagataaaagtggttggtggatatgaaaaatctactgatggcttctattttctcgtgaaatgggaagcaagaccaccagctgaggagaatatgggggaggagatggaagagctttgaggaagaagacaatgtcaagtggtcattcagaggagtggttgggtgaatggctcatttttccatctcccatagcatcttcattacctcagcaagtatgttctcagcatctgttatgttccaggcactttgataaacatcaaatgcttcttgaaagaagatgtggctgtagagtaccttcaaagacaacccaaactttttttttttttttttgagatagagtctcactctgcccaggctggagtgcagtggtgggatcctagctcccattggccttgaattcctgggttcaagcattcctccagcctcaggctctggagtagccaggactacagatgcgtgccaccatgctcagctaatttttgtattttttgtagagatggggtctcactatattgcctaggctggtcttgaactcctggactcaagaaatcctcccaccctgtgtcagcctcccaaagtgtcaggatcacaagtgtgagccactatgcctggcattccaaacattttttagatttggagctgaatgcagcatgggcaggttgtcagggttgaagcactggtgatccagatctggaaggagccagaagcctctaaaagaggccactgcaggagcctcctgacctggtttctgggaatccatctgcttcaatgattttcctaaaacacaaatctgatcccatcacatctttttttttaaaactccttcagtgaagatagttaagaacttgtggcagactgcttctagagaacaaaacaggaacactggggtacagaaataagagatttacttttcatggatacccttgtgtagtgtttggggaaaaattataaccatgtacatatattcactattcaaaggaaggtcaaaagcctctcaaaagtttctacagctttccactatccctaggagaaagaaaagcctttacttggtctataatgctcttcaccgtatggccctacccaactcttcaacctaatctcatgttaatctcgcttcctgtggcccttgtggacttggctagactggccttccaattcagctgtgccggcctctttgggcttgtacacaggcttttccttctgcctcacttttaaaaaaaaattattattactatttttattttatttatttattctttgagaaggagtctcgctctgtcgcccaggctggaatgcagtggtgcaatcttggctcactgcaacctccacctcccaggttcaagctattctcctgcctcagcctcctgagtagctgggactacaggcacccaccaccacgcccagctaatttttgtatttttagtagagacggggtttcaccatattggcgaggctggtcttgaactcctgaccttgtgatccgcctgcctcggcctcccaaaatgttgggattacaggtgtgagccactgcgcccggcctactattattatttttataagaaacggggtctcgctatgttacccaagttggtctcgaactgttgggctcaagcatgtctcactttcttatccccgcctctccctttcccatctttgccgtctacttaggtctctgcttcaaagttactttttcagggcgggcttcccgcctgaattcccaatcaccaccggacttgggtcagtccccgcgctgggcactcactgccccggcaccagcatctctgcagcaagcacccataacaaccataaagtgtaatgagctgctcagtgtgcctccctacatcgttagtccgaggagagggtccctcggtgcccagcacagtgcgtggcacagtcggtgctcagggagcgatagctagatgaaaccgtacttttcgggatcctagtccatccaaagcagccgccttcggggcaggtgtggggaggagggaggccgacgaggagccaacgccgcgcgaccctccgcacttccgtcttggaggccagggtggcgctgccgccgtccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggktgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattccccgaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagyctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaactgtaaagtgagagacttagggtcagataagcttggagacaccgcatactgtatagcagtgatcacagtgcgagtttacttgctaaacactcccaggattcttgcgttaaatgacttggtttaatcagcrtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctrgggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttttttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgarccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagcttagagctggttttattaggttgactctgaaggttattagaagtcaaagctttaaacaaaagctgtgttattagagtagcagttgtttttctacacgtatttgactaaagccattcagtgatccaagaaatgtttgttttgatcctatttaaacctgacgagaaccttctgaagtcctgtgacagagaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccractgccttttacttctttgttgttattgagaacctgtcaatggtgtgacatacarctgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcawcaggaaaagatccatatacctgagtgatatttaatacagaattcttgagcagaggatgagttacctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattaygtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaaggtaatactggatttacctttaaagcttaaaagtcttaaccagtttaatttcttctccctcccacctctacacagatgtgtaattcccttttgagtacagaagtttacattgtatgtgatttcagcatgaaactctcaaggtattgttactgaaatatgccttcagttgaaaaatcagaattatattgttgtttgctaaaaaaaataatttgaagaactacttcttcgttgaagcttgtcaattctgcyaaggcagcatgatacgagtccagagagctgttgtttttacacagtaatgagtgtgaaagtggtaaaggcaactcgattagggcattaagccagatggcatgtatgtgtgcatctgggacttactatgtatagaagtgagaaggaaatgaacatctattgtgtatactggtttccaggccgttcatcagtgccatatggcctaggaggagcctgagaagtgggtttctgggtcctcccaagctttcactggcacagcttcgcttacatctatttgctgttttggggttttgtacaaacattcatttaaggaaaatgttttgctgctttaaaaaggtggggatggaaaactactgatctagtataatggcagtggcccaaatttggagaggttgctgaaaagtggctttaatctgagttatgagagcagatctgcttttggctttagactttactggcctgaaagctgagggtcacactgacagctggctctggtctggggctgccctggcaagattctgggctaaytgggtcatgtttggatcttagcttcccctctcaccagctttgtgaacatgggcaaattaacctcttcaaaatgtggattccttttctgtaaaatggagacaataacaacacctacctctctaggttgttaggaagattaaagaaactaaaagtcagtgaagtgtttccctgacttcctgacacatagaaaggaatcagttaggaattagaatggttttgatcttacagtttgctgtttatttattcatcatccatcaaatttgcattgaatgctcactgcagtcagaccctcactggtgctggtgatgcatgtgatgagcaagaccagagaagtcattgcccacatggaggttacctgtgggggaggcaaacaacaaacatgaaacaaaacgagacgtctgtcagaagctgtgaagaaaccaagtggagtgaggacagagtgactggggaaagccactttgggcaggtggtcggggagtctcccaagagaggccatttgagctgagaggccagtcacagcgagagtggaatgagaagtgcggaggcgcagggctacgaaggcgtggttggtccgggaatggaggggaggccggcatagctaaggcagagtgactgagggagatggtcagagagcgggggtggtagccacagccaggttctacccagtcgctgggccgcagcaagaagctaggagtgtactcggaggagtgggaagccaccgaaaagttgaagtgtgggagtgrtgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagtaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctkgcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccarttcaaggtcaaaagagagaacttttgtaacatccacgtcagtctagttccccaggtaagtaagacattgaaagttttactttgggggagatggagargagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctrgggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatttaagcaggcctccatacacttggagaaagcatctgataggtaagagaccaaacaacagaaagaaagaaacttacagggaactgaggcgctacaagcagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattrttgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaaraaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgkggagaagtagcacaccagcaagatcagttaagagttgaagagcggttgtttctagggattggaaaggggagagtgggtgagggccgatactgcttacaagctcggttagaaccatttgattctaaaatgcatgcaygtgtaactttgacaaacataaaagctaaattacacaagtgaccaaatgatctatttccttattaaaagaggttcaaggaaaagtcatacttgaaaattccttatcagagggaaactaactttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgwccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtctcgctgtgtcgcccaggctggagtgcagtggcgcgatctttttggctcactgtgacctccacctcccaggttcaagcgattctcctacctcagcttcccgagtagcttggattacaggtgtgcaccaccactcctggctaatttttgtatttttagtagagatggggtttcattatgttggccaggctggtctcaaagtcctgacctcaggtgatccacctgcctcagcctcccaaagtgctgggattacaggtgtgagggcgcccggccttaaaaatattcactattaaaaatgtaacaagtatttccacatttaagtttaagtttcagattttttgctttttttttgagatggagttttcactttttcatccaggctggagtgaagtggagcaatctcagctcagtggaacctccacctgctgggttcaagtgattctcctgcctcagcctcccgaatagctgggattataggcacctgccacgatgccgagctaatttttgtatttttagtagaaatggtgttttgccatgcgggccaagttggtctggaactcctgacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctrgtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctcttttttttttttttttttttttgagatggagtcttgatctgttgctcagactgtagtgcagtggcatgatcttggctcactgccatctctgtctcccgtgttcaagcgattctcctgcctcagcctcctgagtagctggggctacaggcatgcaccaccacacctggctaatttttgtatttttagtagagacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaaggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaatrattccaatatgcagctgagtttgagaaccactgttcctagttaagccattcataggttcgtggacatgatttttttaaagctacatttgtgrtttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatgggctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaasgtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcytggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggtttttttycccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctgagctggtggaatggtggggcatggccctgcttgtctgtgggtggcagtagagtgtcatggttaagakcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctacttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacrggccccatgtagctgtcmccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcasatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccrgctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggartttaatgattttgaaggaaactgttgtattttaaaacctcatatttaaaaaatgtttaagttattaaatatattaagwtgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcrctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgttatttataatagtaaaacattagcaagaatttctggttcactagaacagttgaatattacggaggtgtacaccttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcrtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcrcagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagayaatgtatgtaaatagtctctagtagtgcctggaaaatagggaaatgctcagataatatcagctcttygcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggmctccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccrccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgyatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcrtaacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattarttcatgggatccccagccatagtcctgggagaactgctgggttggagcactggttggcttaaccgtatccaaagattttccaggctggcgtaccttgcgttagatttcatgccgagggcatgtggcattctcagcccgctgtactgttaggcacatggaggagggacgatgcctttaatcacctttgaattcccagcccagggtgacagggatgtaaagggaagggcacttatttacgtttttcagcagtcagcaaatgtgaatgcgtactatatgctgggactgcccttgtcactgaggacaccgtgctaaatgagacggacaaagttcttgatctcacggcacttagacagcatcactgtgtttgttgacctgaaattgaactttgctgatactaaggcctcaggagtggaccagcaaatgttttgcagcatggggctttggggtcaggaggaacagggcacagagagcctggaatcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgrtgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcaycctgtgagataaagttctttacatacagcccgtttgttttgccagggaaactctatggagacgcagactacttggaagagaggcaccgccaccgatttgaggtgaggattccagsttgctggtactctggaaagatagtgagctgagagaccagcagaattatttttcatgcctcaacaggtgaatccagtctggaaaaagtgtttggaagaacaaggcttgaagtttgtyggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtcyggactctagraacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacartgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagyccttyctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggcactggacgtgggtaccccatatacacagccagtgagcagtgggccagactgtcttcaccagcagaactgcttgttatggtactttgaacgtggctgattgagcataattctaacctcttctcccacctggtggtaccaggagattgtcttcattttaaattttatttatttatttatttatttttttgagtcagggtctcactctgttgcccaggctggagtgcagtggcacaagcacggcttgctgcagacctcctgggctcataagatcctcccacctcagccttccaagtagctgggactacaggttcacatcaccacgcccagctaattaaattttttttttttttaatagacagggtctcgctgtgttggccaggctggtcttgaacgcctggcctcaggcgatcctcccatagtgcagggattataggcatgagccattgcacctggtcaatagtcttttttttgagatggagtctcacactgttgcctgggctggagtacagtggcgtgatcttggctcactgccacctccacctcgcaggttcaagtgattctgtttgcctcaccttcccaagtagctgggattacaggtgcctgccaccacgcccatctaattgttttgtatttttagtagagatggggtttcactatgttggctaggctggccgtgatctgctcatctcagcgtcccaaagtgctgggattacaggcgtgagccaccacgtctggcccgttttttttcaaacattccccaaactgagggtctgacacgcccgttgttgacatcatggtcccccacaatggctgggtgtgtgggtggtgtgaaaaagcctcccagtaattaagttcctgcccctatgtttaagatcactttggctgatcacttgtcaagtgctggccacataatgtaaggtttctgaaaaaagagatcccagatggctctccagagcttgcaaagctcgagcagccccgccacgctggctgtggcagacaggatagggctgaagctggatttacaggagggcaacctgtgcccagtgtttactgacccgtccccggaggcttctccctcatggggaggaaagctggtcacattcctcgttcctttcttaatgtgacctaacaataggcacagctatgtgtaacttcccttcagtaacttccttcagtccagggaacttcccttcagtccaggggatctgggcagttcttagcagtctggagcagctgggctgaagcctgacttcacccttcctttgtagaaatctgctcttttcccccgaaaaacatttccgaggattgtggtgcctggactagcatttagcatggtacctggaccgtggaaggtgctcagaaatgccactcctccttcttgagtaacacatttgtgtagttttcaaacagtcttggtgaccttggggcagctcggggggtgagcagcaggagtttggtaacctgccaccatataggtgtctgtgatcacattggtccctaaccagcatgaatggcagccgaggcaggggttgtgtgctctttgctaagtgggaaaaccaggtctcagagcagttgtgatcacccagaaaatgtcacctggctggtgagtggaggggctgggggttccaaagttctcatctgtgtctgctgtggatgtggccagggtcttcaagttttaggggatcaactgaagtgtgttctgtggaacactagtcctgtgaaatgccctgttcaacaaggtttggtgattttctggtggctcagaccccaaatttaggagtatccttaattgtctcaccagcaggtatttattgggtgtctaccatatgccagccatacccaaacccctgtcccccagagcagttattcagtgggggaagcaccaaatataagctacagagtgtggtagttcatagatggagaccaagggtggaagtgagcaggggagtggcagtgctgggaggtggtgtctttaaaatagggtgggtgggaaattaagcatggacttgaaggtgaagaggaaaggaaataggccgctatgtagcgcagaggccccgaggcaggagtgcaaatgaaacaagttggtgggcgtggctgaagtggcttacataaggggcggaagacattgaggttgggtgggctaggtggtggagaaccatgtaggccatcaagtttgggctttgctcttgaagaatttggagggctatgggtgcaggtgcggcatgagtgtgatcagactctggctttgcagcctctggctcagctggtggagacagcaggagaaacggccagaggcaggaagcagctggaggagtctggttttttttgtttgttttaagctaacggtcttactggaccagaggggtcttggaaaggaactgagacccttagtgtgaggtgctgctctgtgccacagctggcgtagacacagggcactggcccgatggtgacaaaatgcccctggccattgtcactgtcttatagatgaagaaactgaagcacagaggcatagcactttgccccacggtccctggtctttaagacagagctggactggagtctgaggggctgggctccctgcccttgcaggtctgtcctctgcctcctggacagaggtgggctgggcctgggactcatgaccctgcagcatctgaccggctgacccagtgtcctagaaagaaccattcttgtcccaggtgcatgtaatttattaatggagctttgacagtcacaagttccagcaagtcaggggtgggggctgcagggtggcctcttgccctgtaaccacagtcatcaaatatgcctcgccatctttgaggggctttcctgagatgacagattcctttctggcactgtgtagccaactggagtcacagacctcagcctgggccaaatgagcattttagggagaaggacaatcccttatagcttagccctaggggagctctgggcagggttttacacattctttctgaaagtaaggtcatttggggacagggctgagagcagtttcttggctacacagatgggtctgtcagggttgaagccacatgggtgcctgctcatgtgccatgttgaaggagtccctgtccgcctctcagcagcccgcatgggctttactggttggccttacactcaaacaggaaatccctgggtctcaggtggagagtgccgtgccgtcctgcctgctccccagggccctcacaggacacagcaggtgcaggacacaggcccgtgctgctgcagctgctgctggagctgctccttctccatcatcagcgccttcatcttctcttccagcttgcccagctccaccagccacctctgaggggacatgggaaaagcatgtggccaagcccgcctggtctcgggcctgtccgtcctccacctggggccaaactgagggaggaaggcaaagcccaggagcctgagagctttctcagctaggggaaaagtcaggcccctcggcctgctgccaccttcaaccgtgtcagcctgagggaagctgccggctgccagccatggaagggagcctcctccgtgctgggcaggccatgtgcctcctcactgttggtcccttgtcctccattctctgtttccctcttgaaaaagctcttccttgggactgtgtcttgccccctctgccgctttagggcctcccctaaaatgcagtgtatagtctttggggttttctggtgacatctcaacattccagtctctctgctccctcactcaagatcgagtgtgttaactgcccaagtagagggtgaggggtttcaggcacccctgaagggaggatactgcataggatttttttttttttgagatggagtctcggtctgtcgcccaggctggagtgcagtggcgcgatctcggctcactgcaacctccgcttcccagattcgatcgattctcctgcctcaccctctcgagtatttggaactacaggcgcccgccaccatgcccagctaatttttgtatttttagtagagacgagggttcaccatgttggccaggctggtctcgaactcctgaccttgtgatctgttcgcctcatcctcccaaagtgctgggattacaggcgtgagccactgcgcctggccactgcatagatttttaaaaggagagagcttgggcctcttccttcccaccagccacctacccgcggagtatgggatgtggtgtgattgtattccaaccccttgggttcaacggggtgatgcaggacccagggaaccatggtggcttgccctgggctgctcagtgggtggctgaaggggtctggggtcagctccgctccaccccacccactggcctcagcttccgtacctgcctgcaccactcctggatggcgctggcagacagcgggccctggatgctcccgtcgcgccgcagaaacacctccccctggtctgtctggtagagttgcggctggctctgggccttgggggtgtgcacggtcaggcggatcaccttggtaggggcaacagcagctctggaggcgccgcccctcacggtcggcagcccccatcctgccaggctgctcagcattgctcactgattccttagggcaggccagcagggctggcacaggggccatccccagcctcttctcctgtggcccccagtcccgtccctgccccagcactgcctggcaggagtgcaggccatcgtcttactgagtgatgacagatgacaggcccagaggccctcctgtcctgcaggctcaccttgagggggacgctggtctccgaggtactgatcacagggatgaaggtgagagtgtaggcatcgggaaagatctgaggcttgaagccctgcaggatggagtccaccagcaggcgtgcgcggtcctcgtcacggtggctgcagcggatgccctgcaccaggccgctgtcctctactcccacgagcaggctgccgccctcgctgttgaggaaggcgcacacgtagcgccgcacgtggtgcttgaaggccaggctgaggtactcgccgctaccccgcttgaactccatattgcgggtctcgctgcccaggaaggcaccctggaagagctggtccttgcccacgatctgctggtgcacaatggcactgtcggagcacacgccgctgggccggccctggcagctctgcagctgctgggcctggggcctatcaggcagcgtgtgtgtaggccaggtgggcagcgggacaccagagcctggactggggccagggctcaggccactgtcctcctcctcctcctccttctcctagggtggtagtcaagaatgaatgtatgggtccagccaggaaatgggagccctgaccctgagaaggactgcaagaacccccagtcaggcccctgctgcagcctgactcttacggacatcctgatgcccctcaccaggccgaggggcccagttctgcccaccctcctgcagccgaggcaggaaaccctgctggatcgagggttccagtcagcgctcctttccctgccaagctgggcccttcccaggtgagctgtgggatgcctggtggggaagaagagatttctgcttctcagggctgggtgctgggacatgtgtgggcccattttttcttacttgggttgcagacaggcccctgaggcccagaaccagatcattccagcaggtatctcagcaccctgtgacagagctgcag

SEQ ID NO: 12548 - DNA, 23150 bp, Homo sapiens
acataataaagtcaatggaaagtttctctatttcaggaatacaactatattttagaaggttgatgcttttgcaaatcgtattaacagagccgggcgcggtggctcacgcttgtaatcccagcactttgggaggccgaggcgggaggatcacgaggtcaggagatcgagatcacggtgaaaccccgtctctactaaaaataacaaaaaaattagccgggcgtggtggcaggcgcctgtagtcccagctacccggagaggctgaggcaggagaatggcgtgaacccgggaggcggagcttgcagtgagccgagatcgcgccactgcaccccagcctgggcgacagggcgagactccgtctcagaaaacaaacgaacaaaaaaaacagaacaaaggctgaagaaaggaactaaagactctagaactagttatttaaaaagccaaagctatcactattttacattcctaaatttaaatgattaaacttaagagaaaacagataatctcttaatgtttctttccggcaaatttgaagtttgcttacagaggaaaaataatagtttagtaaaaaatttaaggagctgactctaaagccacaatgattgggtttgaatgccagctccagctgtgtgacctcaggtaaattaaggtgtgcttccgtttcctcatctgtaagatgggggaaacaacatacttaccgcataggattttagtgatgaacacatcttgtatcttagtagtttgtttgattgtgtaacagttccctttatataaaggggacaggacatacatttatattttaaatgaaaaataatgaaaatattcacttttaaaatctttcctttggggtatatttcctctgagataacctgggataccaaccttaatatgcaatctgccggcaaataatccaagcagctaaattataacttgccccactgcttccttcaagagagcagctatatgtcttaaataggtcaaatactgctacagtgaaagtttccataatactaccaccataccagtgaacaatctattgcaagtaatatctataatgagattctggtaccataaggccgggcgcagtggctcacgcctgtaatcccagcactttgggaggccgaggcaggtggatcacctgaggttgggagttcgaaactagcctgaccaatatggaggaaccccatctctactaaaaatacaaaattagctgggcatggtggcgcatgtctgtaataccagctactctggagcctggggcaggagaatcacttgaacctgggaggtggaggttgcggtgagccgagattgtgccattgcactccagcctgggcaacaagagggaaacttcgtctcaaaaaaaaaaaaaaaaaaaagattctggtaccataaaatagttgagaatttttggagttctttttgttttctgagacagagtttctgctcttgtcgccaaggctggagtgcaatggcgcgatcttggctcaccgcaacctctgcctcccaggttcaagtgattctcctgcctcagcctcctgagtagctggggttacagatgcctgccaccacacccagctaattttttgtatttttgtagagacagtgtttcaccatgttggccaggctggtctcgaactcctgacctcaggtgatccgcatcggcctcccaaagtgctgggattacaggtgtgagccactgtgctgggcttgaagttcattttaacgtaagaatttacaaaatttgggctgggcgcggtggcttactatgggaggccgaggcgggtggatcactcaaggttcaggagttcaagaccagcctggccaacatggtgaaaccccgtctctactaacaatacaaaaattagccaagcgtggtggcacttgcctgtagtctcagctacttggcaggctcaggcacgagaatcacttgaacctgggaagtggaggttgcagtgggctgagatcctgccactgcactctagtctgggcaacagagtgagactctgtctccccccaccaaaaaaaaagaaaaaaagtatactttttcatagtaaagtataataagtactttatacatattcataaatattactgagatgaatttctgaaaatgttcaccaattgccaggaagaaaccagaatttatttcaaatttatttcaatttggattaaaaaaactaatctaaattcctatgacagccagatctgtttcctctggtttcactgaatgccatatcttactgaattatcaaatgaagcatattcgttttcctatgtgtataaatgagatttaaaaatcactgactttttgaccgggcacggtggctcatgcctgtaatcctggcactttgggaggctgaggcgggtggatcacgaggtcaggagatcgagatcatcctggccaacatggtgaaaccccgtgtctactaaaatacaaaaaattatcccggggggtgttggcaggcgcctgtaatcccagctactcaggaggatgaggcaggggaatcgcttgaacccaggaggcggaggttgcaatgcgccgagattgcgccactgcactccagcctggcgacagagcaagactctgtcccaaaagaaagaaagaaagaaaaaaaaatcactgacttttcaagccagtaatggcatgttggggaaaaagaaattgactttgttataacttttatatcaaataatcttaataaataaggttaagatcaggttactagttttagaaacctttccaaaagttctgttgaaaaacaacaataggctgggcatggtggctcacgcctgtaatcccagcactttgggaggccgaggtgggcagatcacctgaggtcaggagttcgagaccagcctggccaacatggagaaacatcatctctactaaaaatacaaaattatccgggcatggtggtgcatgcctgtaatcacagctactcaggaggctgaggcaggagaatcgcttgaacccaggaggtggaggttgcggtgagctgagatcatgccattgcactccagcctgggctacagagtgagactccgtctcaaaaaaaaaaaaaaaaagaatataattttaggccatgcgcattggctcatgcctgtaatcccagcactttgggaggccgaggtggccagatcatctgaggtcaagggtttgatctcagctcactgcaacctctgccttccaggttcaagcgattctcttgcctcagcctcccgagtagctgggactacaagcgcctgccaccacgcctggctaatttttgtatttttagtagaggcggggttttaccatgttggccaggctggtctggaactcctgacctcaaatgatccacccaccttggcctcccaaagtgttgggattacaggtgtgagccaccccgcccagcctatattcttaatagagaatatatacactcctcctccaggtatcatgtttttttcattgtattgtgatgtctaaatataagtgattttaaattcctgacatttaagtatattattggtaacagattcacactttggccaggtgtggtgacccacacctgtaattcccacactttgggaggtgaaggcaagaggatcacttgagtctaggagtttaagactagctgcagcaatagagtgagaccctgtctctacaaaaaaataaaaaaaattatctgggtgtagttgcacacacctgcagtcccagctactcaggaggctgagaggggagatgatcgcttgagtctgggaggttgaggctgcagggagttgtggttgcaacactgtactccagcctgggcaacagagggagactctgtctcaacaaacaaacaaacaaagaaaaaaccccacagctatctagggaaaaagtaaagcaaccagcatatagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggattttttttttttttaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgrctctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcrgctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatytcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccsgtggtttgcaagtgcgcaggcgcgcgcccccttccgcgcatgagcagtgctgctcccaacccgccagtcgcggtctccsgcgccagctacgccgctgccgctgtcactatggcccattacaaagtgaggggggcgcggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggaggtacttggagaagtcgggggtgctggacacgctgaccaagggtgagcctgggctaggagagggtacctcgtgccctcgtcgtgctccccggcgctgccccgttccccagcgggccgtagcgtggggaaggaggggaaacagatggggcccgtccggggtccagcgaggtgggcctcggggttcagcagggacctggctgctggacgccgcccgggtggggtagcctagctccgctacccttctccgcaccgggagtgaaactcttgcagctgttgcaaagtctcttcaacttccgttgctttgcctccagcagccgcagtggacatgtttgccaaggaccttcagatcccaattcctcccaccttacggtttttatggagtcctcagaatcttgttaagaaagtttccctccaacaaagagcaactggaaaaatgaccgaatttccaagtgggctatgaagtagctgagtgagcctaatccccaaagtaggagattcatagcgaatttggctgtggcttttcagcccccattccttagtctgtctgtgtcaattcttattttgtgtatatttcataaagtagaattacagcttaaagagctcgagggcatatcaaggtggttacattgttttcactttttaaaatgaaagcttactgttaacgctgtatctcttcattcgtggcttcaagatctaagttaagtagatgagtaaagtgttggaaacaggaggatttcaaggggtagggtacagtttactttattggcttagcactaatttgaatgcctgctatgtgtcactcaactcactgggatattcaagggtgtagaatggaattgttcgcagggatgaggacttgggtcatatgaaactaggaagtttgggaagtgggaaataaattggtaactgccctttggacagaagcaaagtttagaggaaaattctaggagcataactcctgggtcttagaagaaagaaggctagtaattttgaattgctacctatttggggttcagataatagtttacctctttgcaaataaacttcagcaagtcttaagggactactctgtgaaagtactgtgctatgttgtctctgaaagtgtcacagatgctttgaatgtcattccgtctaaaaactccttacgttcatttctttcatttaataattttactcaggtgtctgttctgcacactggagataagcaggggaggataaaagtctcggctctcataagcttatatcctagttgagggagagaaatacataaataaatatgtagtgtcagctagtggtaagtggtacagataaaaatacagcaaagttagggataaagagtaacaggtgaggccaggcacgtggctcatgcctgtaatctcagcactttgggaggctgaggtgggtggactgctagaggccaggagctcaagaccagcctgggcaacatggcaaaactcccatctcttaaaaaaaaaaaaaaattgctgggcatggtgtgtgcctgtaatctagctactgtggaggctgaggtgagagaatcacctgagcccaggaggtcaaggctgcagtgagttgtgattgtgccactgggcaacagtgacactctgtctccaaaaaaaaaaaaaaaaaaaagtgacaggtgggatgtgtgtgtcattttatatagggtgatggggggaaggcctttcttaagaagtaacttttgaccagaaacctgaaagaaacagagtttcaggaagtctaaggaggccagagtggttggatggagcaagtgaaagactgaatggtaaaaggcagaaaaatgacagttgtaggcggtaactgactacacagaagatgttgcccaggctggagtgcagcggcatgatctcggctcactgcaacctccacctccgggttcaagcgattgtgttgcctcagccttccaagtagctgggattacaggcatgtgccaccatgcttagctaattttttgtatttttagtagagaggcggtttcaccacatgggccaggctggtcttgaactccttacctcaggtgatccgctcacctcagccccgcagagtgctgggattacaggtgtgagccaccgccctccactagaatttaacctctcaatctccttagatttccaggctcctaaataacatcagccaacacagtattgatgtgatttattaaaaatttgattttcagctccaaacataggtgctttacacaattctatttgtttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctatttgtttttactttttattttttttgagacagagtctcactctgtcacccaggaatgcctggcctcaagtgatccttctgccttagcttccccaagtgttgacgttacaggcgtgacccactgtgcccagcctcacaaatttaatttacatatatatattttttcgagacaaggtctctgtcgcccagactggagtgcagtggtgcagtcatgtctcagtgcagtcttaatctcccaggttcaagcaattctcccacctcaggcacccaagtagctgagactacaggcacgcaccaccatgtccggctgatttttaatttttttttttttttttttttgagacggagtcttgctctgtcacccaggctggagtgcagtggtgcgatctctgctcactgcaagctccgcctcccgggttcacaccattctcctgcctcagcctcccaagtagctgggactrcaggtgcctgccaccatgcccggctaattttttttgtatttttagtagagacggggtttcaccatgttagccaggatggtctcaatctcttgacctcatgatctgcctgcctcggcctaccaaagtgctgggattataggcgtgagccatcatgcctggccaattttttttttttttgtagagttggggtgttgcccaggttgatctcaaactcctgggctcaagmaatcctcctgtcttggcctctcaaagtgctggaatttcaggaatgagccactttggcctaaatttttacagcttatttccaagatgatttgaaatagtttataacattaaaacactatgaaaggatggctaaagatgataaatcatttggaagctgaagcattttagctattttgagcgctatatcaacctctaaaaatcctggctgcgaaggcaaaaaggggagcatgattgggtatagagttcttgtctgattacaaggaagtgcatttcatctatagaacagcacaggaaactttgtatttacagtatcttctgcaactatcaacctttcaagtaccagtgacaaatgagaagctgaaagaaatggggtgggggaataagaggaggagagagtagagtattaatattcatgtcttataaaatgaggatttggccaggtgtggtggctcacacctgtaatcccagaactttgggaggctgaggtgggtggatcacctgaggctgggagttcgagactagcctgaccaacacagagaaaccccgtctctactaaaaatacaaaattagccgggcatggtggcacatgcctgttatcccagctactagagaggctgaggcaggagaatcgcttgaacctgggaggcgggggttgtggtgagccaagattatgccattgcactccagcctgggcaacaagagcaaaactctatctcaaaaaaaaaaacaaaaaaaaaaaaccaaatgaatttctcaaaaaatagtgattttttcatactgtatattattttggtaagttattaaaactctaaaagaacaaaagggaagtatgtaagttggtttacaacaggacttaacttggggtctagatatctatcactgtttttttgtttgtttgttttgtttttttgtttttgagacagagtcttgctccatcgcccaggctggagtgcagtggcacgatctcggctcactgcaagctccgcctcctgggttgacgccattctcctgcctcagcctcctgagtagctgggactacagccgcccgccaccacgcctggctcattttttgtattttttagtagagacggggtttcactgtgttagccaggatggtcttgatctcctgacttcgtgatctgcccgccttggcctcccaaagtgctgggattacaggtgtgagccactgcgcccagccacattttttttgtgtgtgtttactttttttgcttttattagatttttcaaagggttccatgcacaaaaaggccaaccactgatttagagttttttatctaagtagtaaattctaggaggaatttgttccatagatgaagagcaaggcagtgctcatatgagtgattagatatgaaaccactcaagtatatcttattttaatgttgatttgagcatgttgactactggtaaagtttttggttggtggttatttagcaaaacaaacttaatttttaagaccatttttgaattcagagcttcttccggtaattaccatagtcctgttgattctttcctaaattctcgaatttctttcttctcactgttctctcactcccatcactctactgcaggttgctgtctttttaaactggattaccacatcagccttttaactgttcttcctgtctttatccttgtcccactccagctggtccacatagcagttaagagtggatcctgtcactcccttcctttaaactktttaattatgtgccaaccaaatttgcatgactctccctaatctggccatgaccacctttccagcttcctttcctgccaaattacatctccagccatacttgaattttcagttcctcaatacattgttttcttgctcctgggccttcccattttatctgaaacactcaacccctaggtatcaggtctttgccttcctttaggaagccttccctgatgtcctaggtttgcttaggtgttcttccagtgtgctactgcaacccattatccagtattcctgcttgataccctctgtctagttccttgcatatcttttatgcttgactgtaaatttgttgagaacagggaccttgtctgtcttgttcagcattgtatagtctttgcaatgtgctcagcgtatagttggcacctaatatttactgggtaatggaacataatttcagccattcaaatttaatacgtcaattgttgctttttctgctttttgatttgcagtgttggtagccttatatgaagaaccagakaaacctaacagtgctttggagtatcctttcaagtcagaaaaaggctttattttgaaactcttatttttttagatagataataacctttaaaatacttctgaatattgagaaagttacttttttttttttttttttgagacggagtcttgtactgtcacctggtggggaatgcagtggcgcaatcttggcttactgcaacctccgcctcctggcttcaagcgattctcctgcctcacgtctcccaagtagctgggattacaggtgcccaccatcacacccagctaattttttttatttttagtagagacggggtttcactatgttcatcacgttggtctcaaactcctgacctcgtgatgtgcccacctcagcctcccaaagtgctgggattacaggcgtgagcaaccgcacctggccaagaaagttagtttcacttgagtttttggatggtgatctctgggtagatattggtggtaaagtgggtgactctggtcagggatattgatactactctgtgctatttcattagtttcattcatgtctaagaagtaagttcttaacattgataatagttttttaaagcatcacttaggagctgctactccagaaaatccagaaatagagctgcttcgcctagaactggccgaaatgaaagagaagtatgaagctattgtagaagaaaataaaaaactgaaagcaaaggtaaatttttaaaaagaattcatattcaaataattttacctgtaataattgtatgatgaaaacctcactgaaatggacaggaggggagggaggtgggtgaatatcaatttgaattaattacaatgtaaggccaaagttatgccctgtcaagaaaaccacaagacgggcctggcacggtggcttacgcctgtaatcccagcactttgggaggccgaggtgggtagatcacraggtcaagagttcgagaccagcctggtcaacatggtgaaaccctgtctctactaagaatacaaaaattagccgggcatggtggcatgtgcccataatcccagctactcgggaggctgaggcaggagaatcgcttgaacccggcagatggaagttccagtgagccaagatcgtgccactgygctccagcctgggtgacagaacaagacttcatctaggggggttaaaaaaaaaaaaagaaaaccgcaagacatactggaaataggacaagcaaagaagcaaagtgtggtcaagaagaggttctggctgggtgcggtggctcacgcctataatcccagcactttgggaggctgaggtgggcagatcacctgcggtcaggtgttccagatcagcctggccagcatggagaaaccccgtctctactgaaaatacaaaattagccaggcttggtggtgcatgcctgtaatctcagctacttgggaggctgaggcaggagaattgcttgaacccgggaggtggaagttgcagtgagccgagactgtgccactgcactccagcctgggcaacaagaatgaaactctgtctcaaaaaaaaaaaaaaaaaaaaaaaaaaaagaggttcttaggaacctgtattactaaaaggatgagaatattggttaatgttctttataagtaaatggtcagttctgaggttcttaagcagttgattttaagtaggccaatatggggcgactgctttgtaaatggcacttcttagaatttgtatggttcatagtttgcaaggccatatgtagcggccctctgtaaatttgttaggacttaattttatctagtgctaaagttttttctttctttttttgagacaggttctctgttacccaggcttgtgtgcagtggtgcagtcatgtctcactgcagccttgacttcccaggctcaagtaatccccccacctctgcctcctgagtagctgggactgcaggcatttgccaccatgctcggctaatttttaaactttttgtagaaatggggtcccattatgttgccctggctggtctcaaactcatgactcaaacgttcctcctggcctggcctcccgaagtgttgggattataggcatgagccacctcacccagccagttttttcttttttcaaagtcctgtgagaattttcatgaacttcaaattagtcaactcttaagtctttcaggtcttaccacattcttaatcacataatgtattttacattactctaagtatttctcataatatattttatcttctcaacaactttgtgagataagtgaaacaagtacacaagccactttataggtgaggaaacgaaagcacagtgaagtctaataagcttctcaactccaacaggtagttggcagaaccctaatgttagcctagtgttcttgcaaggaaccacacttagcataaaagaaaatgcagttattttaaattatccaagattccacaatgtgtagtgctagttaactctttggaaccttttaactcaaagacattagtagttgtttattggctggttaagttaagacatgtcacttaactctttatctacttttcagtgggtattttcagtaaacttttgctggagaggaagaaagttccttataagcaaatgaatctttgggaagatatagtttattgcatatcaagtatttgaacagtgcagtcatgaactggaatgaaattttagtttcaaagcaattttaaaggtttatatraaaagggctttcattagatttgattgtattaaatcttaaatyactgaatgatttaaaatggatagttatagaaactgatattaatacaatttactgacagtaactaagttgaatataacagttaccttgttttactattttttactcaatttagaataaaattcacctaaattcctctgtytttgccccatagcttgctcagtatgaaccacctcaggaggagaagcgtgckgaataggattcttctcaktttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctaktccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatgraacaaataacttctttgccaccactttgccttagataactgtgtgtgtgtgtgccagtttgaactctgacaccacattttccttctatgcaatcatgcctgtctgataatcttgcattgctttcctctgagctttrgtgggtcctagttgcacamtggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaaycatagtttgtaggtataattatatagtgcttttctccctcaaagtatttttstagccttgaattcattttatcttcattatccctgtgaagtaggtgggacaagtataaggggaagaggggtgctgaatttttaggccaaagactgatattaatacaaatcactcmctaactgtagagccttgggcattatcagtgaactrctytgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagagagagagacttggcttccttagttggtatgatagtttcttggtagatacaggttgaaaattttttgtggcagccaatcctcatgggctttttactcatttgattagtattaatatttatgtcagtaagccaggtgactgtgactgtctttggtaccatcctttttgaacagaaaggcaacatgtgggttggataatcacacttttaggtgaaactgacttgcttaaactgtaacagtcagtgctatttaagaattcaggataagcttagcctctagaggtcctcttcaacatttctgtcaaggatttggatgaatacaacaagatgctccatggaagagaaaatggataaatggatcccaccagttaagctcctattatgcttcagctgctttgtctataaaatatcgacttcacatcttgcctatctcacaagttggttgtaagaatcaaattaaatataatggatgtaaaagtgccttgcaaactgtaaaggattacatacagaccagatggtggtagtgccaaatctgtaagtgacacaaattggaaagtctggttggaagactatattgaaacaagctttaaaatgattaaccacgtggaatacccaaactgctgggcctaaaccaaaaagttgaagtatcaagtcttacatttaggttaaaaaatgcagttatacacatttaggcactaggattgctgacaaagtattagttacagtgattatcaatgtgacccaccctatggatgcttaaaaaaaattacattctggaaagcaggaatagaaatactgtctaggtgttaaatggtcattctgaaagttgtactgtttagtattgctttgtaggagtcagatgtttgatggatattgacaagctggaatgcatataaagagtgaccaatagaggatttgaatatataaggctgggctctccgatttggtacacactagctgcaagtggcagttaaaaatttaagttcctggtggggtgccgtggctcacacctgtaatctcagcattttgggaggccatggagggtggatcttgaggtcaagagatagaaaccatcctggccaacatggtggaaccccgtctgtactaaaaataaaaaaattagccgggtgtggtggtgggcacctgtagtcccagctactcaggaggctgaggcaggagaatcgcttgaacccgggaggtagaggttgcagtgagctgagatcgcgccactgcactccagcctggcgacagagcgagactccatctcaaaaaaaaaaaaaaaaaaaaaaaaaaaaattcctcagttacactagcaacaattcaagtgcttattcctcataggactagcggctacatgtttgacagtgcagataaagaacatgtctatcatgtatatcagttgtattgaacagcacgataggaatggttgaaactgaggatgttcagcaaggaacagagaagacttagtgggtaatgaatactgcaatctggtatttgaagggctgtcatgaaaaaggtgaagactattcctattttattctattataggcttcagggagtgtggtttggctttaagactttttttttttttttgagacggagtctcgctctgtcgccaaggctggagtgcggtggcgcgatctcggctcactgcaagctccgcctcctgggttcaagccattctcctgcctcagcctcccgagtagctgggactacaggcgcccgccaccacgcccggctaattttttgtatttttttaagtagagatggggtttcaccatgttagccaggatggtctcgatctcctgacctcatgatccgcccgcctctgcctcccaaagtgctgggattacaagcgtgagccaccgcgcggccggctttaacaatttttaaacaaaggtttaccacagtggagttggctgcctttcgagatggtgagctcttttaccttcgaactatttaagtgcattctgcatgtctattagacactatagagttggttcgttttaggtgagaggttgggctagatgacctctaagggtgtatcctacctctaacttctgggttcagacaaaaccaaagtcccagacctgcccgcatgtgcgaatttttccttcataatcaagaagtcagtctccttggagggctgggagcacccccactcctgtactttaaaaagtgtatagggctgtgctttaagaggatcctcttctcaaacttccagttctagagcctgattatcaaaaataaaaattcctctagatttctcggacatatttggtgacaagcatttgcttttgtttgctttcattattcaatactttggtctctaatctgaacgaggtcatagaagaggcagtgttctatgggggatggaattcctagagtagactttgacaaggcgggaaggagggcaaattgagtcccgttgggtttgaagtggcagcagtatccactatcggcgacttactgaagaaagaagataagatgttctagcttggctgcatctgctttcccatcagggtccagctacctgctagaacaaactatcacggtgacccatgactctgccttggttgaggtttgccctcagtgtggctggctcccccatacctttgcacatcccaatctatccatccacctagatctgctcagacgctttctcattcaactcccgagcattatttatccgtgaccttcccacataatatttcgtagcgaggttacttacgcagaggtccgatctctctgttcatcttcaagcaacctgaaggcaggcagggtctgcgtcggatccagttctgtgccccttggtaggcacccaggacactgcaggcatcaataaatatcggttgggcaagtacagttgcaggatgaggacaatcaattcttcctcaaatgccgggagagcatctccatagcggtgctctgggagcccggaagaaggcaggggagcggtgcagacagcgttgtatgcgggccggggcggagggctgagggcccgagccggggctagaggcgcggccgggccgccctcctcgtgactcctcctcccccctccgcggctctgagtcaggtgattccggcacgtgacggggcaccacctaccctgctgctctcgagtagcagctcgggcggccaataagcggctgggcttcggctcggggcctatgagagccgggctccggggggcgggccggactgtggcggctgccgggggcggtggcggtggtgcggcggcggcggaggcggactggggaggcggcggcctggctcggcctgcctggcctgtcagggcgcgggcggcggcggctccagcaccatgtccctgcagtacgggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtgagcagggctgcgcccagtcccccgccccctccccggttctcaggtggccggtagcggggacgcccgggagggcggcggccggggcccgcctgcgctccgtccctccgcactttctcttccactcttgcgagcgcacaggcgcggcccgcgcggggaccccgacctctgtgtccacgcccaagtcagctgaagccaagtggagcgctgaaggcgaaactggttgccgggaggcaggtgcccggtggcaccgcccaagacctccgccccctgggacccagctcctgtgtcatttacgaaactgagacgtactctccagttctcacttggagaacttcgtggactccctcccctggcccgttttgatttgttctcacttcaggtgacctgagtgtttcgggattcccagcagagccccagggagcagcgtcaggaagagttgtgactaagacactgggcgttgtaattctcgctactgatgtgaaggagacttcgctgtagcattactgggaattgggtagtgagattgcacccatttcagtagttgtggcctggtgaatgtaattactggtgctgttccccctgtaggggtgtgtttttaaaaatctgagactttgagaatattttgcagacctagtctgtttgttttcacttttgggccttcatgaacaaatggagggctgtacacgtttgtttgtttatgtttttgagacggagtctctcgctctgtcgcccaggctggagaatgcagtggtgcaatctcggctcactgcaacctccacctccctggttcaagcaattctcccgcctcagcctcccgaatagctgggattacaggcgcgcgccaccacgcccggctaattattgtatttttagtagagacggggtttcaccatgttggccagggtcatctcgaactgctgacctcaagtgatcatccgccttggcctcccaaagtgctgggattacaggtgtgagtcaccacgctggcctacactgtttagtgagggttaaatagaggcaaggttgacttcctccatcagccaaacccattatacgcggagtgagctggtaataaaactagtatcagcaggcacctggtcttttcacctctccactctgttgcaaaggcctatccaaaataaatctgtgatttttttttctttctgaatctgtgatattttgtagatgggatctttttaaaaagcagcgttcttccaggtttgctggagtactgtgttttatttaccttgattttcacctctacagcaaaacttgggtacgttgactgtaggtttttagtaaactaatttcagttattcacatttgttactgagaaaaccttgagagtaattgttcacttttctcttctagacagtaagaggcaaagtagttttatgttagaactgtgtaggttgtgattattgtgatccttttttttttgtttgtttgttatggagtcttgctcatcgcccaggctggagggcagtggtgtgatcttcactcactgcagcctccacctcctgggttcaagtgattctcctgcctcagcttcccaagtagctgggactacaggcgtgcaccaccacgcccgactaattttggtatttttagtggggatggggtttcaccatattggtcaggctggtctcgaactcctgacctcaagtgatccgcccgcctcggccgcctaaagtgctgggattgaaggcgtgagccaccgcacccgggccgattattgtgactcttaacaattgcctttacgtttcttttctcatgagagctatcttttccctgtcagtccccgtggcctccccctggacgttttcactttctacttggtatagttactgcccttcttagactgcaaagtcagtgagggcagagtccagtctgtttcactttttaaattactcctcagagcctgaggtaggcattcaagtaatttttgaataaaccagacttcttaagctttagctgtaagacttttataatcttaaagcagattttggtagaattaatgttagctttcccccagaaaaactaatggaggtgatagagattgctactattagtactgagtatggtgcatagaacataggagaaaagatttagctccaaaatagatttaatggaaattaatttggtgtcttcttttgtcaaaaataaagggatagtgaataccaatggattcaccattcagtttctacttttcaaaaaaaatttttttttgtgggatcaaatgtttaaatgttaaaccagggtggaattttaaatttaaattctgaagtttaatagtcataaaattgcctgttttcttttaacaggtggtgtttcataagatgtcacccaacgagaccctctttttggaaagtaccaacaagatttataaggatgacatttccaatagctcctttgtgaatttccagatatgggattttcctgggcaaa

SEQ ID NO: 12549 - DNA, 31849 bp, Homo sapiens
ggggtgccagtctgcccggtgacgcctgtactctggtaagcccagtaaagagccaggtggagatcagtccagggccagggggcccagagagggtatgtccttgtgacaatgactttttccctggcttctgggatgagaaaggatgcccccagctgaccacagacctgcctccgctgggcctcctaccattcttgagtgctttcagggccccaaaatggcagctgtcgtcctttcggggtgctataacaaaatactttagaagggataatttatggccaacagaaatgtattgctgaaagtactggaagctggaaagtctaagaccaaggctccagcagatttggtgtccaggcctgttcctcatagatggcacctgctatgtgtcctcatgtgatgggagggcaaaagggggcaaacaagctccctccagcctctcgtacaagggcacaaatcccatttgtgagggctctgccctcgtgacctgatcacctcccaaagacctgacctcctaatcccatcactttgggggttaggtttcaccattggaatttggggtggagggcaccaacgttcatcagaccatagcagcctgagaagatgagaggaagagcagaggccccacccacctggagggccagcacaccacaggcccctggaaatcactgccccctttctccttcctcatttgacacatttgtcagctgcatttcaggtcgggtccgttgtttgctaatggtcagcttactttccccaccagcacacctggggggaccattcatcttctctggcagtaacaggggccaaccgtggccttgatgctcagcagggaatacacttgcaccttgggagtgattccagcaggatccctcctacctcctttcgctggtgccagttgctgtcaggactgatacctgggcctgggtgcttctgggagcctctgaccttggggcttccctctgggggtcatagacacctttggttcatgcactgtggatctcctgtaaaggtctttttctcccaggaaggaagcctcaagcccttggctcatttgtagagctgcaacttctaataacacttcctgattcaggtacccgccctcacatactctttttccaacttggctctgatgatccaagggtccctttgccctgcctaggggagaggtttcccgaggcttgtcgttttagtttacactcatttactagggcagggtttctcaagctcagcactactactattttgaggtaggtaattctctgtcatggagggtctgtcctgtatattgtaggatgtttagcagcgtccctggtccctacctgctagatcccaaaaacaccccctatccaggatgttaaaactaaaaaatgccttcagaccttgccagaggtcccctggggggtgcaaaatgctttctaccctcctgcctgagccccattgagaatctctgagtgtgatgaaaaacacatggaaaagtagatggattttccacactgggaaaagatgcttgtttccacataaggggctaggcttctggctatccagccagctactcaaatttgacctatttcccaatttttctataaacagattatttttattctcagagtagtatgagtctttgcctgggggaaaaaatgaacagaagtaaacaatatactcctgtatgccctctctgctaacctcatctgtcactgctggcctgagatttagagaatgaggcactcagacatgatcttcgggagccccgcaaacagaagccccctttctctcttccagctgccattgccttggcctaggacgctatcatctgcctcctcagccaaactggcagcctcctgactggtctgcctggcccccgtcttgctcttttcagcagaacctctgcatcaggccctctaagatgcaaattacatcattccactcctggtctaagccttcagtggctctctgagctttcaggataaaggcaaacttctcaccatttgagcctctgcccttggatcctgcatgacctagctcagccagcctcttctccctcccctctcccccctcttcaaatccctgctcctgcagccaccctaagccacttgcagcctgcagagatgcgccaggctgcccatgcctctggtcctctctgtgtgcaggctgttctgtctgcctggaattctttccccttttgtcctctaatacttattcttcctcccaaatccagtggacgcatcccatctttttgggtgctgcctgctcacctcctctgtgtacacacagtgctttctgccttaactgcagtgtttatcctactccacctgaatttctgatttacttctttcttatccttgcagacctgaggcctcttgaaggcagaaactacttcttaatcagccttagatctctaagtctacaacaagctgggcggccctttctaatgggcacattctttagctgtgcaaatacccacactcaatgtgtatcccctacaaggtggttctatataactctgccaacactgccttcttatcttgtcattcctcttccagaagcagggtgtttcaggctcttttcgtgtccctcactattgctctcctttgtccaccacacttgccattattcgttcattcatcaaatatttgagtgccacctttatgccaggctttgggtcagagggctattctgtctatacaaaatgcttccagtaatgaggaaaaccttctaaaagctgcccttttgtgtctagaacatggatgtgttcattagggcctcctggcaccccccagaaggttaccaagagccttgaaatttgaccaaagggcctgggatagactagagggggagggtctactctacctagccgtgaaaaaatccagtgaatgatcccattctcccaaaacagtcagcaaacctccctcttatcagaaatactagtgtccaccagatatagtccataagtcattaggagttaggtcaatgaaagctcatgcacagctagtctcatcctaattggacactccagttgtcattcccatgactttggttaatataaatgcaaaaatgaatttttaaaaaatctttcagcccgggcgcagtggctcatgcctgtaatcccagcactttgggaaggcgaggtgggcagatcacttgaggtcaggagttcaagaccagcctggacaacatggtgaaaccctgtctctcctaaaaatacaaaaaaaaaaaaaaaaaaattagttgggcatggtggcaattgcctgtaatcccagctactcgggaggctgaggctagaaaattgcttaaacccggaggcggaggttgcagtgagccaagatagagatcgcaccactgcactccagcctcggcaacagagcaagactccatctaaaaaaaatgtatttcagaagctcactggtggtttcttatttttcttgtgaagacaggacacttctcagttgtactttttaagacctttcaacagaatgatgaggctgaggccccttctcagcttcccctttcctgttttatgccttagatgggtggtgcccacatgttggtccctccaaactttctgctttagaatgaccccattctaaagtggccccagagggtcgagattcacttatacaacttcagaaagcaggtgaggaaggtgcttctctggggaaccctgcctcaggtgagagttgaggttctagtgcttgggtgtcaccaatttataaggaattcaagaaaataaaataatcagcatggttgaaggaaagggaaagtgactcagagggaaaacttcccagcctggccgtggaaacacatgatgctggtttagcatatcagtctaggggtggggagctgttaggaaagcaagtagaagaaaggttttgatccagaggacacagaaggggatgagaaaagaaatgcccgggtgtcaggggtggcatccccactgaaagactacagttctcaaatacagttttcattatctaactttcttcttcttgactcttttcccttgttgtctacagatggaagctgaactggagaatttccataagcagaacactcaactggagctgaacatcacagaattgtggcagaaactgagagccaccgatcaggagatgcgcagagagagacagaaggtgtgagggtttcagagtctggcagttcttggattcgggatctggcacctatctgcaatgggcagctggcttccaagaggcagagccagcccactgcgaggatatgtttcccattttaactcacattctttacttgctcccagccctgcctgatttcaggcccatgtagatttacatcactgaactcatctgagactataaaatgactttgggtaagtgatcaaggaggtgggaagccagcatggcaggaatatttgtagcatttggcttctttggaggaggaaagtacgtgctcagagaggcaatttgtcgccgctggtttaaggctttgatgaccgaaaaattgccaaggccaggggaacctcaaaggtcattgattcccatttctccatgttataaataagaaaaattaggccccaaaaattgggaggttaagaaacttcacccagcacccacagctaggtagtacacacagagctaataatggaatctaggttttctggatgtgggccaggacacagttgtgccctcctgcctagcacaggccactccttaacatttgttgaataagattggaactttccgtccaggcacagtggctcatgcctgtaatcccagcactttgggaggccgaggcaggtggatcacgaggtcaggagttcgagaccagcctggccaacatagtgaaaccccgtctctactaaaaatacaaaaattagccaggcatggcggcacacgcctgtagtcctagctaactgggagactgaggcaggagaattgcttgaacctgggaggcggaggttgccgtgagccaagattgcaacaccgcactccagcctgggtgacagagcaagactccgtctaaaaaaaaaaaaaaagattggaaatttccatcttctgcagtaagcattaactaactctgcactaggtaacaccagcagctgcagagctataaacgagaactgatacagatcctgccatttccatgctgaagaggatgactggtgatttgtggcatgtgcataatagttatattgagaggtagaaaacgatggaacatgtagaaagggccatgggagcaaggagaaatgactttctctaggtcagggttggggaagacaggtaaaagcatgatgaagaggggacactagcccaactgtgtagatgaaccaacctgcccactcacagcagcgctcctgactatcgggaagggtaagcactggatgagctaacacgggggacgtggaagccctggccaggaatctgcaagagagaaatgatgccatctgtcttggctctaaagggatatgggtgaccacatgagcttccttttatcttttaaggcctgtggtcctgaaagggaatcagagtcaataaaggagcccatctgtgtggcctcttaaggatgaagccccatgtaggctgttcaggctgggtgtccagccgagggcaggtgcacaagacttttcgtgcctccacctgttggctgtgtgcccgtctaagtttctatgcccagtgtggcccctggcagtcagctgtaagtcccagatgaggcatctcttttccctttctgtgccattaacctctgcctgcagcccccgcccctccaccgagagcaccctacagcaccagaaggaaatgtctctgattgcaggagcgagacttggaagcgctggtcaaaaggtttaaaacagacctccacaactgcgtagcctatattcaggaaccgcggctgctgaaggagaaggttcgaggtctctttgagaagtacgtgcagcgagcagacatggtaagctcagcctcccctcctgccatgcactgacctccggggtctcctctccctcgctgagaatctcctgggccccgtcaggtggagatcgcagggctgaacacagacctgcagcaggagtacacccggcagcgggagcacctggagaggaacctggccactctcaagaagaaggtggtcaaggagggcgagctgcaccgcacagactacgtccgcatcatgcaggtacctgcatgctcccctcagcccctgtggaggccaagccatccaagatgagagatcccatcaagggtccctctgagaccacctgtcttcagggctccccaggtgtctgggggcccagtagctccccctaaagtcttattttggctcctctcctytgagctcgtcttggctstgactgtggctgagagctcacctaggaggttttctaggcacttccatgctgcaccctggcctccaccccacccaatgcccacctcccttctccacatacccgattcctcttttctacaccatctttatccagagcacacctgtgtcccctgcctcactcctctcatcagccccttggccctctagaccttcatccacatcatcttacctctcctgagccactttcccttctctcttccattcccaactctcatttcacctgactttgttttgctcctttgtattctgctacccatatctcgtggccacgcctcatctgatttttctggtgcctcaggtccctacccttatctcttgtgtcccaagttagccacaacgtcccagagctggcctcactctggtttaataagcgcctcacacccacctccctggatccttcataggctgttcagagagcctgaccccattactgccgcctccacacaggcacgttatcaggactgccagtcgggattcttctgccagatttctgtttgggtatcagtatcatctgaggcaattaatgtgaattagtatcaaaagggaacatcagaatcacatttataaagcacgtacctttttatgttcacatttctttattgccataattaaaatactggaatgggaacaggttgcagttagattgaaacaaaccagttcccagcttggccagttcatacasagctgggcagagcgcactgtgattcaggccagacccaggcagggctggtctcatgtcatcttacgaccagtccctgctgaaaagcagcccagtccatctaccctttgccctactccttggccatgaaagccatcggaggcccagagatagaagtgcctccagctggtggagccctgagacaccagcagccgcacackgagccactgcttagggcctggagtacctagagcatggagagccccctggggctctggagtgcagtgagcagggaagggaaaccaggatgacagcaggagcagttgtcagctgctgacatcacctagcaccctctgtgccctgtcaccagagtacaggcctgaggaactgggtccctctctccatgccaagcagccaaagcaaacatcgatgtaggaggaggaagatcacaggctagccagagggtgtgagcgtcagcatgaggctgctggggcgggcatcctgtcctcttctgcttccctatgccccggagggtgctgggccagggtggggtagaaagcagaggagacccaagcgggcctcctgcccagccctgccactccctratggctggcagagggagccatcaacaaatgaagtcccgggaagaacattttctccagcagcattgtaacctatgtgctagggagtcctgtggatccaaataagtaactccagcaactgcagggagtaagaaggggcccagggtggggggtgtgtggcagggggtgcgggtctccgggtccctaccccttcaaccagaaagagactgcttgctgctaacagtggagctctttttgttggaaaaaagtctggaagatttaaaaaaaagaaaagttttcaaaaccactgtgccgaccctggtttaccctgctccaccactcctctgccaggagaccttgggtaaattccttaactcaaggagccaccttgcctatatgtaaaacagggaagaaaacaccaacctgagagtggggggttcctgcaagattgaatgggacaaccacataaggcactaggcactggcctggtacagaataagtgctaaaaaaaaaaaaaaaaaaaaaaaaaaaggcaatttccagccgggcgcagtggctsacgcctgtaatcccagcactttgggaggccgaggcgggtggatcrtgaggtcaggagatcgagatcatcctggctaacacggtgaaaccccatatctactaaaaatacaaaaaaattagccgggcgtgtggtgggcacctgtagtcccagctactctggaggctgaggcaggagaatggcatgaacgtgggaggcagagcttgcagtgagccaagatcgggccactgcactccagcctgggcgacagagcgagactccatccccccccmaaaaaaaaaaggcaatttccatcctcttcatccaagcaaaggacctatccaagaaccaaggtagaaatccagtgggaaagcctagaagcccatcacaggatgggccacgggtgcctgtggactgcaggtggcaggggtggagggtggagggtggatggcacaactgattccagaccctcagttggtgaccttggtgtgtgctggtcaggagccagctggacctcatcttcagttgccatggccctggcacttcaatccaaaaaggctgaggaaggccacagcaaacatggcatctaagagtaactcattagaaaataacagaaaatgaggtcactgtctcatttgtttattcagacaggagctcagcctccccactccattcctcagcacactggcagatatgaaaataagagttgctatgagatacaaacatctaggacatgcattttattcattcagtacacattttttgagggcttcttgtacagcaagctctgtgtcagtcactgaggattccaagatgaacgtgatagtgttcctactctcaaggagttaatcattgggaacctggaccagatacaaataattactgctcaactcattgtatgcagtgctgtgggctcatcctggaaatggggttcagtgatgccttcaggacttgtggaaggtttctggggcaaggggcatttgagctgagccttgaagggtgagtagaggttgatcgtggaacaagtcagggaagagacttccaggctgtgggaacaacctgagaaaaagcagagaagagtgaggcctgtgaggtgcttggagacccaagagtccacgagaagagagtccaagtggagaagaacccactgaaatggttggtggctgagggtcatgttggaaagggcgtccatgccatgccaaaaagtacagtttgtcctgtaaacaggctccacccaaggtttcttaagtaggggtgtctttgttttgaaaagacaaaacactccattggcaaggtgggaagactggtggggaaagaggcaggtggcagaaaaacccattaggaaatgactgtcatgttaagggtagatgagaagtacttggaaaggggaaagttgtggtgtcaaaaggcatttcagagtagaaatgacaaatagaaatgtcaggttagacatgggaggaaggttgaaagaacggagaaggattccaggatggctcatttgtgcagttaggcagatggtgagcccactgactgtgggttccagaaagatgtcactgatgcaaggattccaagtccatggaataaatctgttgcctgctttttccaggctgtgaggtactgccatattctaaaggcatcgactcaggccatgccattagggggtgctgtaggcattcccttctcttctctgctcaatacggaggtcggaaagacctgccagggtcatcagtcagttccaaaggccaaaggcagtcctggacagcttggcagagcccctttgcttagaaagctttttacataaacagtttcacatcccccaagacttggcacgttggtggaccccaggtcagatttcctctgcagctgtgtagacctgggtgggggtctggaggattggaggggattttggaagtcaaactgacaagggagagatcaggaagagaaggctcggcaaacccattgcattcacatttttaatccacaaagccatccaaagcaaaaacggtcgacctcaatgtgacctcgggacccctcggaacacaggccaccccagaaaacattttgcaggtagcccaacttatacttattgggagtgtccttggccatcatactatgtgagatattggaatggaggtgacataaatgtgaggggggacagcagagcctggaaagcagtagtcacggaggagcagggctctctggatggaggcacgacagggttcagacaccagctctaccactgagatacggcctcagtttcctcacaaggttggtgtaaggatgaactgagggactgtatgcatgctgtttgatacatttgcagtgatccaatcaacccttgcaattgtggttactcttattatcrttatcatcaagctcttcctgccttaggttctgcttgccgcctcctggctctgggcctggaacactcttctcctctgtctcccctggggttgcacactgtcacactgggttgggcaggggcccaaccatgcttcagcctctcatggcagctctgcagtggagccaagcgggacctcccatgcctggcacagtgaccagtataagctttcaggaactggttcttagattacttttcttacatgaatacgtgaatgaatgaatgaatgaatgaacagaacaagagagtcaggctgcactgagtggtgggcctcaatcatactccaaaaaggatcaagccctggagacccatttaggtaagggagcatcatgaagatgtcagaggttggcaggggggtcaggaacaggcattcacaccaacaggtaccaggagccagaaatcccaatcacagtgacagggctgtagagggtggagggggtggggagaagccagggcagggctccacttgccggggggcctttacagcagaacaagggagaacactgagagctggtgacaaaccagcaggaaggatgaacatcagaatcaactcagacacaaaatcaataggactcagtgacagaatggatggagatgaccaaaaagaggaagcagctaaagatgcaaactgtgagagaactcgaattgtgctttcagtttctagtgcttattctgatgattgttattgagttatttaatgaggatcaggagaagtgaagcttagcgaggcctactgaagggagaaatggagagagacctcaagcaagcaagcttccccctgtggctctaagaccttcccttctgttctggtctctttcacctgtcccttatcccttggtctgtaacttccttattagtaagaatctcatcttattcggtttggtatccactgcattagttatacattttctcatccatttcacaaatatttaatgagcacctctaacatgcaaggcagggtccaaggtccataacccaataaatatgtattgaattgatcatgtcatgatataaagtctgcaaggagaaggtccatgggaggatctagcagagttttaccaggcagcatctggaaaggaaatgcgggaaacctatcactgttatgagacaatttggaactgtaatgttccccaccctccctcccaaactggggagaccgaagaatgacaagtccagcttggtgagtagatgagtttatttaggtcttccatgtggggcactcctgggcagcagcaggacagctctagagacctgctttgcctcacatcgctaagctgcttttaagctaattttctggctcttcacctactgtgtatgtgccatgggactgttttccttagtaggttttcagatatcttctaggatgyttggattctcagggacacctgctccacagctgggcaccatggccttgactaactgcctggccttgagggttcagacagtgaacatacacccttaagtaacctggtgggggacccatcacactacaatcagcaaggcctgggttggttcaaagggtaaagcattcgatggagaaaacatctgattcagaaacacaagtacaaatcctagcatgaagaatgaggggttgacaatgaggactgggcatttcatccgagacagagagatttcattactataaaggaatacctgaggctgggtaatttataaagaagagaggtttatttggctcacagttctgagggctgtacaggaagcatggcaccagcattgcttctggtcaagacctcaggaagctttcactcatgatggaaggcaaaagaggagcaggcgtgtcacatggcgaaagagagagtaggagaggagaaggggccggtctcgctctgtcgcccaggctggagtgcagtggcacgatctcggctcactgcaagctccgcctcctgggttcatgccattctcctgcctcagcctcccaagtagctgggagtacaggcacccgccaccaygcccggctaactgtttgtatttttagcgtagacggggtttcaccatgttagccaggatggtcttgatctcctgacctcatgatccacctgcctcggcctcccaaagtgctgggattacaggtgtgagccaccgtgcccagccgaggccaggttcttttaaaacaactagttcttgcaggaacgaatagaacaagcactcattactgcgaggatggcaccaagcccttcatgaggaatctgctcccatgacccaaatacctccctctaggccccacctccaacactggggatcagttttcaacaggagatttcgaggagacaaacatccaaactatattgtaaggaatactgaaattaagtaatatactggaagtctaaaggtgtagatctgtgctttagatgaagcatttctggaggaaaagaatcattgcggtgtctctagcccracccctgctcccttctgggytccacaggtacctccccacagcagaggaccgtttgtcacagctcagggagaacagtgcttaagaccatcctgttctctgggctctgactccrtagccaccactcgtgagataatgtcccaagtagaagcacagtttgttcctggcacaggtccattttatgtagatttggcctgcaactgccttttctggtatacagaccctcaggtgctttgcaactgaaagtgtggtctggcctgcagaccagcagcagcatctcttggaagcccagtgcaggatttcagggcccattccagacctatgagtcagaggggcatctaacaaggtggtcaggtgatgtatttgtatggtcatacacgaggaactgctgtagacaagctgactactgtggctgtgggctctaagagcaaagtggccagtctctttgggmccttggggatggggctcctccttggggtacttgtgctgggtgtgaaatggaaggcagagatttgaggtgtgggaaaagaggaaagagactgtttggtcccagggtgcagagcctgcaccacctggcccccagcaagcttcgtcctcactcctgtcgactcccctcctttcactctgcattccagtgatgcaggactgttgcaggtctcccccacccccatcagctgtgtcacattctgtgcctttgcttctgctgttctagttgtctgggacaccctttaccctctccttggtgactccttcaagcctcagcccaggggtcaattcctaggaatccaccctagtcattcaggcagaaggaagcatctttcctctaggcccactcctccatcacagcaaggtggccaccatgttaaactgtacccacaccccgcactaaactgtaaactcctcaagagcagaagctaagatttacactctctatactctaggattaacatagtatctccataatattggatgactacattataggtactcaataaacatttattagatgaatggttggttggatggatggatggatggatggatggatatttgtcaaacacaaataagagaagtgagcttccaatggatgcagcagatgttaattatccatttacttttctgttttactcactaaatagcatgctgctaagggcagaccatatcctatttctgtttgcactttatggacttaccagatagcctataaatgtgggttcagcaaatgaatgaaaaatgaatgaagtatagcacagtgcttacgaactctggagccagactgttggggttggaatcctgactctaccacttgctagctgtgtaactgagcaagtcatatacctctctgtgcctcacttttctcttctgtaaaattgtgattataataacaatttataattgtttttgtgattataatagccatataattatatatatataatataatagccatataatagccaataattktgatataataatagccatagggttattatgatgcatttaaactcatataaaaagtgcatggaaaagcattgttgttgctgttgacrttgcaacaagcatgggtggatgtgaatggtgctgagtctacccgaaagtaagttagctggttccttaagaggctgagcaataggctggaataaaggctcaggccccaatagaggatccagagttctggatccagacctaaccctgcccattccccatacactcagcccaggagggtatgccttgtgcccactgaccactcatccatccaccctccctctctcttcccccttttctgcaggaaaatgtctctctgatcaaggaaattaatgagctccgcagggagctgaagttcactcggtcccaagtctatgaccttgaagcagctctgaaactgaccaagaaagtccgaccacaagaagtttcagagacaggtaatatcaccagtggccaggggagatgggcactgggacgaagggattgatggcagctgcaggcaggtctccctttggcttccttctgtatcaggtcccatctacacatggccttctgggatcctgtccggggcacacacctgctctttgaggaatccatgagggccttcccacactccgacacacacaggtccacagtcccctggctgacatccttgaggttagctaccgttcagaatgcagactcttttagattttagaaagcgaatactttatataacattcccagaggggtctggggcagtgccctaaaatcaaacactttagtatttctgtagtgacatatgaatattcacactaagcttcctgaatttaaaaaagcactctgtttttagatcttcttgcattttagaatagtgaataagggattgtgaacctgtacaattaaaatgaagacaaaaagcaagatgaggagctatttaaaggaagaggggaaataattacataaatattaaatgagtcagttactgcaattatatcctaaagttcctctgaatttctgacggccaaggcaaaaagagaaacaaagaaatatgatcgtttatatcatgctcattgtatggcaaaagggagctttttttctggagaaacaaacgtttccctggcaataaattctctgagaaacttaccacatggatccttacaaaaggaatgtggagtaacaatgaacagcctttaattacatatgccgctttcaggccccaaagaagcatttttcaagtatccactccttatctggacaatcgataaaaaccaagagattaaggcatctctatggcaaattaagccaacatggttcaagtttttgttttctggtggtttacattaaggaataaagattagaggcttgaactgaaacatcccatagctatggatkgggtctctgaagtgtcagttgtctcttgtcccatggtcacataagcttatgatggggaaaagtggctgaaaggtacacaggaaccttgtactatttttgcaacttattgttagtcttcaactatataactatatacatttaattacaaaattaaatacatatataagattttatgtatatgtatataattttgttgtcttgtgcacttttggctagggttgaagttgaaacaagagtaaaccctgagtagtacctgaagtggcaataccaggcctacagggttgatgtgagagcatagcgtgtgtcataaagactgagatacttggggccaggtgcggtggctcacatctgtaatcccagcactttgggaggccgaggcaggcagatcacaaggtcaagagatcgagaccatcctggccaacactgtgaaaccccgtctctactaaaaatacaaaaattagctgggcgtggtggcgcgggcctgtagtcccagctactcgggaggctgaggcaggagaatcacttgaacctgggaggcagaggttgcagtgagctcagattgcactaccrcactccagcctggacaacagagtgagactccatctcaaaaaacaaaaaacaaaaaaacaaaaaaacctgacatgcttgacttctcagaggtgaaaccatcttctcttgaaaataaagcacagatgtgaacaattgcaaaacttctcttaaaaaatgtttcaggccaggcgccgtggctcacatctgtaatcccagcactttgggaggccaaggcgagcggaacgcttgtgcccagggttcaagactagcctgggcaacatggcgaaaccacatctctacaaaaaatacaaaaatcagccgggcatgatggcatatgcctgtagtcccagctattcgggaggttgaggtgtgaggattttagagtaaaattgatcacctgaacctcagaggttcaaggctgctgtgagccatgatcacgccactacactccagtctaggtgacagagcaagaccctgtctcaaaaaaaaaaaaaaaagttttaaatatatccaagtatcctaacaaatattcatttgagacctcctcaggatgccatgtgatatagccagggtcttcatattactatcttggagatttccagacatatacaaaaattgagagagaagtctaatcaattcctgggaccccagtcccctacttccaacaaatatcaactcctgtcacttgtgattcatcaacatacccccaccccgacccagaagccagagtggtgaacctagaagaaatccaatgtatgccacaaaaccctcaaaaggctcaggaatgatcagaagcagatatctctggaggtggaagtgaaggtagggctgaaaacagaaaaaaatctgtttaagaagctgttagatccacctactatccaacacagtggctaaaaacagacccacatcaagtccatcatcttgaaatttcagaacaccagagtatgaggaaagaactcctccagacttccaaaggagttaaggaaaatttttatacaaaggatcaaaaatcacaattacaggatacaaaatcaatgcacacaaaaatgttgcaatttttatatactaacaatgtactatccaaaacggaaattaagaaaacaattgcatttacaattgcatcaaaaagaataaaatacttgggaataaatttaactgaagaagcaaaagactgaacactacaaaacattgctgaaagaaattaaataccagtaagtggtggattggaagacttgtcgttaagatgtcagtactacccaaagtgatctgcagattcactgcaatccctataaaaacctcaatgacatttttgcagaaacagaaaaatccattccaaaattcatatggaatatcaaggtaccctgaatagccaaaacaatcttgaaaaagaagaacaaggttggaggtctcatactttctgatttcacaacctgcaacaaagctatagcaatcaaaacagtgtgatactggcgtaaaaacagacatacagaccaatgaaatagaatatagaggccagatataaaccctcaaataaatggtcaagtgattgtcaacaagggtaccaagatcatttagtagggaaaggacagtcttctcaacaagtagtgttgggaaaactggatatacacatacaaaagaattaaggtagacacttaccttacaccatatacaacaattaactcaaaatgaatcaaagatctaaacagaagagctaaaactataaaactcttagaagaaagcatagaggaaaagcttcataacattggatttggcaattatttatttggcgaatgacacaaaaagcacaggcaacgaaataaaaaatagataagttgtttgtgagatttgcagcaatgtaagcaatgcaggcatgtatgtgagatttggctccatactaaatctggcatcatgcttaattgtattaaaaacctgaacatattttgttttcgagtacatacatgacggcccatcagtgataaacagcttgagattaaaaattactagaaagtctcaccttttttattactacttaatccaagtgaatgtcactttaaattagtttgagagaaattctaatcaatataatttccttaaggacaaggccaatgtttcctgaacattaaaactttgtacccatatcacagttcttcttcattaaaggaaaagatctaaaaccaacacaaactattgattcaagtgactcacactagaaacaaacaccactcaaacagttccacttycatccacctctccaaacaacaatatataatgtactatttctgttcagaacttataaaagccttccactagaaactaaagaacatggatgattttatacatatgcatacacaagcaaaacacaaaagagaacaaacagcaaacaaataaaaattagaagcaaaacaaacaggaaaccaaccccaacatttccccactcagtctaccctggagactaccatgttacccagagcccaaaaaaccacatgatgaatattttattcttcatacacaattcaatatccttaagtccaccaatatcaccatacatcctgtgcaatcaagaaattcaccctaggtacatgacctattagtaagtactccagtgccagcactattgatgcaaaacagcaaacatagtgtgaagcaatacaggcatgtatgtgagatttggcttcacactaaatctggcttcatgcttaactgtattaaaaaagaactgccaaaccgccaatgcatttgtttaaaatatttcttattttgccttcatcaagactaagaattttaactatgaaagtgttaattayccaaatttctccaattctttataaggttttaaagaatattttattatctaaactttctaatttctctgtatgtgcaaagaaacaaacaaacgaaaactacatatgacttacacagaccatgcgtgacatgcttaagctttccatccagtcccagattttattcttcttcatttttctttaaagaaccagtcatttggccaggtgcggtggctcatgcctgtaatcccaacactttgggaggccaacgtgggtggatcacgaggtcaggagatcgagaccatcctggctaacatggtgaaaccctgtctctactaaaaatacaaaaaattagccgggcgtggtggcaggcacctgtagtcccagctactcgggaggtagccactcagctactgaagcaggagaatggcgtgaacccaggaggcagagcttgcagtgagccaagattgcactgctgcactccagcctgggtgacagagcaagactctgtctcaaaaaaaaaaaaaaaaaaaaacagttattttgctccaggacaaaaattcatcatacaaaattctttctcatacaaacttactatcttctctttataaccttccttaccaaaaaatatatcttcatatccataactttcttcacatctctctcccctacattgtttcataaaaaaattttcttttttttttttttttgagacagagtctcgctctgtcgcccaggctggagtgcagtggcgcaatctcggctcactgcaagccctgcctcccgggttgacaccattctcctgcctcagcctccctcgtagctgggactacaggcacgtgccaccagacctggctaatttttttttgtatttttagtagagatggggtttcaccatgttatccaggatggtcttgatctcctgacttcgtaatctgcctgcctcagcctcccaaagtgctgggattacagacatgagccacagtacccggccataaaaaaattttcatgtccataatttgaattaacttttaataacttctaaattagacaaaattatttttttctcactaataacatcttttggcccatttcatatacagaattatatattaactataattattatccttaataaccttaaattttagtgaaaccctaaaaagcaagaaatcctgaactatcagatatgagcattttatacatgagaacaattccacaacttttagaaacatatttctccatatcataaccttttttttaattttattttttgagatggagtctcactctgtcacccaggctggagtgcagtggcgtgatctcggctcagtgcaagctccgcctcccgggttcatgccattctcctgcctcagcctcccgagcagctgggactacaggcacccaccaccactcccagctaatttttttttttttttttttgtatttttagtagagacgaggtttcaccatgttagccaggatggtctcgatctcctgaccttgtgatccacccacctcggcctcagcctcccaaagtgctgggattataggcgtgagctgccgtgtccagcccataaccctttcttaattggaaatgacccagatacccacatagccaatgagcatcaaaaataattttaagattttaagttacacaaaaagtttacctaaaacatttatcccattgacatgtatttggtttcttcatttttaacagtttatctagattacttctgaaaactgagatattagacacaattatacaaagttagttatttccttcttaaccatttcttttttttttttttttttttttttttgagatggagtcttgctgtgtcacccaggctggagtgcagtggcgcgatctcggctcactgcaacctctgcctcccgggttcaagcaattctcctgcctcagcctcccgagtagctgggactacaggcacacgccaccacacccagctaactttttttttttttttttttttttttagtagaaatgggrtttcaccgtgtttgcccagactggtctcgaactcctgagctcagccaatccgcccacctcggcctcccaaagtgtggggattacaggtgtgagccactgcgcctggcccaaccattttcttaatagccagtgaacatcaggtgctcacctaaataagaggctcaaagttaaatacatagatatttttgccaataactcagaagattcacctaacaacattaaattagtctcatctgtcaaagaaggcataccaaaatcattttgttttggctagattaacagctttataaccttctatgccaaacactgaaacctcaaaatatctagcagagacatatataaaacccaaacaaaaatgtatgctgacaatttcattctaccaataattttaaagccggtttgtttagtaaagatttacataagtcacgtgaacttgaaaattgcttggactttttcacctaacgtatgagtgctcttttacttataagccagtttggtagacacaacatgtaacaataagtgtacatacaaatagacacatacaagtagacacacacacaaacgaaaatccaataattttaccttagaactctagccatgaaatgccaatacaagcgtactggttttacatggttatacgttgtttgccccaatagttaatccagtgaagaatgtgaaccaaaattttgggtaaagcagtgtccatggcagtttgatttttaaaggccaaacttccccggactccaaagaacactggggctaaacagcaccgaaggaaaacatcacatattaaccaggcccaactctgcttagaacagcagcacaaaagcctggatccatgcaactccatcccacttttccattcagcagcaaagtccagattccaaacaagattggggccaaatagtattgcaaaagaatatcaagttggctaaattctgatttcccatgactatatcaaacacacacaatcaccaaaacactatccaactgctgcagcaacaaacaagcccctagtgtccaaactgaaacagccagagtgcaccctttctctactggttgggcttgatcgacctgcaaatggaaattccataaagaatttcccaaattgagaggagctgatcccactgtctggtacccaaaagagacactcacttgccgggacacaacacacaattacaaacaagtcctcaagagtgtccatactgaaacagtcagggtgcttccctctcagtcagttggtcttgttccacctacaaatggaaattcctttaaaattttcccaaattgagaggagcagatgctgctcacctatctgtgtacagatgtcaaatttcaaaggcagttcttccaaggcaatcaggaacaaagttggggctggctgtggcagggccagagagagacggaaattcacctccagccaaaattaggtgggcagctgcttaggagggcttctgagactcccagmccacagcaaccgagctgccatgagcaagacattcccggtcaaggaaacaaaatatattgctgaaacaccaggagtttggtcaaggtcctggtgcttgcagcatagaaagccaatcactgggaggacaagtattaccaaggaagaaggctttaatcaggtgctgcagccaaggagatgggagctcagtctcaaatccatatctctgactgactaaaacggggagggtttatataccagggaagaaatattacatgggtaagaaaacaagaactagggaggggccaagggccacccggtgcagtgatctggtgagtttcagttctttgacatttcctttttaaggagcctgaaggtcctttcctgaagaacgaactcagataaaacaaatacaggtttcaggctttaagagaagaagggtaaatttctatgtttattcaaaaacaactgtctatggaactattgagacagtttcattagcaatatggacatataaaatttcacaaatgaaaaaacaaagcaattattaactttaggaaacacaaattattgtatggaaaagagaaatgaatcattgtatactacatggctcaactgtgaccagcaattatataaatcataattaaattctgactattgatctactcaaaattaggaggatgaaaggacgggaatttgcaggggcaggggaaggtgctgaaggaaagctaaatcctcgtctttcatagagagaagtcaatagagaatgcctaaaaatgataagtcaaagaggcaacgtaagtacattaatcaaagcagagtatggaagtagatataaaggaattagctaaactaattgaaattgttgcctctgaggattgagaaattgaatggaatgtagaataagagatactgttctttgtaataagccttatagagttatttgactatgagcatatataattttcataaataaattaataaaatattaggaaaactttgctttccttccagtttactattgcaggcacatttttatttttctccccttatgcatatgggaaaactgacaaggatatctgttttaaaaacaaagaaaagaaaagaaagagtcaaagcaaaatagaacgaattaagaaactaaaggttgactagaggagaaaacttatcttgcataagaagatgggtgagaaactgtttgtgtcaatcttggctctggatgaaggaaagaaaaaacttcagacaaggtctctgcatgacaatttctaaccaaaagtccctactcagacaagttttagtctagaatttgcattcaatttgtggcttraggcgatcttggctgaaaatttaccttaaaaggaccccacagtagtagtgtccctaggccccaagcagaagcaaatgcaaattttctctggaggagtaccttttaaatataggcttcaaagaattcccataaatagtgttctgaggaacatgagctcacaatcaaaagtcattaaatacttgaaaaaataaaccaccagaagtgaaaaycaacaacaacaaaaaaatcaaactacagaataaaaccaacaaagactcatagctagtatgattattaaaataagaaaatttcatgtctgaaaaaataaaaaaggaatttgaaaataagacaaaaaagcaaaagtcttccaaaattgcataggcagatttgaaaaggaaccaaataatacttctagaaatgaaaactattataattagaagctcaatggacagattgaacagtagattagacacatctgaagggggaatttgtgagctaaaagaataaattgcccagattgcagcccagagagataaagatatagtaaaagacaaagaggagggagtgggataatgcaatgtatgtctaattgaagtttgagaaagaaagaatgaggagaggcaacattacaataaggtacagccaagagtttttccagaattgatgaaagatgccaatcatcaaatccaggaagcccagtggatcccaagcagggcgcatgggacaggaggacagggcaactagaacactgagggtgctgttgggaagatggaggaagaaactcactggggtctagctggccagaaaagggagtaaatctaaaaggagccaatttggtaggcaagaaattgagttgtccaggaagagagggttctcagttcagtccaagatcatgtgtgtcatgcacagagcagttacagcagttgtggtcagagaacagtgctagagtgaaagacctaaagcatggcatcaggggaagccacaggagtgggtgctggcatggcgtggaggccaaggtcactaatgctgcaagttcagccttgcggggcaggggtgagccgtggaccctggtggacactgccattgcccaggatgatgccagcacctgagacagggaggatgactcaggggagaaagttctcaaggaacaaggtatgagtggacacacctggagaggcacgaaggggtctgtctccaggagcaggggttttgcacaaggagaaagactggcagttcagaagccaacataggtcaggagaagagtgccatcctgctaggatgtggagaatgggagaaggggcagcctccatggktgggggcctctgtgcaggcggatctgggggctcaggagaggggctgggctggggtggttctcagtattcacctcatcactctgaagtatgctgcttcacttctccatctctctgcgagacagcaaaatggcttatcactgtacctccagcatctgggattgagtgctccacagtaggtgcccaataaatgtttgaggaagcagggagggaggaggggaggatcggctctgcagcagtgcaatggacaggcccacatgagtcctgttgtctcttacagaacccagcagggacatgctcagcacagctcccaccgcaaggttgaatgagcaagaagaaactgggaggatcattgaaatgcagcgcctagaaatccagcgcctcagagaccagatccaagagcaagagcaggtcacagggttccacaccctcgctggagttcggcttccttccctctccaactccgaggtagacttagaggtgaagaccaactgaccccctctggtgagccatctccagccacagccagaagaaacacagcatgtctgtccccaagccagacttgcggttggagtctgtatggtccctgcagcactgaccccagcaacctctttctcttgccctggggaatttgggacacagaataaaggtgtttgcccacaccttgtctaacttctgcttagctggggggccaaggccagaagagggaaagagaggaggctgaggactgggggctccagctcatctgaagccacctctgcttgtccctttctgggcacaggactgcctggcactgagagatcacactggacttgggctctctcctctgccagctcaggcaggaccaaagcctgttcattcctatctccttcaggaaatgcagcgaggctttctaaggactttttttttttttttttttgagacgagtctcactctgtcgcccaggctggagtgcaatagcgcaatctcggctcactgcaagctccacctcccaggttcacgccattctcctgcctcagcctcctgagtagctgtgactacaggcgcccaccaccacactcagctaattttttgtatttttagtggagacggggtttcaccatgttagccaggatggtctccatctcctgacctcgtgatccgctgggattacaggtgtgagccaccgcacccagccacactcagctaatttttgtatttttagtggagacggggtttcaccatgttggctaggttagtctcgaactcctgacttcaagtgatccacctgccttggcctcccaaagtgctggcattacaggcgtgagccaccatgcccagcctctgagggttttttttttttttaatctgtgtaaagaagaaggaaaagatgacagtaaaataacagacatgggaagtgttggaaaaattccccaaagtcttacattatctgctgaccctgttcttggaactgtaagtagagccctgccctcatttcccttgcctccatgtcattctagacttgtcatctttgttctgcagggtcctgctctgctcctccatttctggagtgagagaggatgcacttctccctctggttattcctctcaggcgccatcctgggagacccagccacacacaggtaccgggagagatagttctttatgcattaaagagcaaaagaatataatccaatgtccctctcttctcccacctgcagaagccagatgcccctctaatacccaaataagaaatatttaagcccacagtccctgctggtccctgctggtcacctatggctgtcttaaacctggcattgtcccatctttccctaatcactttactgaaagtctgggcactgctcatgggttgactttcacagagagctgaggcttggcagtcacatttggcaaggtctcccaaaggctggtgtagcagaaggagcatgcaggcaaaggccttggagcaaagggttccacagggtctgcaggagactctgtctgctgagcaacaaccccgacccagcctgcaccctgtcacagcagccagccccttcccccctgctggcatgttcttcacatgtactcgccccactgggaagccagatccagagagcagggaaggatccaggcacccccagagaggttcagctgcaaagatgacagcccattacattattatgatgggtaggtgggatcttccaggacccagattcctccactccaaactagcatgctggcttcacctttgaagaagaaacggacttgaaatgagactggggatgaggggccagcaggggcagattgtgcaggaccgtgaaggcacacagaagctgtgggccacccagaggccaatgctaagccgctgggagtcaccgccactgctcaccaagctcttgccacattggcgtcctttcagttcgtacaagaggccgaggtctttcctgccttcatctctttccacatacagtttcctctgccccctctgctcttgcccccacacctcactttgtgaacttctatttatcctttagatctcaccttaaagggcacttcttcagaaaggcagtccttgactccctcctatctaaactgcacccaccacatcgtttttcttcttaatcatcacggtaacatgtctgtctagttgcttaatatttgtctgtcctgctaggagagttctacagggtaagggatgcagtagtggacacaagggatgttgtggttgcccaggtgaaacaggacagtggcttggaccaggatgatggcagtggggaggaagacacgtgaactcttcggacttaaggactggtgagggttagccaaaccaaggtgcatggagcaggggcctgggaagaagaaaaatgcactagagactggagctttcctgaagaccagaaggaaattcttaatggctaggacatatcaatattcaagtgatagattttttaactgcaaaatgacttagaatcgagatgtcacattccacgtacaagatggaccttggttctcagacaaggaaatccaaaccaaagaggagtaaagtgactggcacgtagtcacacaggcaggggtggggctgcaggccagtcggcccagtgactccaaaggtgctgctcttacgcactgcactggagagatgcccaaacaaaacactgtaggccaagtgaaggttataggaacttgaaaccctgagagtctaaatcagaagttaaaggagtggaaactcccaggctaagctaacctaagcctaacctaaacctggatgctgtccagctggtgaggaggaagtatgggccaagggagggccccaccctagcagaacctggcaccttggccagcaggtcaacaaggtcttttcttggctgcacaggggtgcacacagcttcttgttagtaaatgtagggccagaggttcaatcttgcttatgtctccatgttctgtcttcagtgcttgctcctaatccacccatcgggaggcattggttctctagcatctgagacctccctctacttttgtctatccagactccgtggggaaactgaaggcattcaccccattggtgcccccttttccttcacgagtctcttcatccagtttactgcttcagccccgacagtgctggagtgggcctagcagtcacctcctcctgtaagcagccttagggcccctgctggtcactcaagtgactaggcattggcacacagactccactcttgctctcccggttgcagtccatcattgagctctaggtactcattcaattctggtgtgatgactggtgcctttggggagtgctgtgcctctttggtataatagcctccagaattcctcactgggccctctcaccttctagagttttggcatcagctgtggccaagcagtgtgggctacctagctgaggctcccctggtgtcctgctatctcaacactgaaaagcctgccctacagaaggttctagcatcactgtcctgcttcttatacaaaatatggccagccattgctggtcccaggaggtacctgagggcctgggaacatctgtgtgcccaggcaggacccccttataatcattcctctgcattcggagtgagaagtgaaagggaagacatcttagggccaggaacgggggttcactctttctgaactcccatggggtgagctctcctagaccactggggttcaagggcctacttaggcttcaagcatgtctaagatgtgcccagactgccctgagctgaggtaggctggggagcagatttccaagaaaataagcctgccctgtgcacctggaagcaggagggactagcatgactaatcacctacgatgaccagtagaatacaagaatttgtatatgttgctcgtctgctatgtgtcacatggtgggatttggcaggggctacaaataggaattagtgctagccacctaatgcatgtattaatatattaagtgtattataagtggaactatgagaatgttagggaaacacccgaggtttggtccaggtcctgctgctcaccacacggaaagccaatcactgagaagacaagtattgccaaggaagaaggctttaatcaggtgctgcagccaaggagatgagagctcagcctcaaatctatctccctgactaaaactaggggtttatgttaccagggaagaaatgtaacaatgtgtaagaaaacaaggactacagaggggcaaggaggcatctggtgcagtgatctggtgagtttcagttctctgatactttttttaaaggtcctttcctgaggaaggaactcagataaaactaatacaagtttcaagctttaacagcagaaggatcaatttctatgttcctccaaaagaacagtctgtgggagtcttgggccagtttccgtgctcactttctatttgtcaattgctcaatcatgaggaatctggctgtcgatcttcctggctgcttcatgctgaggaggggtgtcataggcagctccataccatgagtgaccatgtggccactgaggaatcaaagattaagctaatatagagttttcttctgaaacacaatctttctgtctccagtctgccacttccaccaaagacgaatcacagcaggaccaatctacctgcaagataggcttcggtcccgtatgcttgacctgattatctacacaaagtgcagcaagaatcattgccaacataagctctccaaaattggctttgctggaacctatcataaggccatttcagtcaaagcactgggaaaataaccagttcctccaagtgtgtcccattacaaaagaaaacaggttcttattaaatgtatgaaaagaaacacattgccatgaattaagaatattcggctgggcacggtggctcatgcctgtaatcctggcactttgggaggccaaggcaggcagatgacgaggtcaggagatcgagaccattctggctaacatggtgaaaccccgtctctactaaaaatacaaaaaaatcagctgggtgtggtggcaggcacctgtagtcccagctactcgggaggctgaggcaggagaatggcatgaacccaggaggcagagcttgcagtgagccgagatcacgccactgcagtccagcctgggtgacagagtgagactctgtctcaaaaaaaaaaaaaaaaaaaaaaagtacaaagaaagccgagcacggtggctcatgcctgtagtcccagcactttgggaggcagaggcaggtggatcatgaggtcaggagatcgagaccatcctggctaacatggtgaaaccccatctctactaaaaatttaaaaaaaaaatcagccgggcatggtagtgggcccctgtagtcccagctacttgggaggctgaggcaggagaatgttgtgaacccaggaggcagagcttgcagtgagccgagatcatgccactgcactccagcctgggcaacagagcaagactccatctcaaggacaaaaaaaaaaaaagaatattcacaaatagtttccatattctggagaaattaggcagcgagagaaacatgtttcaaattctgcttacaaaagtatactcaatacacttaaagtatatttcaaggatataaataactcaaaagaaaaaaattctccagactctgaaaaacaaaaggaatcggcaatatttcaaacaacaaaagccattaaaaaattatttcagtcccttattagttcagtccatgcaatcaactcctgctctgcctcatattgggatatgaacacattagcctttcaataagggccctgaaagttttctctctaatccaatggcacaatctccaaagttatcagaaacctgctttcaagagtgcagtgtggcaccatcttggctcactgcaacctccacctcctgggttcaagagattctcgtgtctcagcctcccaagtagctgggaggcatacaacaccacacccacctaatttttgtatttttagtagagacagggtttcgccatgttggccagtgtggtcttgaactcctggcctcaagtgatccactacttcagtctcccaaagtgctgagattacaggcatgagcccccatgcctggtcccaattttctattaaagagcagatcaatactccaagacaaccctgtcattccaaaacatgggcccagacgctggccttgcatcactgtcctgaggatttgactggaatcaat

SEQ ID NO: 12550 - DNA, 41241 bp, Homo sapiens
  misc_feature (1)...(41241): n = A,T,C or G, or insertion/deletion polymorphism (see Tables 1-2)
tgttgaatctggtagccacagtcacatgtggttattgcatccatgaagtgtaactagtgtaactgaggaattgaattttttaaaatttgatttcatttcatttaattgaaattgctacatgtggcagatagtcattgtattgatctgtgttgctaaagaagattgtgtaaaatggttttcataactttggggtagcagttggcatttttatgagactaggaagtatatgattatgtagtgttgtagtttatgtgactaaatgtggctccttatggaggagttctttaactttgccatacttataaagatagttattatttattctctctacttatattttgaaagtccctctcttaaagcaagtagatatcatggagtgagtctggaaactcctgttacagaacaccaggagtggccaaattatgactggtgccccctggagttgtgcacacagagtctgtggctacccctataagctgagtcacatctcaaggcaatgtcatattcacttttatgtctacaatgcttggtatggaattgattactgacaaatctttgttaagtaaggaatatatatctcaattttgatatccgcaataataaaggatagtgaataaaaaatattttactatgtgctcatagaacacattgtatgaatttgccctttgatgtatatattcattaagttctacatttatgaagtacgctttgtggaaagtattaatttaagtatttaatacgaatataattcagacacagtatgtctactgctgattaatgaagaagggaatgtaaaaatatgtgctgcatcataaagtaactgcactaatgaacatatgtgcaagatgtagttcccaatagcaaaggaagagaaagggatttttgtttggttgattgattttctcagtcctgtggcagaacaaaaaaggcacatcagagaaggaaggctgccatcagggaaatgacttttgaggcgggttttggaagatgagctggagctagcagaggggtggtgaggaaagtaaggcctgtgctgctccaggtactttgctaagggacatcatctcacatcggttttctccatactcctccaacgtagatgtccttaatcctcatttcaatgatgatgcagctgattcggatttaaagaagtttgcctaaggtgacatcgctattcagtgagggtactaagctttgaacctaggtatgtttaacgctaaagcctgtgaattgcaccatagtcattggtatcagtaatgaaaaatccaacgtgtttggtgaaattcaagtagtgtagtatcgccaagcacatgatacaaagagaagcaactgaagtgctggaatggaggcatgtgataataaaaaaccatctatgccatgacaaatacactggacttttttctgtaagtaatgtggagccctgggtgggttagttttaggctggcaatgacatcatgattcctaaagaaattcaggagctaaaatcaacagcatatttagctaattatttgacttgaatttccattcaaattggctttattttttcctgaatacgcagttgcttagaagtggttgagttccatcctggtgcgtgctggctatcaaccaacataggagtaaaaattcaccatgagtagtcagccaaaagacacatgcagatgcttaggaaaataaattataaatatttcttatgtctgccagtagcaatgagaagattttgctatattgtgttttttgatagttggcttgttttactgtatgcttatgaaaacataaagtagcaggacaacagatcacattgccaaatgatttctaggatttggcccaaggtttgatgatccctctgccgcttcttggctttgtatgctcagaagcacccaccatcagctgtcagccctgtggcaaaaggaggaatggggtcagagtcaggcaaacagaagccagagccaagtgttgttctgagaaatactagcatctgtttagtgcagtgagttctctgctttgtacttggcaacccacttgggactcatgctgcaaagggggctgatgatttaaaactgagggaggagatccagaggggagaccttggctcatgaaacatcctcttcacctctgtgatgggccgttcttcatgtcctacagtttgaactaaagaatggcctcggcttctcctgtggatgtaaacatattttgttgcaagtgccattcgttttatttgttgtataccttttccttcaaatatattcctggctaaactcctggctgtctctcctggagtgtttttttttttttgtattcttggggttgtaagaatcaggttcatgtggaggtgtctagaaacaggctggctggacaggaaggaaataggtggatatagttttaaatttatacacatcttttggagccaggaacttctacacaatctagcttctatgagataaaatttgtggtacgaaagaggagtggtaacatgaataataagagattttttttaagtctagaaaaccttagatgttgggagtgtaatcaagcattttagccagtcattttgaaaggtaagtgagtttaaatgaattgaatactcagttgtgaattagtgatactgaacatgtacactgtcttatcagtgtgtttcatagtgattggtaatgcccagatttccaatttgatacacagtccattttaaaaagatatatgtgtgtattttatacgatgctttgtagttttgaagttttgagataaattatttagaatcaaatgctcatggaaatgtctgtaatattaaaataggtttatttcaagattattaattcatttgttcaacgagtgttattgagcgtctgttgtgccgaaccctcattaacctcaatagggaaggtactaggttcaagaggctgaagaagagaccccgagccaacaaaggagacatggagtttcattaggagcttacatacagtggagagagtcagtggcagtgggctggacaggagaaccaacttacctacagaaatgatccagtggtggcaggctgggcaggaaaaccgcaaccacttgcaaacagcatgcagtttatgtagcattttcacttaacactctctcctttatgacctccacctggcaaccctcattaaccccaaactcagggcctcattcctctgtatggcccatgttccatgggatgggatggggtttcagatgttcctcacagacaaagaacaaatcttcgggctgtccactagattccctagcttgggacacactttcaggtgtgtctactgtacagggtcattctaagggtttgcttaagtttaccctacagcatcattcacgtctgctctctcatgtgcttgcgatacagtgaccatcaacacaagggccctggtctccaggaacttacactctgtagagcagtgtttttcaaagtgtggttcccagatcattagtatcagtgtgctgggaattgctagaaatgcaaattctcaagtccccggcctagacctattgaatctgaaactctgagagtggggttcagcaatttgtcttttaacaggtgattgtgaaagtttgagaactactgcaaaagacagataaattaactgatgattattaagtatgccagaaaaggctgagttttacaaagaaaataaaacagggaaagaagatggacagtgtaaaagtgtgtagcttttggggtgttgtctttgtctttgagcacttgactgatgtgagaatatctgggaggaaagctttgtggttatctcggttagagattttagtgagttgaggcacggttgggaattgtgatgtctttagaagggctgaacctccagaatttgctgttgaataaattggaaatggtgatgtgagagggcagaatgatcctaaaggttgttgatggtacctactgatctctgatgttacctcatagtaagatgggaaaaaatgaaatggggtggggcagggaaaagcagactttgggggaagaataacacattttattttagaaaagttgtttcaaaagctcattagccatgtgtgaagctatatttgtgagtatgccattcatggggaaggttggcactgggaatattaactggggagtcatggtcatataaatggtattttaaaaaactagttagcctgagatcaccaagggaatgaatgcacatggaggaggtctaaataccaagtcctggggtatacctggggggtggggtgggtggcattaggctaaagatagtgaaaattctaatgaatgataagtaatattttgctatgttgatcttgagattgatatgttgaaatggcagcatcctagaccaatcccaagtttaatgccttccttgaagttgccatgtttctgtttcggagtccttggtgccacaggtccctcttgactttcacaggccagggcttcttgccatacaggtaagtgttctcccttcccagcttatgggatccagactcatcagctgcccgctgtaggttgtccttaaaacttagagaatatgcagagagcatacacaattctgcttagaggaggagcactctccttttcctcttgtctcagttgtgatcttgtcttctttctctaatttccttttcctctattgaactttcaacaggcaaattctttggtctgcagagccaaaagaataattgtctttctttttaagttaatagtacttagatcattttgacagttgtcttatttattaccacttacacagaggcatttcttaatgttgaattcaaatgttgatttttagtgtcctagaccttgatattttctgatttgaataccctgagctgttgaccaaagcaacaatgaaatttataatttcttaacgggtgtgtgattcttgggatttctttcagaaaacaatacttccctgatgtaggaatgtatcacttaaagtaaaaaatgtttttaaaatttgaattatagaagagaataatcagtggatgattcacttcgtagaaaagttctttgctttaaaatgactcatcaagtgctattgggaacatttaaaatgttatttcaattgcacatactctttaggaagatacaagtttattgctttatatgtgtgtatcactgataaaaggtattttcatatatttaacaaaaatttaaagggaggaatggttaaatgactgtctaaggactcatacctctttagtgggcaaccaagtcttgaaccctagttaccagttgtcatgtttacttgtagaactaccatcacggccccaggggaacagcttaagaaagggataggaggaataaaatggaagcactctatagaataagtcttcatctgtactcctgatttaacaaattctgatattacccactgtgtttaggtttcagtgacaagttttcgtagcagttgcggctgcatttagctcttcacatcctcccaattctaaaactgcaaggtattgtaacgataatctgtcccatttcctcgtttttgaatgagaaaaccacagcctagagtagccattacttgccaaagctttttttcttagaagagaggggggatcttcagttatcttctagaatgtgacaaaattttgccaagatcatggtgcgtgctcactaaaagatgatgaagtttattgcctaaatctcaaattcagtcaagatgctacttaggccagcttttaaaatttgtataatagctagttttttatttaaatttttaaattgtgaaacagatcacaaattaaagagcacatataacatatatagtattacatatgcatatcatttaaaaatattttatatatagctatatatcttatgtatgttatttttactataagaataataataaaatataaaatgaacacacaggcatcaaccattgagtctaagaagtaaccattccacaatcttggaaagcccctgtgggtccctaatctgtctcaccccattccttgccctcagaggtaacctctgtgcactaccctcttgtggttagaagatggagctaggccgggctcggtggctcacgcctgtaatcccagcaytttgggagactgaggcgggtggatcacctgaggttggtagttcaagaccagcctgaccaacacggagaaaccccgtctctgctaaaaatacaaaaagccagacatggtggtgcatgcctgtaatctcagctacttgggaggctgaggcaggagaatcgcttgaacccaggaggcggaggttgtggtgagccgagatccaccattgcactccagcctgggcaacaagagtgaaactctgtctccaacaaaaaagaagatggagctacattactgctccggagccttgggcaagttattattctccctgtgcgtcagtttcctcatctgtataaaaggaatagyaatatatgtgttgtgaggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttgrttgggggggggrgcttttgacatcatctgtttcaccttatcactgtgtactttcaaaatatcttcaagatgctttcattgargcaacaagaaaattgttttgaacaaagaccctttagygtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttactaaagagtacttctaaaagtatgagaggataaaggattgagatataagagaaaagttgacaaaatcagaaaactgtgcaatgaggtaatgagtaaccaaaacttgctatcttatcagtactgagaactgcagaaaaatttcttacttggagatttgtgcttttctttgagtattcataaataagagtgaaaaacaataatcacttttctcagtaaaagaaaacaaccttatacttgaggacttttgtttcaaagttggtaaggctttggatactaatataaaattcaccagtaaagtattttgaaactcttaatgccacctgtgcttctgaattcatatgaagattattgtttgagacctctgtggtgacatggacatcacacttgaggggtgagacatatcttcaccttctttacacactggctcatcttctatttagttgatactattgttcctcaataaaattatttttctctctattgatattattttcaagttgacttctagtcagcaactctgtaagtatctttttattggcttttagattctgtattttaaatgagccagcaatatttcaatttcattgagattgcattatatcattttgaaaacttatttgcctgtgattaaatttttgaacaatgtctgggatctaaaaactcacttgaaaatcattttttaaatcaaatttttttaaaaaagtgttacaattatagcaagtcatcatggaaaaataaagtaatatgggtatgtataatatgccttctaaacctctaagcatctggaagcagagatccatgttctgtgaatgacctactaatcttcttaatgagttcatagcaaggcatgtggtatttgcgatagaaaagactcagtaaaagctgtcttccattcagtttttgaaaagtgaatggatrccagtttatgttatttcctatagtgcctatcttaaactgatttttttttttttacttgctgaatctcatttcatgtcaatatgagttttgtattggtaatatagtgtttgtaattgatgatgtagccaactcctttattgaagtaaactgtgaagctaataaaacatcttcatgttttaaggccattaggagacatttttttctgtgtgtgtgtgtgtgtgtgtgtgtgtgtgtgtgtgtgtgtgtttgagaccaagtctcactcttgtcccccaggctggagtgcaatggcgcgatctcggctcactgcaacctccgcctcccaggttcaagcaattctccggcctcagcctcccgagtagctaggattacaggcgcctgctgccatgcccggctgatttttgtatttttagtaaagagggggtttcaccatgttggccaggctggtctccaactcctgagctcaggtgatctgcctgcctcggattacaggggtgagccactgtgcccggccgtgtttttttgttttgtttttgtttgtttgttttttaacataatgaatactacaacagaaacataattaaatagcttctaaacatttgagaagatgaatggatcactcgtttctaaatggatagccaggagagttagttaagtatttctgatcttatagtgaatgataatgtttgtacaacctaatagttgccccttttcctttctttttcttctctaatartaatagcaaaaacattgtttctggcattcagtgagtgccagataaatagaaaggctatgagcttgatgcacagtttcttttctttttcctgggtcctctctcctcccaacctacatttcttggcatctttccgctgtctgtttgttagagttctgactctgacgtcaaggactcacagtgagtgacccccgtggcaaacctgtaaaacattatacaacatgaataagaactttcttattagatctgcagctggctgagtacagacatatggcagcaaggatgttttggaagaaaggcattgcttgacaaagaacccagtctcttgaataaaggtttatactggcactctttgatgtttataatacccgatgccaggggcaaaacttttttccccccattatattgttattttactgtttaaaccccatcattttatatgttgcggtggctaaaatgtagaagcagacattttatgtgtgtctgtataactttaaaaggaaaaaaaaaaaaaagcaaaactcaaaaaactttctcaggctctgtctacccggctgtaagtgttcgattttctgaggctgagactcagattgaaagtgagggagtttgtaagaatgggcccagtccttttgagcaggttttaaaaggatgattaaagggtacataggctttgtaatgccctgacaactttaattgtttcttttggtggttgtcctttttatcgtgagtagttgttctcagttgctaaaaatttaggctgggaataatttccaacctaggaggttgtcacactgatttgcatttggtttgttatttcttagtcttttcaatgcagccctgctttcatcttactccctttctcaaaccccagctactgacattatgtacatggttgtgttttgtgatctgtgctagcacactggtgttgaataatatattgtgaaatattctgatggtgacaattcggtagttgccccaggaggaatgatgacactttgaatcagaggcacaaggacagagaagttcaacctagtggagagccaaggtaaatgaatgaaagcttctgcctccacaaggaatatctaagtccttttagcatggttctttgcaaccttgattatgtttataatgttcaaaatctttgatgaggccattgtcttcctagtacttactgcatctacaataatttagtcataagatattgataaataaggtatgcccattggacatgcctgatgggattttaattaacatctgcctttgacaactgaaacaactgaagggagggagaggtacatgacttttgcagagcacatattatgacagacgctaggggtataacatctagcaaataggtacttgatgacatttttatgaatactatgatttatcaaaataagtatatcctgagaagtatatatttatagatgaaacrgtatttacagagaatagactctagtttagagaaactgaagagcattagtaaaagtgttaataagaataatattttaagtactatgagggacttttttcctggtttttaggttttcatgttaaaaattcatgagcaggacagatatgtttgtcttgttgattttatctctataacgggaattcaaattttaaatatgttctagaatcatgaaagtcatggctagaaaggtcttggagattatctaattgaggagtcccaaatctctaaataaaatctaccagaagaatcataggtcaattactacatgtataattgttccaaataggtttttccagaaagtgcagaaggtagcacagtcctcaccaagttctttcattcagcaagtgctatcaataccacttaccaagcatatattttacttggagaaaatgaaaattgctccatccataattggttgagagcccctttaggtataataataatcttccctattatgtagttgagaaaactgagacccatatactaagagttgaattgtgttttccccaaaagatatgttgatatcctaagccctaacacctcagaatgttaccttatttggaaatagggtctttgcagaggtaaccaagttaaaatgaagtcattatggtgggtcctaattcaacatgactggtatcattataaaaaagagaaatttggacacagacacccctggagggcagatggccatctgaagacagagaattctaatgatgcatctacaagccaaggaaccccaagaattgccagcaaaccaaacagaagccagggagaggcaaggattcttctcttacagatgtgagagagcataggcctgttgacatctagatttcagacttccagcctctagaactgtgagataataaattactgttgttctaaaccactgaatttgtttacctagttatgacagctctagcaaactaatacatcatagatattagtagtcatggtctcctggagaagtaattagcaaggtagtcaagtctggaacccagtttaattcccaggttcagtgctcaatgcctgtctctagaaataaaactttttaatttcttttgctgtaaagataaatgcaccgtaattcacaaattgttatgaggactatttttctgttgtccatttttttggttatctttttactgacttatttcatttataacacaatcttgaagtctgataatttcaggtacagacttcatttattaaaataaaaactcaaacttgaggagacgaaagttattcgatcatttctttcacttcccacagttggttaatgaaatctggagaataatataattgttatatctttttctttgcttagcgtaaacactcaaactataagttatagctgataacactcaaattataacttataagctgtaccataattcatagtagtcaatgaattagtcagctaaacttgaacatattactacaacttatgggcatacccaactccagatagtagaaataagactcagagtatacatttcatgagataaatctaatgtgagtatccaataatagattcaaatatttttcaagaattgactatgagtctgtgaatatatattaatgactatacaatacttttttttttttttttaagagatggggtctcactgtgtaactcaggctggactctagctcctgagctcaaatgattttcccactcttagctcagccacactctgcgtagctggaactataggtgtatgccatcacgcctagcttaaaatatattttattaagaattggtgctatggaaaagtattgcttcaaccatttcccccttttcaagctaaaattaattagtaatttaaaaagagacatgaacatcaacaaattaaacaatggaacaaggatcattcaagtcctcctataggcctcttgatctgtacattaattggaataatggtctgttctttttgtagaaattaatcatgttcttaaacacctccatkcagtgtaagttctgactgtttaattaaaactttatagtaagctcaaactgggatcctgaaaatgaaaagatattttttgttatctggttcaggtttttgttaggatgagcactctcccttatgataatccagaggtctgctcctttgaaatgtcaccccaaagtaggttgcttgaagttcccagaggctaagagggttccccctatcaggacatagttatgacacctacacagctcccctcttagcttcatccctcttagaagagtttctatttatcttcatattctgagacgaaattgttccatttattctactaacctcagcaaaagctggttatgttaaaaacaaacaaaccaaaaaacctaactgcatctaggtaaacattttcccatatttgttcttgcaagatggctgataaggcattataagtggtgatccctttattccatcattacaggaaaaaataatgtttatttgatgtgaaggggaaaaattaaaattaaagataattctatacttcggatacttgaccatattaaatttacaaaatgtatagttgagttttaaaatcacaatataagtagatttcttctactcacaatcattatattagataagaaggtactcctcttgatctctcctttgctccatcataaaatccttactagatgggtaagacggtagttgtgataagacagtagtagcctatcctgtcttatacgtttctgtgaagcccagagaggtgacatgaatttctgaaggttgcagaactgagacttaaaacttagtgtgaaatttattctgttggaaaaaaaaattgcactgtaactatttctttgaactttgggaagtatatccttattagagaattacagtgtcaagacattgcgctattattaaacaaatgataccactattttgacaagagtggtactttccaaaatacctaagaagttaattgaagacttggaattatcagaggatttattttatgttgaaaattctgacttatttttaaattgtttattccatctcataaacttctatttgttatttaattttaggaactttgaaataaaagtttttttttttaatatatcttatgtcctgtgtgcaagtctaatggatagatctgtaccttgaagttccaacttctgccctcagagatgaaagtgacaaacagcaaaatatggagcagatacattgaaaactttaagaaacttaatttttatttagtttgtgcttatttactaatatgttctctgaatgcaaagtaagtatacatgtagagtcatctttatgaaaagctatataaagagctataaataaaagggatagataggtaagacaaaaaaaggcacactgacaaaatctgcggtaagaaatataatgagttagattctaggcatttgtcttatttaacatggagtaatttgtggatatatatatattgtgtgggtatttgaaatttatgtagttattttaaatcatgtaatttatttatgcaattattttatatttatgttaacttatttatgtaatgattttacatttattaagctgacgattatggtatatggaacttaaaggtataaatatacccatttatggtatatggaactgaaaggaataaatctatccatttaccaatcagtctgagagattctctggtttcttacaaatacagattggcaacaccgatgtggttaaacatgacaggcaaataactaccattcaatgtgaatattagcaatactgacaagagaaataacatttgggttgaatagatacatttatgtcaggtttttgtgtattagtttctctctctttttttttttttttttgagacggagtctcgctctgtcacccaggctggagtgcagtggcgcgatctcggctcactgcaagctccgcctcccgggttcacgccattctcctgcctcagcctcccgagagctgggactacaggcgcccgnnnnnnnnnnnnnnnnnnnnnnnnnnnnnnnnnnnnnnnnnnnnnnnnnnnnnnnnnnnnnnnnnnnnnnatattaagcgtcccatgctatattgagataactttcaaacataatacaattatggtagtaataataatttggaacttcaactatactacttgacattttagcatttatgtaattaattagttaactaacttgtaggtgccaggcacagctaggcctaccattaaggagtttgcatttttttcaagatagttatttatagtacagtatgaaaagtacacaaattttgagcagtattttccttttttcatggcttcccttattcaacttctttaagtaagtaaaattccacctcagaaatggttatccatgttccctatctcctccattcctattgtctctgccttgactcaagacctccttatctcttgcctggattatagaactgtgtcataacaggtctttctgcttggagttacccaccttcacttgaccacaatctgtgatacccagtttctttttctttttttttttttttgttttgagacgtggtctcgtcctgtcacccaggctggagtgcagtggcgccatttcggctcactgcaagctccgcctcccgggttcccgccattctcctgcctcagcctcccgagtagctgggagtacaggcgccaccaccacacccagctaatttttcgtatttttagtagagatggggtttcaccgtgttagccaggatggtctcgatctcctgacctcatgatccgccccgcccccctttggactcccaaagtgctgggattacargcatgagccaccgcgcccggcccccactttcttacactgtatctttctaaagaataagtctgaacaaagtagtgactattttaaaccaatagtatacatttactaaattcttagcctgcctttcaaaattacattcagatttttccaccattttctttttagtgcatcttaagtacaggtcatccgtgcgcccgtcttttttctgagcaaatcacctgtgtactttcacattcttagcatctgccaggggtgttccatatacctggcatgatcctccagcccccactacccgacctactttatttcttcctggtaaaaccctcttcaaccttcaagccacacgttatgcagcctttcctcgcactgagaaacagatactttaagggttatgatatttattatattgtaattatttacatgttttgtttccctctagagaatgagagttcctccaaggtggagactcattcagcttttcgtctctcttacataacctktgcctggcaggttgtaggtacccagtgattattgaattagttaatatacgcaatatggatttgcttgtcagagcatgagtatccatggctttctgaagtccttcaacctttgcttgtgctacttcctctattttggtcctcttcaataggcgaggtgattatgatctacctctaatgggtcacagtgaccccaaaggcaaagcaatatattgatctcccttaaaaggatgtatgccacgaaataagtgtttttatcttctcatccatattcacatttatactttaagtgcaatgtcctgagtgagacaaaccttcacactaatctgtgtaattaaaaatattgaaatctcattgcttggcaaccactctagacctttggacacattttctggcgctgttaagggggctcaggctgcaattgagatatagattacctatttaaaggaatcatatttttcccctttgaaatgtctgtcctttatctccttttgatggattttctaatttattaggctttgcttttttgggaagtaaattatacctgttgacacagttgcatcctcatgcaaaaacaaagatgatatcattaatattttatggcttaatcattaaatgtgaaagggtgaaatgcttgtattgcaattgaaatgaatcttgaattgaccaggtctttctctgtgggaataaaaagagaataggtatgaactttaataaaaaatggtgtttaactctacatttagcagaggtcttctaagtaattttgccatcagttttcttcccacaaattctcccattacataaataatctgctattatgttgatagactcatctttctgaaatatagacatgttcatataattcatagtttgaagtgtctgatgtctcctcttgcctttaaagaataccctgaactcttaaacttcacgtataaggttccatctgtcttgaccccaatctacctaggatttctcctcatccctggtaatctatacataccttaaaacccaactcaagcattacatgctttctttagctcagttttcactgatgccccagcctcttagggaagaattcattgtttccgtatttgtgaattatagcacctacccattcatatgtggaggaataaaatgtagagagtaagagttagtgtttcaaaggcagaccttctggctgtttgcattctgtctgtgggaccttcagaggattccacggagtaaaagcactctatgtgtcccagttctatcatttatgagagaggggaaataatactgctccagaaggttattttgaggatttttaaaataatgcatgaacagtacttagtacatgcctggtacacagtaaggactcaaccactaataaaaaaaatgttttgtgtgcttacattttgttttgatatgcttacatatttttcttccctattaaaatgagatggccagaattctgtcttcgttgtacaggcagcatccaacagctctcagcatataatattggatatgtgattattaatatatgtaaagggtaacatattggtcaaaacattaattatttggagaattattcgattaataaaatatgttttatacatattaatgctgaaatctctgctcaagtgttttaagaggggatttactcacagaaaataaaggaaaatgaaagctactaggtgaactatagtttaaaataacaaatccaaaaatgttagatattgcatctcttcagtggagtattatgcctggagccaattttgaaataaaaacaatgtaagtacttacaaaatctccatttggttcagactctgcaggtggaactaatgtaagtggaaagattcctaaataattccaaagtcactatgaataggaataatgatcatcatacatatacttatcacttctattagaaataagccatgcttatacatattgtttaatatagccaaaatatcttacacataaagaagttagttataattccctactctattcctcaatatttttaacagtgcttctcaaatttaaatagggatgacaagactgatgtttatcaggttttcctcaaggagatcctttactgtgaggtgtgtgtgtgtgtgtgcatagaggtattattgaaatatgattcacataccatgtgatttatccacttaaagtatacaattcattgttttttagtatattcacaaagttatggagctatcgccactaatccagaacattttcatcatgtcccctaaaacacctatgcctgttaacagccacttctcatttcacctacctctctactacttccaggcttaatcaatgactaatctattttctatctttatagatttgcctattccagacttttcttataaaagtaatcaaaatatttgcagtcttttgtaattaccatctttcacttakcataatgttttgaaggtttatccatggtgaagtatgtatcagtactacttcatttctttttgttgccaaataatattccattgtatggatataccatttttgtttatccattgattagttagtagacattttagttgtttttgctttttggctattatgaataatgctgctatgaacatttgtgttcaaatttttgtgtggatatttgttttcatttctctggaatatacatctagaagtgaaattgctggatcatatggtaaatccttgtttataagtttgagaaactgtcaaatggttttccaaagtgaatgcatcactttgcatttccactagcaaattataaaggtcctcatttctccacatcctcaacaacacttgttattttctatgtgtgtgttttaaaaatggtttttatagccatactgatgggtataagatggtatctcactgtggtcttgatttgcatgtccacagtagctaatgttgagcatcttctcatgtacttgatgaccatttgtatgtcttctttggagaaatgtctatttaatcctgtgcccatttttcagttagattattttcttttcattattgaagtttaagagttctgtatttcatatacaagctttctggtataagtctcatatcagatttatgatttgacaatattttctctcagtccttgtattgtcttttcactttcttaatgccattgttgtgtgtgcttatttttaaaacaaaatctgatgacagattattctaaaggctagattttaaggttgatatttgttttcatgatgcatctactattatttattttcgtattttctgaaattattagttttttaattacagctataacattttgaacaataaaattcttaattttagtgttttccaaaccgtgctctgtggtacacaagatgctccatgactaaggtagattgagagatgttgtttgctttatttcttactctgagcacacaatattaaaggccatatgatattctattttaaaaataacatgtctagcccagcatttccaaaagccgttttaatctttttccctgaaacagctattaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacawccacaagttatttctaccatgtttgtttaactcaggagattgaatttgatgtgttatatacatggtatgaaccaaacgcataatagaaattgggtcttctctaccaatcagatagttagaaagatatgcttttacttcagagaaaattcaaagtcagctaaagtgtgtaggtctgtttcttttcaatttccagggccttttccattatgtatttgctgcctaccattattgctactattccatgaaaaatcgcactctgtgtgtgtgtgtttagatttgtatatgtctgctcaaatagagcttaatggtgacatttttatggcttcaggatgttggggtggagggaattatcttcccctcatggtcgctttgtgtcagatgatcattgcttcatctctagaatcctatattgcttctggacagggaaaataggaaggcagaaaggcaaaagagacaagctagctgagttttcccctttttaaagactttccttagaagcttcacacagtgacttctgcccgtatctcattaaccaggactgtgttccatgatctcctgatctgtaagggagttaaggttgggggaaatagtttcctagctggacccattgccatctctatgagaaccagggttctgtgaataaggaagaagaatacgacgtattataggatggacaactagcatttttgtcacacaaggcatgggatgacagaaaattctgagagtgaagagctaaaaattctttactacttgtgtattcaacagtagaattttaaaaatcaactccttattgtagcctaaaccacctgggttcaagcaatcctcctgcctcagcctcccaaatagctgggactataggtgtgtgtcatcaggcctggctaatttctaaaattttttgtagacgtgagatcccactacattgtccgggctggtcttgaactcctggactcaagcgatcctctggctttggcttcccaaaatgttgagattacaagtgtgaaccaccacacctagccttattttttttttttcctggacaacaccaatcagttattctttttaaaaagcatgtattgaatcccttaacacgtgccaattatattccacatagcaaataagatccataaggtttctgctatcctgaaacttactttctaaaatggaagatagacaaaagcaagtaccggttgagaatcccttatctaaaagggaccaaaactgtttggagtttggaatttttcagatgttcaaatatttgcatatacataatgaaatgtcttggggatgggacccacgtctaaaacacaaaatttatttatgttttatgtctaccttatacacatagcctaaaggtaattttatacattttttaaattttctttataaaacaaagtttgtgtacattgaaccatcagaaagccaagatgccactatcttagccacccatatgggcatcctgtggcaaaaaaagtttcagatcttggagcattttggatttttggactaaggatgctcgaactgtaatgaaataattacacaaggttatttcagattgcagtaaatgcaggaaacacacttggtcatatgctgaagagtgacaagagaagatgagggtaagactggccacttttgttcacttaataaaacccagcacctaataccatgcttggtgcaggataggtgctcagtaaacgtttgtgttggatgaatggatagatggatggatggatgatcagtcacagaaagtgtcctgaggaagtgttayttgaagtgacacccgaagaatgaaaatgagctgacaatgctaagaaaatgggaaaatgtattctaggcaagatgaacggcatccaaacctttaggttatatcagtgaaatcaaatttaattctaaaacaaatgagaagccattgaaaggtgttacattgattatctcatctgggcttcacaaaaattacgtgaagtaggtagtcttattatttccattttgcaaatgaggaaacttaacctagaaattataaaatatccagattcacagagctggtaagaatgaaattgggatttgattataagaaattcagctcgagtccacccttaaccactgtgcaatgttgtaaactataaaagtaaactgtaacaggactagattgtttaaacagcaagtaaaagcctgaaaagaagatatctgccaatttaatggattcaatttttaaccacattgtctattagtgactcttatgaattgaatacatagcacagtttctcagagcctccactgaccatctttctctttcaaagtaaaaattgtctttgtatattacattatggactggattattataaaagatctagtttctggttctaatgaacgctgaaatatggaattgctaaaaagtaaatttagttagaataacaatagcttgatagaggaaaatcattacaaactcaagcggagaattccagtttagctatgcccttgaagttgttattatactttgcatataatttattgattctgaaaagttggatttgccatcttctgagaatattatcttgggcatatggggcacaccctgcaaccagaaacagcacaggaatagtcattccttcatgacaacttctacgaaagtgtaaattgaggctaacaggraaatcaccctattactcctgtaaagtgacgatagctttcagttttcaaatgcgactttctgatcatgtttgaatgtgtttctgttcatgtttatggagaaatttaagaattagaattgtgattcttaattctaattcttaaatttctccacaagtaataggaaactaaagaatttttctgtggtaatttcattaggaaaactttggctaggacatggtgataatgtgcagatattttgtttgccatgtcacattcttccccttcttttctggaatgcaatcaatggtgaaacatgttttacggtaaaacatttaatactccaaattgtgaataaagcaaagagaatgtgtttaatrtattttttaaatcatatactttctttaagaccctctcactcctaacataagctagagttttccgtttcaatatataatcaaaaaaccaagtatcctattaagtgtatattrttgactcaaattgacaaggacattggtaaccttccttttttttttttttttttttttttttttttttgagacagggtctccctctgttatccaggctggagtgcagtagtgcaatcgtagctcactatagcctcgaactcctgggctcaagcaatcctcttgcctcagcatctagaatagctaggactaccaggtgcacaacaccacacctggctaatttttaaaatattttttgtagagactgaggtctcactatgttgcccaggattgtctcaaactgctggcctcctcaactgatcctctcacctcagtctctcaaagtgctgggattacaggcacaagccaccatacctacccctctatttatttagtttttgccttcaatcaaggatacagtacatcgcatttgcttgaaatagaaaaaaagaatgagcaagtctctcggttcttgtacttgtggtaggaatagagacagagaagtacctggttaattatttctgcacctgcaattctaacgacctcagttaactacagttttaggtcatactttactcttcctttttttctatttcttcctttttccttgccacatcatctattccactttattttcttttattcctaaatagaggtctgcataatatatcactaagaggaatacatttgcaataaaacttttttctgcaaaaaaagcattggttttattgtaaacaaacctctgaaattactttcaacatatcaaatgggtcatggacccgtgaagaattgagggggaaggtcaaatttaggggcagagatgtactgtaaacttagtcaaaagaatatcttcaagtcttataataaattactttcttcagcatttaagaacttgaacacaaaatgcacatgtcttgttaaaatctaattgaaagtggaactaaagtaatttttggcacaaatcggctttagaggacaaataagaaagccaagggtcgcgtaatggggctagtatatattgtagtccgtctatgcttttctcaacaacctcccaaagtctagctgattggggagtaagaaataagtagcagggaaaatgtttggaattttgtcttttgctgaaggtttcttggcacttatgaaaacttcattgaatgaaataagactttaaaaattttgtaaaagactttttggaaaaacgtaactttcacattaaaattatataaaaaccaattcagtatttttctcatttataagacttaaaaatgaattcaatgttttaagtcacaccaattactgagatatattttttaaaattacctatttatcaattttaaagaccatttctaaaaaaggagtttaagtagagaatattcctttgagttagatagtttttggtatacgtaacagcatacacacacacacacacatacacttttaattttcttggacttatatattttaggcccataaatgtaaaccatttggatatcaaagcaatgtttatgtttttcagcacgtaattttaatgctacagtctgagaaattgtatgttgtttaaatgcaatacatcacaatgtttgataaataaaaataaaaaccgttaaacctatccaaatgcaagaactcmtaaatattgttgagttaaagcttttgatgcagctgaggctatgtctggattttattattttccctaggatttccaattttttctaagaaaggagatcaattttatagattagtctcctgaagttgtgccagtgggttcgtctgagttttaataattttctgtagaaaatagccttgaatgtgtcttttcacggggcatggtatgaatgaaacctaaatatatagggaaacagagatattagcatgatccagtcataaaacaacaggtgaagagctagaaataataaatgaggcctttattttattttttatttcctactcatttactcaaattgacataaataatgcaagaggtagtttgacaaactgtacaatacagatttatagtcacattaattggtgcttaggggtttgggtttcacctgaagttaagttcatatagttaataaagtcataatgccttgtttaaatatttcatgagaaaattgcattttgttttgtctactcagaacctaaaatctgttttattgtggttattttataaatatttgcatggaatttttggagtaagtttatttggtttgtttgttttttttttaaacaggcctaactatcaattgcattggaaatttgattgtgtttccaactaacaaataataatacacctggaagtgcaagtcctttccatattgaacagactctctctagcttttccttagctgatcttttcaaacgtttgctatttgggcctctctggccccaaagagtagccttttgctactctttacgcttgaggaagattaagctatcccaggcctctcataaccaaggggatccattaatattaaaatttagatttttccactgttaatgcagaaaaccattgattcagtagacttcatggtcatgcacatgcgttacatgttactctgagtaatgctgcatgaagttttaattacagattgatcaaattctataaattgtgttttggcgtggccaaggaatgggtttttcctattctagtttaatagaaagtcataatatatatcatgtgaattttacgtttctcaatgaattagattgcaacaatgcctaagtttgattatatacttattaatagtgataacaattatagctcacatttagtaagtccttactatgtaccaggtatataaggctttttaaacctaatgattcatttaatgcttacaaaaccatacaaattggatgctattattagctaagtcatggagacatgaaactgaggcacaaagacattatataacttgtcaagatcaagtatctggtaagactgaatatcaagtcagaattgggatttgaaccagtctggactctagagctaacatgcataacatatagcctacactttttaattattcagaaggtacttcaagactcctgtggtgcctttgggttggcagtttcagtattttttatgcttacatagagcataagatatataaatataaaacattatatataatatatattcaaatatatattttatatgtgtatatatatttccctaataaatattgaaagaatgcacacatgaatgagtggatgggtgaatacagaaatgaaaaatttgtattgagatgtgctaatagagaatttggtataactaaacatctgatatataatttatattttgaggtaactctttagccaacattttaaartatgattaatttatagtacttacgaaggattttcagagacattacatttttctgttatttcactgttttaaacaagatggagattagagggtggaaaatggattctggagaaataaacccatcatattaactataaccatgagttccttgaagacaaatcaaatctgatgtcttttctttytccttatgaatatacttcagtacgaaggacctgatacttagtttggacccagtaattatttattgttgtaagtagcacagtaagaataaaaacgtttatgatttgcaaccagccaacctatattttaatccatatttaaccactggctgggttatgttacatttctcctctcttaactcatttccatatccataaaatatggagcatatgcctctatggtttcttggtgatgaaattatgtattaaaaattataaaactgtaaaaaatatatctcaaaatgtgtttgtgttccatggaaaactgtaaatctctcttgaaacaaaaaagtttctataatcacatacttctagaaatatttcatctgagttcctttaaaacttcctcaagctttaacatgctaacaggtactgggactatccaaggagggatgatattttgcagaatttcacaagcttattttactttattaccatttttcataaaatacctcacaggaaaacttaagcatgagactgatgtgattacattattattaatagtctccaaaattcaaattagcaatagaagttgtaaaaatttcaagtaatcaggataaaccagatgtattaaatgaaaataatggaagctttgtaagattagtggcagcatataggtttagaggaattattatcattgtgataacagggacagatacagaattatggaaacattctaaagcagtatataggaagatcattatcagaaatagatagagaaattgtagtagagaggctagaatttcaaactccagaatatctgaatttgcctctatctgaagccttctcattcccagtgcttatgaaatttacactggctgctatattgaaatgctaagaatcagaatcagggatttagtatcaatcaagtggatggaatttagctagttatcaccaactgtgaaaggaaaaatatccgttaaattcagtcacaatgctatatatcaggctctcagtgattttttaaaggagggtcaattttaagaattctaaggaatctctttgttcctgctaatttgtcygaaggtttacgaggaatacaggagaaagctaaattgtttggggaacagtaagagatttagattctgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgtattttgtataatgtaatgatgtcctcttgtctccccatgaaatcgtcagtgaaatcaacatcacttgctaatacattgtagagtgggattgatttgaggagcggggagatgtgatgaagtagctgtaatagaggtattgtgtttatgagactgtggctgctagtcacatctgttttacccacacgaggctgatgtggtcttctagtttgtaaattatgatatgcaggcggttcctgccagcagagatttaaaaaaaattatgcaggtgggtaagtctttttcagcaccacctgtattaggtctttctagatcccaaatcccagtattgacgactggagggctgataaacagtatatggcaaccccaggaattctgttagcttctttggcctaagccccggaccaaatgcagacttccactcttacttttctgaagagtgcaaggtaattttgacattcttactccgttaataagaagagacccaggaaaggaccaccaaaaaaaaaaaagaacaatttcccaaaatgactagacaggtgctgagactggcctaaactatcagagatcttcccaatccagagcactgacctctgctagagcctgcagtcaggggagacatacagttcaggctcatcttctcacatggaatgctgcagagagcaaatataggtagcatagaaattaaggaaaaagagtatgccaaggaargaatccaatcaaacatgcccaggttaaagaagtgcttttagtttcttatcaaatcaaaaaccgtgtgctcatcagagtaaatgtggttctaaaaggcaacccctgctctcatgcattttgtgactcttgaaaaacaaaacccatatgtaaagggacaataaaattgtactatttagtatgactaatataagggtgtctttgtggcatgtggtgcatattctataaattcttgttgtattgaatggaattaagtaagagtttggggacagaagaatccctggtgtattagtatttccctagataattttttcttgtaattttgaattaatgaagctaataattaacttgtagaccaattttatactaaaggaaaatagtaaataccaaatatatagctatgatcacaaagatccaatccctttttaaatttaacatagagatgctttgctgctcctaaggtaccattcctgctcccgcctcagagcctttacatcttctatttcctctgtctggcatgcatttcccccaggtttgtgtgtctggctctttatacaattatctgataaaatgtcacttttttcagaaaggactttttcgatctactgtacttatataaacttacctctgcttccagcccctaccatccattacccccacttgttctcccttcgtttattctattctaagcttctttatagctttatcatcacctggtatactatgtttctgtgtttrtcttcttccttcactaaaatataatagccaggaggcagagatacatcttgttttgttcaatggcatacagtttgtgcctagaacagtgctttgcacataatatgcatacaatacatatttacttaatgagtacatgatgaaatagaaagtggactgtgtggtaacctttacatccttatatgtatattagttttatatgtcttcagaaatatgttttagccatcttcagctgctgtaaaagaatagttttcttgagagtagtgcaaagataactgtggtgactattactttccatcgttatcctctttttttcatatctaaaacttctcacctctttaaggtacacacaaataataattttttatttcccatctagttacagtcctccttcagctttcatccctttagtaatagttgtggtgaattttttctcccgagaagcycctaaaaaggcgttcatttttacgtaaacaaacaacaggagaaaaacatataaacatgaaagcaaaatattttacctacagaaatatattttcagcaatctatttctcatgctattgttaaaaatatctctrcttggatagaacctttttgtttccatgctgacttcttctttgcttctcctgtgaactttttaaattctgtgtttggcagcagttttgttttccttggagctaagtactgtgtaacatactgttagctgaaggctgtgatgtagaaatttattattaaaaataaaagacggagagaagaatttattccataaggatcaaaatgacttagtgtcaaagcagttaggattttcaaaatgctttctataacagattgtgtttcttttcaaggaagtttactttgtttgccaggaataaatttaagggtcttcattgtgcctatcttggttaatgagaactgagaagagaagaaacattctcttttaaaaaaaattttttttagagaatttcttcatcagacggaragattttatttgccatttgcaggcataaccttggtgacctatatatccccagaccttctggtaagatgcttattaaaatgtcattacccagaggagtaatcataaactagccagagggtattttttatagatggtgagagacaaacattttttttctccctgaattaagtagttatgtactcttatcaactagaatatatttaaacttacttttatttatttttccagtctcaatctctccctctctgttttatgtttctagcaactttatgtaactaatcttaaaatcattagcattccttctccaaaaagagtatcatatcatcttaataaagtttctcttttcccagaattgcttaagtagcatgctgctattcatttctcttgaaaktttagtcaaaatgaattattttgcaaaaaggaaaattccacagtttctatttcttttcctcattgtctgtggcccattaacgtcttttatctgctactatgataatgtcaaatgattactttggtcatctgcaacttaacactaatcttatctgtttaattgaaaggatgttttgactttctctttgaaataatatcaacatcattttgcacttaattctgaaattcattgacctcaatgtgcaagctgtcttctttactatttattgtgaataaccatttttttttatttgttgtaatcacacatcargaaagggctagggagatgtctttgtgaaacatttatccctatggttctgtttaataggagtacttaccagtagctaaatgcctcattttattttaaataatctgtaatattaagtcagtttatcacactatgagtagttttttttaatggattctgacaatatgctgcttattgtagtctttcatcctttatctgagaacwatgtttttatgacagtaaaatattttttatacaaataggataaaaattcatatgctgtcatgcgctaatatgaagtttatccttacatctcccactctccaccccatgccccatctagtggccagaatgctgtaatcgtgggaaggaataaagctctgacactatgcagtccctacccccatcattgcctctttctttgcattaaaaaaaaaaaaaagaaaatacactgaaataataaatgctaaattttggctcagattattttaattagaaatggaagtttaatgataaacactttgtattcttcaaatccaaaaggagaaatatcctgtttacttcctttggtgctcttattgactgtagaacattacagtatctcatttgtcatatgcagagttcattctttttgaatatatttcacataggatgtagatttctgtaacattttttattactttgaaaaaagtagccatagtgtacattttaaaatactaccacattcttggtcagctcatacctttcaaatataatataaagatgatattaatatataaataagaatggaaaagaatttctttgccctgcatatttctcagtttgttatataatgctaggaaataactctctgatacataacacacttggcaaattttactgttttatgctttaaaagaaaaagtcaaatttagatagtgaattttttgaaatgcatcttacaagctctgatttgcaaattaccaaattgatcttatcttctggagtaaatgatgacccaaattagtctacattttgagtgtttttgttctttgactaaaatcgtcatcgttaagataattaatggcagaaggcagtgaattacatgctttcctcattttaattctggtcctacaaaaatgtttcctttttgacttactgtcatcatgaaatattctctcttaaatcaatatattgtggattataacttgtgtttgtaagatttatttacctcttttagttgtgataggagaatttaccaccttattttgatcctgttagtttaaactcattagcaaggaggataacagtgttaatagtcagcattttgtaaatcttccagaagattttgataaatcatttcactagaagcctattgctcaatttattgccactttaaagttgccaaaaataatgagctcatcttcctattttaatgtaaggtattgtcaatgtttgaaatgtgtcaagaattgtttttgatagttctagtgaacaactaatgtttctaaatcatactacttatttcattagttaattattgcttgtgaaccatattataatcatctttagtatcaataaatatttttgagatgatataatgccartaaatccataaattaaaaaattaaagcattaaagaaatayctactatgtaagcattcaattttatataatgattatctgggtcagtgtacccaaaattgtgtgctagccaaactacaattaaatcatcatgataattccaaggcttaaaacaattgactatgtctgttaaaaatgagtagcttaaaattcattaaattactttgttatgttttttacctattatactgtgaacatttcacatgttcttttttataaaggccttggaagccaaattttaattgctctatggtatcaytttgtataccgtaatctattgagtaatttcccttttgttggataaacaattagtagcacattatagttactggatttttagatcttagtttactggttcaaagggtatgaatttttaataatatatgtattatatatattttatatgtgtgtaaatatatatatacaatgtgtataaatatatatttgttatatagtagcaatatatatgcttagtttactccctgttttccaaatattcaacattattaatttgcaaatataataggcaatagtagtatcttgtcattgtttatattgaatttcttttacttccaataaagttaaatgtctttccatagatctatttattttgtaagttgttctcactcttccctcagttttttactagggttgggattctttcaaatttgtaagaacccttgatatcttgaagatattattctttacctaagtttactacagatattttaccaatgtgacatttgtgcaaatactctaaagttttatatagccagatcaatttgtcctcttttgtaataaaaaaaaaaagtctttaaaaaaagatttacggacaggattgacagattgatagctctttctcgattccgtgggtggtggtgcatggccgttcttagttggtggagcgatttgtctggttaattccgataacgaacgagactctggcatgctaactagttacgcgacccccgagcgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactgggacaagggcatggcctgtgtgggccgcaccaaggaatgtaccatcatcccgtccaaccactacggacccatcccggggatccccgtgggcaccatgtggcggttccgagtccaggtcagcgagtcgggtgtccatcggccccacgtggctggcatccatggccggagcaacgacggagcgtactccctagtcctggcggggggctacgaggatgacgtggaccatgggaattttttcacatacacgggtagtggtggtcgagagctttccggcaacaagaggaccgcggaacagtcttgtgatcagaaactcaccaayaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcccggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccannnnnnnnnnnnnnnnnnnncgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcasgagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggttttttttttaatttttttttctcttaatgaacacattttctaaatgaatttttttgtagttactgtatatgtaccaagaaagatataacgttagggtttggttgtttttgtttttgtattttttttttgaaagggtttgttaatttttctaattttaccaaagtttgcagcctatacctcaataaaacagggatattttaaatcacatacctgcagacaaactggagcaatgttatttttaaagggttttttttcacctccttattcttagattattaatgtattagggaagaatgagacaattttgtgtaggctttttctaaagtccagtactttgtccagattttagattctcagaataaatgtttttcacagataaaaataaaaaaataaaaaaaaataaaaaaagatttagatttatttaattttttttttatttcccaagataggttgagtatttacctggattttattctattttatatttacagttttgtctttttaaaaatttgtcttttaaatctataattaatattaccatttattataaggttaggctttaattattttttaccctcaaaagtctatttttctttttctttcttttttttttctttttttgtgagacagggtgtcactctgtcattcaggctggagtgcagcagcgcgatctcagctcactgcaatcttggcctttcaggttcaagcgattctcctgcctcaacctcccaagtagctgggattataggcgtgccccaccacgcccacctaatttttgtatttttagtagagaaggggtttcaccatgttggccaggctggtcatgaactcctttttttcattagttgaataattcatcaaatacaaaatatttttgatgttttcttgcttatattttgttagcacacatacgtatatttattccaaattatttcattcatttgcatttttaatgctaaaccattatccccaaatttggttaagttttataatatatcttaataaccagaaaggtattttcatcacttgtaacattttctaatggattcctttcttttgagatggagtctcactttgtctcccaggctggagtgcagtggcgtgcgatcttgggtcactgcaacctctgcctcccaggttcaagcaattcccccgcctcaacctcccaagtagctggggctacaggtgcacactaccacgcctggctaatttttgtacttttagtagagacagggttgacccgtctggtctcgaactcctcaccacaggaaatccgcccgccttggcttccctaaatactaggattacaggcataagccactgcgccccggcctctaatggattcttttttattgtatatacttgaggtgtacaacataatattttgatgtatatttacaatgtaaagtaattactaaggtcaagtaaattaacatcgatcgtctctcatagttttaactttgtgtttggtgaaatcaccgaaaatctaccctcttagcaaacttcagcacactgtataacatcatgaggtatagttctcatattctgcgttgtatcgctacacttattcatctgacataactgattatatatgtttatactctccaatgaaatttatattctttcaaaattaaaaatactgttagcttttgattgaaatctagttaaacctgaaatctagttaaatttgtttgagtagaattgagcactcaatagtttatagaattaagtcttctttaccagtagcactgtatgtcttcagtaaacttttaccattttctgtatatggttatcaaacatttcttgataatattcaaaggcatattatttttgttgctattgtgaacagttgtttgttgttaagtctacttaggagtcattgctgctatacagaaaagctaataacgtacataaattcatttatagtccatcttattggtgtgctagcttattagttgtaaatacttcttcagctggtactgatgactaataagattactgacagatgaatggagtttcatttctctgagtcaatatcttttatttccttaatattcttaatgttaaatgttattttcaataagtaaatattcttctttgtaagcaaggtagctcagggctattaccaccataggaataacgtgatgatattttataggttattattaaaaatctacgttttgtgactatgtgggcatatttcatattaaatatttaataattttactctttagaactctcaagatttttatagttttgaaggaggattaaaaattattgaactgatttggccttctggttcttatcatttgcggcagtagatttaactgcagtagtcatttacccagaatattttcttaaaaagctaaaggcttaataatatgcaaataaagctttacatggtttaacatctatctaggatgttcctgacagagctacacagtagcttcttttatcacacagtgatattaaaatactctcaaaatgattagaagttgaaatattagctatcaaaccaggagtttgctactaatttaggtatgttaatttattcatgatagctatttaatatattactaataaagattggaacaacctgattattctttaaaataaagaagaaaaatgtttgtcaggtaaaataatcatttaacttattataattttcatctttccagctcatggggcattcagaatgggaccacaaacgagggccaagaggatcacaggtaagtttcttttccttttctttttcacgtttcgtttcgtaacactttcagccacgggttttctaaaactcaagagataataaaatgtagagcgaggaagaggcaaaataaccatgccatttgtttttatttaagttaactataattaaagtctggatttcaaatcccaaaggcagatgccaggatattccttctaagagctttctggtatcccagattggttgtgtttatatgaatatagattttatattcatcttgtctcggcagaatacattttgatcagcaacccactctctttattcatttcctttgacaatttttccgtgtattttcttttttcttcagcttcctgtttttggttaaatattttgaaatataatcagactaaactctgaactaattacaagattttgtctctaaattaactctcttcatctgagggaaacagaaagatgaaaggacctattatttttgaaaagaaacaaattctaagtctttctgtattaccagagtgttttcattgtcttgctttatgtcttaggcaaagagaaaagcttccatgacgcatttatgctttttaatgacctaattagacaatgtggatttgttttgctttcataattactttccctgatggaataaaggctgagctttacactgagaaaattatttctcctcctagagcactttgtgaagaaatgtaaaaataatttctctcatggcaggctatggttacctgactgtaaacatgcaaaataaaaattaagtgggtggaaatttttgcttctattgcacacattttgcatttgctactaaaaaatatataaattacaaagggcagttgaatgtgcaatactgtaaatgaaagttcattggaaagtgggggcttctcccaagtgtttacaaagctgatttgttcttgtgttgtcattaaacttgtgtgaataactctatttaattccggtcactaggaaaacaaaaccaagtcaatcaattgttttagttcacattttaatgactgattttatttctgtccagtatcaatttgattagtaaataatgtaaaccaattaaattaggatcatctaaaagaatttatgccttactttatttccctcattcttatctccccttcattttctctgaaaactcttcctctgtacacatctataaaattttaaatcaaaatttgctgcaaggtcagtaatgaagggattaaattaacatagagtaaattcttcatgattcgaaaccagtaaaaatgtaaagataagtgcaaataagaaggtccatggtttctgatgattgccaccaaaacattttgatattcaaaacatgccaagcaagttgttgaggacatgtctcttcaaagcaagggtagtgttatatatagaaaattattgtttaagatatacatcatttactctctattttgcttactttggtataatttatcttcaggtttagattggtcactatgtcaatataaattgacaaaannnnnnnnnnnnnnnnnnnnaaaaaaaaaaaacctcacaattgtacagtatggtttttgttaactttcagtataaaaaggacaaaatttttaaaattccaaatattgcatatagctagaaaatgtgagaattccacatataaacaaaagctattttcataaataaaatttgattatatttgaaagcctgaggtggttctaaaaagcaaaagcattaaaatcggcttgcatgaattaccattatcaacatcaagtcttttttggatctcttaaccagcaaaatagctattctaaatatagtatacctttgtcccattttgattcctcaactcagatgaaaactgtcaaagtaaaaaacaaacacaacacaccaaaagataagaacaataagaaccatagcaaaaaacattaaaaagaaagagaatttccaaagaatttggaaatttcaggtagataaattaagtcttaagtaataacctcttatctgatttcaattccctgctgacgaaataataataataataataataataataacaataatgttttcatgttttggataattgatcccttcttttattgctattatctccttggtcaatatgtctaaagccttccagcttttcaaggggaacttcagacaagttgcacttgaacacagacctcttaatagtttactccaaagccttgctcaagtcccatcttagttaatttagaactggtttctaagcacttcctatgtttacagcactgtggtgggtctaactgaagacaactgaaaagacaagtatactgctttccaagagctcacaaattatggttggaaatacagcaatatttgtatatataattcacatataaggcaatctgatagacgcaacattacatacagtatgtggtgcatgatgacatatctgtgaatgacagtatatatgatggtggtcacataaaattataataccatgttttcagtatgccttttctatgtttagatacacaaataccatttgttacaattgcctacatttttcagtacagtgacatgctgcacagatttgtagcctagtaacaataggctacagcatatagcctaggtgtataataggctataccatctggtttgtgtaagtatactctatgatgttcccacaacaaaatccccatcattaagtgacatatatacaaagtgtaataagactatatatatatattgggaggccgaggcaggcagatcaccagaggtcaggagtttgagaccagcctgtccaacatggtgaaaccccgtctccactaaaaatacaaataatgataataataataataataatagtaataataataagccaggcatgatggtgggttctgtaatcccagatactcgggaggttgagacaggagaatctcttgaaccctggaggcggaggttgcagtgagccaagatcatgccactgcactccagcctgggcaacagaacgagaccccatatcaaaaaaaaaaagactgcatatatacaaagtgagataggatttaggtggaagagtatttcttactccctagtagactaggaaatacctctgagaagtgatgatgtctgaggtgtggctttaaggatgggtaagctttcgaaagtacagaggaaaaggtggatgaaaaagctttggtaaaagtctgaactgagaagagtgtgggacacctttgaatatatgtgaatttttttataacttctgtataaatgcttttggatggcaactcttacagcaattactgtgaagggataatctggagaatgctatactttattgactagataggcagaggaagttaagagggtcaagagtttgaaactgagtactctaagaattaggaccattaacacagaacagtttagatgaaagatgatgacttcagggttggcaatattaagtgacaagtgaaggtgacaattccaaaatgaagtttcaggcacatactcgaggcctgattagaacaaagggtgtcagtttgggaatgctaatcatacaggagataattgagctcctccagtagataggcttccagaaaaatattaaaagaaaaaacagaataaaagtctgatttttggaaaatatgctataaagactagaaacaagctgaggagggagttaatatgagt

SEQ ID NO: 12551 - DNA, 34746 bp, Homo sapiens
accccaaatagcatgtacatttgcttcttctgggtgccagggtgttgacaaatacagagctatgttagcctctgtcagtcagtgtctggttaggaaaacagaagccctgtgccctatgtattccatcgattaatcgatatatatatatatatatatatttatttttattttttttttagacacagactcgctctgtcacccaggctggagtgcagtggcacgatctcggctcaatgcaatctttgcctcctgggttcaagtgattctcctgctgtgggtctcctgtagcactctaataagtcattaaattccacaatttgactatacagagctcaggttgacaattctgaaacaatttcaaagcagatattactcgtggctcaccgtggctgtggaaagacctccctccagcctccatggcctctccgttcaggcagttgtgtggtggtttttggagaatgcaggtcccagaggcaggctgcccaggtccacctgtgactacaccatggacaggctgtgtggtttggggtagatgactcagcttctttgtacctgagttaactcatctataagcaggagccaaggttagcgctatcccttagggctactgtgaggattaaatgagataatacacattaagcactgagatcagggtttagcacacaggaattgtacaataaatgtctattggttttgtttgttttgttttattctttttttgttttgttttagacagaatctcactctgtcacccaggctggtgtgcagtggcacaatcttggctcactgcaacttccgtctcccgggttcaagcaattctcctgcctcagcctcccgagtagctgggattacaggcacctgccaccatgcccagctaattgttgtatttttagtagagacggagtttcactatgttggccaggctggtctcaaactcccgacctcaaatgatctgctcaccttggcctcccaaagtgctgggattacatgcgtgagccaccgcgcccggcctttgtcaactgttaagagtgaaagaaattataaggaaaaagaaatgataaggaaaagagtggagggctctgggagcctctcagcttctcctagctctcagcagcagacgggaggggaacgggctagcagagagcaattcagctctgggctgtcatggggacagcaggcttctaggcagggtctgaatttatagccacatgtaaaaggcagtgatctcttccattaatgggtggaaatagagccctatattagggcttttgttcaagttgcaaactcagggccgtgaactatacacttctccttcccttggctgtctggttagagaaggagcagccatatcggtacactgcctggctcagggtgggcactggctcaagccatccaatcagaatccctccgcgggaattttgaattgggcccagaagaggccacccacattctgcttatctcttggatggaagaaagataaacttgggagctgctgactgaggccgtcggctgctgtatttcctggaaagccaggaaagccagtctgcagggagaaagagagaaggatgacatggaaacagtgttgtgggtggtgccttcctgggctcccaaagtcccagcaccattctcagttcctgaggcccaactgcatccttatgcttaggttccctaagacacccctaaatccttgtaatagaaatccccttttgtcatcaacctgtcccccgtggcttctagtaatcacaaccacaagaatctgaattaaacacaacctggggaccttctctctccccacagtgtgacttctggtcaccctcccagcttcttcagccagatggggagtgtcctgcaggcaataccagttgacacagaaagacagtctccatcttcccccagtgccccagtcccttgctgtctgtccttgtgcagccttctcactgtgcacagtcttgttgcccacacttagagatcccctagtcaggcccctcctggctgcctctctccaaagtaactgagttttcctggtcccacttcgtctgtctgccttctggagtcccagcctctggatccaggattctgtgtgtcatgtctctcagatggtagctgcagtctagcaggggccttcaaagccttctggtggcagggcagtgtgggaagatgttttgaagaaagagaaattttcaaaagctcttaagagactggatagaaagggtactggattaggagtggagactggattctggcctggcttggcttctaactcgctgtgtggctttaggcttcattttccgcagctgcagaatgatgaaattaggcaagatcaaaggctttccagggagccctttggaggtgacttggccacggccttgtaaccataaggggagaagagatggcacctgggaccctgcttctcttcactcagggcaccaccccccccacccccccgtaggtgtttcatacattgagcatgctggaaagatctttgtcttagcccaggtttccaaagaagcagagcagggcagcatgtatgctaacactgtattggggagtgtggtggctgggaaggggaagtgaggacaagggggagtgagacagaggagaagggagggcacacaagagagtgcactgcggagctggccaccactccgtctggaaggatgctagaccttacaggaccttctttattatttatttatttattttgagactgagccttgctctgtcgcccagactagagtgcagtggcgtgatctcggctcactgcaacctctgcctcctgggttcatgcaatttctcctgcctcagcctcccaagtagctgggattacaggcacatgccacgacacccagttcgtttttgtatttttagtagagacagggtttcaccatgttggtcaggctggtcttgaactcctgacctcacgtggtccacccaccttggcctcccaacgtgctgggattacaggtgtgagccactgcgcatggcccaggaccttctttaaagtggctgtgtgaactcggaactcaggccagtctgtccagaaagaggaagagagaaaaatttatttgctaatccctgtctcttgctggtcaaagttcactccatggagtgtccaacactcctgcacttctgaggccaagggtgtggggccaaggggagaggaggtgcagttgacttctgcctgggtgaagtcagttgtcacagcagctggacaaaacaagtggcaaggagctggaagactggtgtgtctaacggatcttaggcgatacatttaaaagtatctgatacaggcctggtgcagtggctcacgcctgcaatcccagcactttgagagactaaggcgggcagatcacaaggtcagtagatcaagaccagcctggctaacatggtgaaaccccgtctctactaaaaatataaaaaattagccaggcgtggtggtgcatgcctgtagtcccagctacttgggagggtgaggcaggagaatcacttgaaccagggaggcagaggttgcagcaagccgagatcgtgccattgcactccagcctgggcgacagagcaagactccgtctcaaaaaaaaaaaaaaaaatatcggatacagctataattgaaaagtagtgggaacctctactaaaagaaaagtcaaaaccaccaagatgcataataccaaaggaccttctcagctgaaagatttcttgatgctggccactgaaattgcagctcagagagctgagactagactcccttctgatgtgcagggcccatgttctcagataatcacaaacaagatcctgcaaatgtgtacccctcagctttactctatcctcctcccccaaatttccatgcaatttaaagagctaatgaagatggtgtttttaaagtgtcctggtgggatgggaaagagagggggctgataatcccaccggacagggagaattctcatcttgttcattcagaaaggcccagccccctgccaggttggactcccctcccctcaaggggcagcagcggactccagaaaaaaggcagatgtgtttgtatttaagagattggaggattaaatgagctagagaggctccctccacacggcctcatcctctgatggctggaagcccacctctgagtgttattaaatcgatgatgacatcatgggcactgcatgcccctccctctggagcccagcaggcttgcaaagcctgcagaggataagaaattggggtcagagcgggaagcctcaatccttcttctctggtgtataccgagatcgatgtgtagatcagattcaccagaattaaatctggggccccgtctgagtgctgtccttggctgacccttgggcacagtacttcagctcagggcctaggtttttctctgctacaaaacagagacaatcacctgttctccttacgacctggtgtgtgtggatcaaatgaaacaaggaaagctttaaagcaaatgtgttcttcaggggaccaggggcggaggggggggattgaggtgtggcctgtgggctgctagagcccaggatggggctgatggaaaatgactcccaggcaggcagtcctagcctcccacagccaagaaaggacatgcaggttctgaccaaaggggaaagaaataaatccaataaacatctcccaagaagaaagacaggaaagaaaatagaatggaaataggcatagctcagacccctcatggtctgggaagcagaccaaggatactgggcaggggaatggcacattgcatttgcatctgaggcacatcccttccaagaggcacatcccttctgcagcggcttgagggctgggtgagaggagacaggactggagacctgcacatgtcgtgtgcgcctggtgtagcacgggggtggtggggagaatgggagttggttgcagttgttctagttagcggcctgggctgctgacagtgaccgtggggaggagagagtttgtgacattgacagtggtgtggaaggtaacctttctgtggagggaaacctcaggtctcgagacgggctattgtaaataacttagtccaccagtgctgggctctctgctaagagtttcatatagtcatcacaactccaatgtagtagatgcaataggcatcttcttgttacagatgagtaaactgaagctgtgaggggttgagccatttgcccgcatcacagctagttcaaagtggtaccactaatgaagtcctggcaatctgccctgcaggctgttctcaggtttgacctttggttctgtttttcacttgaggatgctgtccccttaggttctgtctgtcttgtatgctccggtgactcacgagcctgtccactgggttcccaggtctcgcctcagcttcagaccaccggtccaacagccttcctgacccacctcaagcttaatgcgttcaaagatgaatctttatttacacgaaatctgctctagcccacttcccggggggtgcctccactatccacccaggggcagaatccggccactgcctgaactcttctcccctcaccccccacatccagagtcccagtcaccatacctctcacacgactctagatgtcaccaactcgctccttcccactgtcaccgccagcccctcactagaacatctgcaacccacgtgctgcaccacgcgggtgctacacgtgcaggtctccagtcctgcctcctctcctccacccgtaagaacaagggaaatcccacagaaccctctgccccggggagcatttaaatcagcttagtctatctccaggtcgctaccccgccccagcccaacacccaggcctcagtcaccctagacagagattcccgtacccaggcaggcaagggaccctaacacatcccagcccgctggtggtcacgcgcgcagcccggacaggccagcagcccccgccccgcgaggacgccacactcgcagcgcccggccctcccctagcggagcccgccccgtctccctccgccccgcctccctccgctccgctccgctccgctccgccccgccccgggtccgcagccccgcctgttcctcccgagggccgcgcgctctcgccggcccgccccgaaccgccccgcgctgggaatttgcggcggcctccgccggggcagccgagctgaaccggtctcttcctcggaaaggcagggccgaggggcctgcggggcagccatggrggcgacgcggaggcggcagcacctgggagcgacgggcggcccaggcgcgcagctgggcgcctccttcctgcaggccaggtgggcgcgcgccggggtgagagggcgggctaggcgcctgtgcgctggggcctcgggacccgccacgtgacgctcctagggctgccgggcgggaacctcgtgtgcggcgctggccggggcggagcggagcgcggggggcttggaggcgcgctaccgtggcggcggtgcccccgcgtttccttctctgtctggggagcctggggcccagcggggctcggcctccccgcttcgccgttgctcgggtgggaggagcgcccgcccgaagtttggggttttcctcccttcccgcgttccagcgacccgggctggcgccgggacagccgctgcgctgggagagctccccagggcggtgggtacacacacctcgtcactcggacccccaacttatccgcaagttccgggcgccacctccgcgttctcggggtccctccagccctgagtaggacttgattctgtcatttatcaggaggctgtctgcttgacctggggcacccaagaatgtgcgaatgtaatggaagagacmgcggggaagggcggaagctgccgtccagagaatgaatgaggagcccttctcagtttttggtttatctcgttgggcgagcagagctccattctaccttcgtcccgttttactgaccagaaacattcactgcattcagcaggcattctttaagcgcctgtggtatgcccagcgctgtgccaggcagtaagggggtaggcagggtgaaggtgggagaggcttacsgtcctgtagggatcaggagagacagagcccaagtgggagtgagcggtcatcttggagggcttcatggaggaagtggcacttgagctgagtctcagaggacttggtaggggacccagggaagacaggctgttccatccagggaaacagtggggaagggcaaggagtttagtggtgctggagctttccggctgtaaaagaaagtgacaggaggatgcagactgattgtgaagggcctttaattgcagcaagtctaggactcgagttgaggacctagattgcaaaacttaggggtaggcgcactgccgtgaccgtgagtgccgcctcaaatgttgggccttggaggccttgcttgtctcaccctagttcctgtcctaggtgacaggttaaggacacagtctttatcccataggcactggggagtcgtgagaagtttctgagcactagcatgcgcaaagtccttgttaggaagtttttggtacgacctggatgaagggagaagtctgagcgcttgggctgaggtgagggatggctcgtttctgctgctgcggacatgcgggctgagcagctgcggactgtgtccgttttcacttagaaacaatgtactggccatagaccgcatactgtagctcacctgtctccctcggcctgtgagttaagtattattttactgatgaggaaataggcttagatgggctgaggagcctgactggctgagtccccgggctgtctgccccacgccgtgtccagtggtttcatctctgctgtgacccaacccatttaccagctcccctcttccaggcagcctcttctgcctgcgggatgtctctgttccgaatccttgccaagttgggggtcactgactgccctgaactgtgacagcccaatgggaacagcctgtgggtctcagatagggtcaccactttatctcctgtgtggggctcccatgtctagcatcttactcagtcttgacaatgagctgccagatgtcacttccaatgtacagatggggaaatggaggcccaaagaggttacatcatttgctggcaagaaccagggcctaaacccagggtttctgacttacgggctctgctcttacgactccactttggctgctaaggagtcatgtccctcttcccctgtgtgagctccccaccagccagggtattcccaggggggtggtgtgagggtgggagctctctgtctcccagggtgtctctgcccccyacaatgtggcttcagyccattcccagtatcattgctgctcaagagagtaggcagaatcatcctgtccagttcctaggatgcttggatttcctctgctgcatccgtgctttgctcactacctcttaaggtaacccattccaacgtccacctgctttgttgccagtttttgtattataatgaaagtgttacaattaggccgggtgccatggctcacgcctgtaatcccagcactttgggaggccaaggtgggtggatcacttgagtccaggagttcgagaccagcctggccaacatggagaatccccgtctctactaaaaaatacaaaaattatccaggtgtgatggcccatgcctgtaatcccagctactcaggaggctgaggcaccaggatcccttgagcctgggaggcggaggttgtagtgagccgagatggcgccactgcactccagcctggatgacagtgagactgtctcaaaaaaaaaaaaaagtaaaaaaagaaaagaaaagaaagtattataattagtgcccgtgataaatcaaatagcaaaggcttcaagttttaaaaagtagtaatccctgtcccactcttccctagcaccagagacaatcaccctagcttcttttagctcttttttccagagtcaaattcctatttccaaataatatgtttataacaataaaaaacactatgtagcactttttatggatcaggccctgctcttaagtttttgcatgtattaattaaaccacgacccttgagatacgatctactggccaggtgtggtggctcatgcctgtaatcccagcactttgggaggccgagatgggcggatcaggaggtcaggagttcaagaccagcctgaccaacatggagaaaccctgtctctactaaaaatacaaaaattagccaggcatggtgtcatgcgcatgtagtcccagctactcgggaggctgaggcaggagaattacttgaactcaggaggcggaggttgcggtgggccaagatcgcgccattatactccagcctgggcaacaagagtgagactccgtctcaaaaaagaaaaaaaagggataggatctactattatctccattttacaaatgaggacattaaggcccaagaagttaagtgacttgctcaagatctggttagtggcagagctgggatatgaacccaaacagtctccaaagtccagactcttttttttttttttttttgagatggagtctcacactgttacccaggctggagtgcagtggcatgatmtcagctcactgcaatctccgcctcccgggttcaagcgattctcctgcctcagcctcccaagtagctgggattacaggtgctcggcaccacgcccagctaattttttgtatttttagtagagacggcgtttcaccatgttggccaggctggtctcaaacttctgactttgtgattcacccgcctcagcctcccaaagtgctgggattacaggcctgagccaccgcgcccagccaagtccacactcttaaaaactacactcaactgctatttcttggtttattttattttattctttttttgagayggagtttcactcttgtcccctaggctagagtgcagtggtgccatcttggctcactgcaacctccacctccagagttcaagcaattctgcctcagcctcccgagtagctgggattacaggtgcccaccatcacgcccatctaatttttgtatttttagtagagatgacgtttcaccgtgttggccaggctggtctctaactcctgacctcaggtgatccacctgccttggcctcccaaagtactgggattacaggcatgagccactgcgcccagcctttgattccttttagaaaaaaggaaaaattttaaaaattagccatgtgtgacagcacatgcctttctgtggtcccagctactcaggaggctgagatgggaggattgcttgagcctgggaggtcaaggctgcaatgagccatgactgtgtcactgcactccagcctgggtgacagagcaagaccttgtctccaaaactaaaataaaaagatgatattagtcccctaccctaaactttagctttcctcaccccttcctacaatttctgtcctctgttttcatgttatcaaagtagactataattatctgctgctttaaaaccgtaattatcttccatgttttatctgtggattgactctaaacattgaaaattaatataaaatgtgtatgttatttaagccatgtatttaataaatattgttccaacagagccaaataatgtttaacagttacatttgctttcttatgttacttttgtttttcttggagtttctagttgcctttctttattctctcattatatttgccttcatttccttagttttttttctgttcaagcttttcattgtcttgtatgtcaccattctttaaatagaagcaaaattagtctctctgtggtccccatttgtgggttaccgcttgacttgttcaggatgaaaccccttccttttctgccaggcagccctgcagatgctgctgactgccttgaggattttaagtgtatggcatgcactcctcaactgtcgtggtgtcattgtccccatatggtagacttggaaagctgggaaggagagaagagtctaaccttgtttcaggttayctgccattgtgccatcaccattgttttcagcagcatttgctagtgattgagacctagctggcacaggctgggggctcagtgtgctaagtctgtggagccaggaacttgggacagggttgaggttgctcatcctcaggacatgagctgggggagaggatgcctttaccattccatgatctgcctcccgtgggcagagttccaggagaagaaaaccaggcaggtgctgattaatctttttttttttttttttttttgagacagagtctttttgtattgcccaggcagtgcagtggtgccatctcagctcactgcaacctctgcctgtgaggttcaagcaattctcatgcctcagcctccccagtagctgagattacaggtgtgcaccaccatgctgggctaatttttgtatttttagtagagacggagtttcrtcatgttggtcargctggtcttgaatkcctggcctcatgtgatctgcccagctcaccctcccaaactgctgggattacaggcatgagccactgtgcccagtctaatcttgatttgcaagctggttgctgagtgtccactctgtgtgcctgctttttttttttttttttttttttttgcaataaggtcttactctgtcacccaggctaaagtgcagtggtacggtcatagctcactgcagccttgacctcccaggcttaagtgatcatcctgtttctgcctcctgagtagctggaactacagatgtgtgccaccatacccagttaatttttaatttttaatttttaattttttagagttgttttttgttgttgttgttgttgttgttgttttctttttgagacagtttcactcttactgcccaggctggagtgcaatggcgtgatcctggctcactgcaacctccgcctcccaggtttaagtgattstcctgcctcagcctcccaagtagctgggattacaggcgcacaccaccaagcctggctaatttagtatttttatatagagacagggtttcactgtgttggccaggctggtctcgaactcctgacctcaggtgatctgtacacctcagcctcccaaaatgctgggagtacaggcatgagccactgggcccagcccccctctttttttttttttcctgtcctactaagttaggctggactaatgacagggattctcattgaccaaggtgcttcctgaggtggaggaggaggtagtcactgagcctctagtgtatgctgggtacacataacttccagatacacacatctaagtgttcatgcttccaaaatccctttattcctcgtaccgaacatcctactttttgccaagtttggaggtatcagagcaagaaactgaaggctgttacctctttcgccacccaagttctctgggcctggaggttatcactctctgctttttgaggccttaccctgatggctactgaggaaggagctgggtggggcctctgtgttggtcactcgtctcagaccactgagcagtcctcagggttactggctatctgtccagtctgaagatcgagccgcccgtcccttctctttctctggctccagtaagccaggcatctcagctccatgcagaaccttcttcacttccacctccaggcctttaccctgctttcctgcttttctgcctagttagattcatccatccgtgctttgaggctcccttccctcatgcaagctttgtgtattgccctaggccacgctgatccttttctttttttttttcagtatttattgatcattcttgggtgtttctcrgagagggggatgtggcagggtcataggataatagtggagagaaggtcagcagataaacacgtgaacaaaggtctctggttttcctaggcagaggaccctgcagccttcctcagtgtttatgtccctgggtacttgagattagggagtggtgatgactcttaacgagcatgctgccttcaagcatctgtttaacaaagcacatcttgcaccacccttaatccatttaaccctgagtggacacagcacatgtttcagagagcacggggttgggggtaaggttatagactaacagcatcccaaggcagaagaatttttcttagtacagaacaaaatggagtctcctatgtctacttctttctacacagacacagtaacaatctgatctctctttcttttccccacatttcccccttttctttttgacaaaactgccatcgtcatcatggcccattctcaatggtcgctgtctcttcggagctgttgggtacacctcccagaccgggcggccgggcagaggcacttctcacttcccagacggggcggctgggcagaggcgctcctcacttcccagacggggcggccaggcagaggtgctccacacctcccagacggggcggccgggcagaggcrctcctcacctcccagacggggcggccgggcagaggcgctcctcacatcccagacgatgggcagccgggcagagacgctcctcacctcccagacggggcggccgggcagaggcgcttctcacctcccagacagacgatgggcagccaggcagaggcgctcctcacttcctagacggggtggcggccaggcagaggtgctcctcacttcccagatggggcrgccaggcagaagggctcctaacctcccagayggggcggctgggcagaggtgctcctcacctcccagatggggcggccgggcagaggggctcctcacctcccagacggggcggccgggcagaagggctcctcacatcccagacggggcggccgggcagaggggctccttacttcccagacggggtggccgggcagaggcgctcctcacatcccagacgatgggcagccgggcagaggcgcttctcacctcccagacagggcagccgggcagaggggctcctcacttcccagacggggcagctgggcagaggcgctcctcacttcccagacggggcggccgggcagaggcgctcctcacatcccagacgatgggcagccaggcagaggcgctcctcacttcctagacggggcagctgggcagaggcgctcctcacttcccagacggggcggccgggcagaggcgctcctcacatcccagacgatgggcagctgggcagaggcgcttctcacctcccagatggggtggccgggcagaggggctcctcacatcccagacgatgggcggccaggcagagacgctcctcacttcctagatggggtggcggccgggcagagcctgtaatcttagcacttttggaggccaaggcaggcggctgggaggtggaggttgtagcgagccgagatcacgccactgcactccagcctgggcaacattgagcattgagtgagcgagactccgtctgcaatcccagcacctcgggaggccgaggcgggcagatcactcgaggtcaagagctggagaccagcctggtcaacacggcgaaaccccgtctccaccaaaaatacaaaaaccagtcaggtgtggcggcgtgtgcctgcgatcccaggcactcggcaggccgaggcaggagaatcacgggagcccgaggcagggaggttgcagggagctgagatcacggcagtacagtccagcctcagcaacagagggagaaggaagaagcgagggagagggggaggggtgggggaggggggagggagatccctttctaacctgatctcctgataagcctagtaatcaaaaacagaatagcaagctgttggccagacatggtggctcacagctgtaatcccagcactatggatggctgatgtgggttgattattgagcccaggaatttgaggccagcctgggcaacatagtgagayctcatctctacaaaaaataataataataataataataataaaataaaattagctgggcatagtggcatgcacctgtggtcccagttactcaggagactgaggtggaaggaatgcttgagcctgggaggccaaggctgcagtgagctgtgatcacaccactgtactccagcctaggtgaccctgtctccaaaaaacaaaacaaaaaaacagaatagcaagctattaagagcacaggtcttgaattaacataaacccaggtttgaattgtgtgtgttattcaggacgactgggttgcaagtgacagaaagccagtgtgaactgcaccatccttagcaaaaaggaatgtgttggctcatatggccagatcatgaactggcaacatgaacactgtcagcactttttctccccctttccctgatcctctctgcgaggctacttcattcttacctggatgtcccttgagggtggaaccttggctgtaggcagtcctgggcttgcacccttagaacccagcactataaaggaaggagctcttttcctcacctgcagttggaaaagtcccactgggccagtctagatcactggcccttcctgtggctaagaaaatatcatgtcttaccagaagaagcagtgggtgggaaataggctgacaaaaggaattgttgccacagctccttactacacgggtggctttggctaagcacctaatccctctaagcctcagtatmctcatctgtaaagcagatgygtggattagatgagatagtgcaggtaaagacctagcattgcacatagttggtgttcagtgagggggtggaagataccgagtagaggggacaggaagacttagctgacctagggaaggcctacccaacctgtcttgcctgccactagaaaatgagatttctcccaagagcttgcctcsctgtcctggggtactctaccagccagtatggatcatccttggaactggcaggaagggatctcagaaaattagggaagcaacagcagtatcgacagaagacagtctttgcagtgcctctaagctaatgtttgccactacaaaaggagtaactggtcgttgtgactgttttaatcagccagtagttgctgagcatggaccagggcctgagctcagaactctggaggaatacagatttgtggtccatggcgcctgttcttggcacaaacgagacgatgaaacccacacctcagtcctcttaggatgtggctggctgcttgtccctggaggtgtgcaagtaattgcagggactctgtaaagaggatttggactctgatagggaggtgggtgagttgggagaaccttaaaggtcacccctgttctcgagggtctagatgggagagtacagctccagccccattatgccagactgggttggygttgaaatgctccctgcagtgggctggtggggctttgggaaaagcttcatcagggaagccttcccagaggaggcagcactggtcctggaacttcagtgcatctgtgaacagcagatgaccaactgtttagtgagagggacaggcctccaaagatgtatcgtgaggcagtactccacttcctgctgtgtctctcacatcaccttgcttctgctggctccttctcaggttctactgtggactgctgagaagaggattaccagcagcccaacctgacctcctcacagtgctggaatcaagcgagcaggaggccctatccatttcagtctctctaargcacatttcattggagggctctgattggccaagctctggtcacatgcccatcccatagaccaatcctgatggacccaactatgggatggaggttaaaagtataagctcaggagcccaatcatttgggttcaaatccttagctgtgtgaccttgagcaagttattgagcctcttgggcctcagttttttcgtttctaaaatggaggtaatatttcagccttgaaaggtttctgtgaggattaaatgagataatacatgtaaacagctaacagtagtgcctgggatatagtaagtgctcaactaaggtcagctgccatgatccatcatcaagtttcatgcttttcagccacgattgcgtcctttgcctttcttgatttcctccatctttcagtagcggagaaaccccagcaattacacctgttcagctgtttccttcctgaatcagagagaagctaaggtcggggcagctgaagtccaccttctccttgaccacagggccagaccccagtatatccagcaaaaccctatccatagaactcaattatgtgtgtctcctcctgtcctcaagtccccagacctctttgtggctaatctcaggggaagattttggtggaggaggagagaagagctgacttctctcgtctggttccttcccaggcatggctctgtgagcgctgatgaggctgcccgcacggctcccttccacctcgacctctggttctacttcacactgcagaactgggttctggactttgggcgtcccattgccatggtgagtgtgaaatggtgcacagggctctgaccagcactgaggacacttagtgtggcttgaatttgccgagtgaccttagacaagtcacttctcctttatctccyagtaaactgagagaataggcctggatgccttcatatccttagctctatgacttggcccgtcaggcaactgccagcaagtggggggcctgaagagtcatactttgccccaactctcatgggggaactggtggtcctgaacagtcatactgtaatactgtaaccccctctggcctgtgtctggaagcaggtgaaccaggttgaaccaaatcaccaagacagacaaaggggtataggaaaggaagtggagcaccgcacccccaccyccgtctcccctgtccttccccattaccttgggatagtattattttttctggagttgaagggcgtaggctgattttgcatattatatatgactgtgagccatgggtaatttttaatgccatccagtgaaaccatcccctgccttccaaggctacttcatgctttagtatccagtggtggcctccacagacaagattaatgctgggagggcaccagtgccccttgcttgtagtgggaggatggaagataggtaggtaggtaggtaggtaggtaggtaggtaggtaggtagataattgacagatgatagataataaatagacgaacgtgaagaaaattaagtgagatatcaccaggtatcaagtcattatttggtagtgggggcacagtgtgactattcatggcccccagacccctcccacccaacttgctgacagttgcctgacgggccacagtcatagagccaaaagatatgaaggcatccaggcctatactctcagtttactggaagataaacgggaagtgacttttcgaaggtcactcagcaaattcaagtgtaaaaataacaatatccagtgctgaaactggcactttgtacatactagtgatcatgcaaattagcaaagcccttttggggccgggcatggtggctcatgcctataatcctagcactttgggaagctgaaacaggaacatcacttgagcccaggagtttgagatcagtcagggcaatataatgagaccctgtctctataaaagatttgtaaattagctgggtgtggtgatgtgcacctgtagtcccagctactcaggactgagctgggaagatctcctgagcctgggaagttgaggctgcagtgagccgtgatcacaccgctgcactccagcctgggcaacacagtgagaccctgtctcaaaaaacaaaacaaacaaaaagcaaagcctttttggaaagcagtaataattcataagtaacaacttggcaagattagtacttagaatagtgcctaacacaataagtgtttaatgcatttttactgaatgaataataattatagcaaagttagaatagtggctaacatcgaatgtttactctgttctaagctctttatgtgtttcagtttatttaattctcatatcaacactattgctgatctcaatgttatagatgaggaaacttgaggagagagagaataagtaactggctcgaggtcaagcatagaggccagcatctgcccaggcattctggccctggagcccctttctgacaaggttgaattctctgtcacataaatatccagaatcctaatatattcatccctctgacccagtaatacccttccgagaatctgcccgtagggatataatcagcaagaagacagcagtttcctctaactcaaagatgttcattgcagtggtgtttatgatagccaaaccttagaagtgacttgcgtgtccagcattagggactgggtaaatcagttttgctatgtccattatagagaatgtttcctggcaattaagcagaaattatggatactatagagcaacctggaatatttaaggagaaaaaaggttcctaaatgacatgcagactgactaattgcaagtcaataacgagcttgtctacctgggatcaaagacttgataggtgtaaagaaaagctgtcctggcaatgctgtcagggagtgatggtgggtgctggttctccttcctgcagtctttttgaaggttgccttttaaatgtggaaaaataagaggaattgagccaagagttggggcatctggttgggtttgtgggtgacctagggcaagtcactgtcctgggcttcatttctctctccaagaagactggctggwctggctgctctgaaccttcttctagcatgaaggaaccacatactgggggccaaagaagctgcccatcaaactggtgctagagagagagatgaggccaggagtgggctcgtggctcccytcactcactaggacccagcttctactggcataacagggtctcctattgggcaaatcacttcccccatcctgcttagagctgctgtgaccactgtaaccctaagtaggacttggtggaacgtagacatttgaaaagctcttgtatacgctagagattttcaaatgtatgcataatagttgcaaatttgttaaaaacaaaaacatttacaagttataaaagtaacatgtcatagatgtaacatagttgtaacataaagaagtgttagactctccctacccctttcctgtcccactgctgacagtttcgggaacacccctttcactcttctctgcttgtacaaacacatatatacatccttttcccttctaaccataatgggattttgctttatactttattttgcaacctgcttgttttcctttagaatatatcatatggtgggcatggtggcatgtaattccagcactttgggaggccaaggcaggaggattgcctgaggccagtcctggcaacatagcaagaccctgtttttacaaataatttaaaaattaatggtgcttggtgcctggcacctgtaatgccagcactttgggaggtcaaggtgggaggatcgcttgagcccaggagtttgtgaccagcctggtcaacataaggagacctcatctcaataaaaaagaaaaaagaaaaaaaaatatagctctctctccatgtcagtacatataaggtgtcatttctgttaatggctacttaaccttccatggtaagaagtactatcagggattcaactggtcctgtttgattgaagagtcagcctatttctgatgttttgctatcacagagtattttagcaagtatatatatgatgtaggtaaagaggcagataaacacatgcacactgagtaagagagagagagagagagactgagattgctgcattctgtgagttttatttctgcgggtttagtttatccaatatggcatttctgtgttaaaagagagaaccatctaaatccttccttgaaacttgtgggccttatgtgtgttttcaatcaacagatactagaagtacagtttgggggttgtgaaatgctttaaccccgcataggggttttcacactggcctggacaaggccagggctcagaagagagagcattgcagaaggaggaactgcccctggcctgccttcctctctctgggaaggaagagttgcagctactttgtagagcattcytgttttctcctttgtctcctaaygtgtactttgaacctggtttggaagcagtccctccacatcagggcctagcactcaggagactgatctggcactcaggagcgccagaacccgaacggtccaagtaggccctctgggccacctctcttgtgttatagatggggaaaccaaggcccagagaagggaagtattagcccagggtcacccagcaagttgrtgccacaacggagtccctgagaagcctaccaactcccaagctggcatcagggtcatttatttggtatctgctgggtgaggggcacagggtcaggccttgmctggaattgcatctgctctgtgtctggggacaagtccgttacctcctctgggactcagctttcctgtctggataaacctttgtcccaaggctgccgagaaggtccagcgatcacaggaagaattaagtgtacatgatggggtggggggtgaaaggagttggggtgggyggcattaggggcagactcccttgaggcccgagggccgcgtggggctgtgcccaggtgagcccattcttccatttgctccgcagctggtattccctctckagtggtttccactcaacaagcccagtgttggggactacttccacatggcctacaacgtcatcacgccctttctcttgctcaaggtactgtcccagggcccccactctctcctgtcatccccattctttgcacacctggcaggaaggtgatgctaagccctgtgtcctgactcaagcacgctcctgcctgctgctggggggtgaaggctgtgacagagcagcatgtccagggcctgsggccyggggaaggcggagctgccggtggcctggagggatggaaaatatgccccaagaaagggcttttgatttgagcctcagcctggcgtgccagtgggggaagcagagaggtgttcaggtagaaggacctaaagacaaggctgtgcttgggaaaccgtaaaacatttggggaggctgaggcagaagtgactggaggtccagggagaggtcaaggacccactgggaagagaggaagaagccaggtggcaggagaggcagcagcagcagctgaactccatcctctgccctggagagccctgagatgtcactgggagcackagcaggaactgctggctttgcactttgccaagtaaggcctttaaaactactataggttgagcatccctaatccaaaaatctgaaatctgaaatgctccaaaggagtctgaaattttttaagcactggcatgatactataagtagaaaactcggccaggcgcggtggctggagcctgtaatcccagcactttgggaggctgaggtgggtggatcacttgaggtcaggagcctggccaacatggtgaaacccccgtctccattaaaaatagaaaaaattggccaggcgcagtggctcatgcgtgtaatcccagcactttgggaggctgaggcgggcggatcacctgatgtcaggagttcgagaccagcctggccaacatggtgaaactccatctctactaaaaatacaaaaaaaagtagccgggcatgctggcaggcacctgtagtcccagctactcgggaggctgaggccagagaatcacttgaacccgggaggtagaggttgcagtgagccaagatcacgccattgcactccrgcccgggcaagacagtgagacttcatctcaaaaaaaagaaaaagaaaaaaatacaaaaaacttagggccggcatggtggcttacgcctgtaagcccagcactctgggagcccaaggcaggcagatcacttgaggtcaggagttcgagaccagcctggccaacatggcaaaacctcatctccattaaaaatacaaaaaagttagccaggtgcggtggtgtgcgcctgcagtcccagctacttgggaggctgaggcaggagaatcacttgaatccaggaggtagaggttgcagtgagccgagattccaccaccgcactccagcctgggcgatggagcaacactctgtctcaaaaaagaaaattctacacatatgtacttaacacaaactttktttcatgtacaaaattatttaaaatgttatataaaattaacttcaggctgtgtatgtaaagtatataggaaatataaatgaatttttccaggcatggtggctcacacctgtaatctcaatactttgggaggctgatacaggaggatcrcttgaggccagtagtttgagaccagcctgggcaacatagtaagaccctatctctacaaaaaatttaaaaattagctgggcataatggtgcacacctgtagttccagctactctgggggctgaggtgggaggatctcttgagccactatactccagcctgagtgacagagtgagaccctgtctcaaagaaaaatgaaagaaatgaatttcatgtttagacttgcatatgcattcccaagatatctcattgtgtatatgcaaatattccaaaatctgaaatytgaaacatttcagataagggatgctcagcctgtatcaccatttactatcaccatcattttgtattgaagaaagatacttcaaatctccagaagtaggaggggtataatcccagaactccggtgtgttttcagttaaacagtggcatttcagaagcacctgcccccatccctgacattttcttcatgtttgctgggaccactcagaaatcagaaggtgccttcagcaggctgggccagccacccagggacacagccagggacagtgggagggctgggcctgagcctggactcctgcactgaaggctgggctgtcccctccagcctacagctcatgtgtgactttgggaaaggagttgggccctctggtctttttgctccctgggtaaagtcagcggggggtgctgctccacattccctccggggttcataggggtcacgggaggatctggaggctgggctggcctgctaaagggaccagccactttttggagtgacattccagctggaagcgtccatcccaccccaggtgtgaggggggaagcagagggtgtcacatactgtgacagaggtggggtcatgctgccaaccccactctgaaccccagctcatcgagcggtccccccgcaccctgccacgctccatcacgtacgtgagcatcatcatcttcatcatggrtgccagcatccacctggtgggtgactctgtcaaccaccgcctgctcttcagtggctaccagcaccacctgtctgtccgtgagaaccccatcatcaagaatctcaagccggagacgctggtgaggccacctcctgctccctgcctgtaagccctaggagcacagtctgtyctgggaggctgaagaaatggcccccacccctcgccgcacctgtcctttcaccaaaggcattctgctaggtgagggcactgtcgcctgccccaagctaggatgctcaagtgttcttaggaagtggtgcacagactgcctcccacctgggcccctgtaacagaaggcraggccccgggtagggaataaggcagtgggggaggcctgggactgggagaagggtggtcagaggggatgcttggggccccagcacctccctggactgacatcgacatcccccgactctgccctgcccgttcctccctcagatcgactcctttgagctgctctactattatgatgagtacctgggtcactgcatgtggtgagtgatgggcccatctgtctatcccaggggccccaactaccggctagccctgtcactggctcagggacacactgagcaaggctgtctgggctgcgggtctccatgtgttgagtctcatcccctgtaaaggcactgtgagctcaacctccagtgaagttgtccccgaggttgcccgggagacccagctgctgtcccaggctccaggccccggcttccagccagcatccccccagcatcgccacccccgcccagccctcagtgcccgctgtggccagcagagggcagcgagtggctttggtccttcctcgccaagcctgagccctgagggtgggggaggaggacgcgtccctgataaacaacccccagatggtgatggcagggrgtgggggcacagccagggacccccacccgtgtcgggcctgctctttgggagtggaggaagctgcggggagccagctggatcaggctggggaggggcgtgctgtttgcgctcccccctcttcagaactcccagaggggcaccttttcctacctaccccgtccctcagtcgggggagacctcagaaatgtggtctcagcctcaggagatcccgggcccaggctgggaggcttcatctgttccaccctcccatcttacccaggagaaactgaggccagagggaggagggctccgaaggctgcagctgggaggtgagggccagccctggacccggctcactcctgagttggtgctcacagcacacgcaccctgcacgggcatttccagggtgtttcgggccctgcgatgtcaatcctcctggctcagctggtccagggtccctggacaggcctcctgccatctttccctggcctttgccagagcctcttcccacagaaggttggggaagggtggaggggctaggaacagagagctggagccccagcaggaagggggtgtgggtgagaagaggcaggcgggtatactggtgaaagcacaggtgggagaaagggagcyggtgtgtggagaggggagagggtagtattttggggtgaggtgtctgaggtgggggtggggctgtgtgctgagagtgggtgcagtgcttcaccaagaggcccctgcaggtgctgttctcttttttaacatgtggacctccatcctcagcccgggaggtgcctctgtctccaggctagtgtggtgctgggctgctggtgtctgcggtgcatgagacagacaaccccccagacaccccttacccccacggagtgagtgaggtgccctgggcggtgtggatgcctctgggcctctgactcacacgtgcgttgccttcctgtttctgtttctgtcccacctttgacgcccagcacaggcaaggttgggtggagaggagcgcctctcacccaggctaggcgttttgtaaactgtgacgtggcactccatgagaccccatgggagtggttgcagaggttgtggggaagagggccgctgagcaggcctctaagacactggccttcctgtcacaggtacatccccttcttcctcatcctcttcatgtacttcagcggctgctttactgcctctaaagctgagagcttgattccagggcctgccctgctcctggtggcacccagtggcctgtactactggtgagtggacatcagcatgggggcagaggcaggggcactgagagagccacggcagcaaaattctgcacttgccaatggacctgctgtgtggccccagggagactggccctctttgggcccgtgcttcttcttgtgtctagtggggactgtgacaatgccctgtggtggcctctttgtttccatgaagcccaggcctgggtgtggcagggaggtgggaggagagggcgaggttgcacagtctgtctccatcctcaagcccctctcrctctgtgccccatctcaagaaccccagtgttgccctggggccggtacaatccacctccgacaccaagccctgtagtgggctgyggtttccacctctgtgaagtggggatgatggtacctgcctgtctgcctctcagatgatgaggatgctgaggacagagaggggctttgtcaaatgtaaagcactatggcgaggccagactggggggtttcatggcgtaggggcttctggccttgggtctttgttccctctggctctctcttcttcccattgcagaggacttaggcctcagccagtctcctagccctcgtctgtcacttctgccctggagacaggtcaccctgggattgtgggtatcatgggaaggacagggtcggggcaggactggacccttctctgatgggaggcctccctcaaaatgaaaagggcctcctttcctgggccagctctagatcctctccccggcctgtcccctatgtggctgagatggcccactggggctcatctgtatgctctctggggattaaaaagaatgggtggcagctacagtgagcgggaaagacgttaggggagcgcttcctgctggttcttaccccggcatcctgccgcgggggtggctgccgtcgtaatggcaattgtttgttgctttctcctctagtcagtttttgttgtgtggaagtataaacttaatgtgaccagagaagccagaaatatacatttgtaggtattctgttatttaaatattggcaacaaactcaacatttaaaaaacagtaactataccagctaaatcaatatgctgcccatgggctgtggcttagagcggcatagttctctgagccctggcaccagaggactcttctgcctgcctggagggcagcctggctctcgcacacaggaagggatgccaggcaggacggggttgccacggcagctgcctcactcacccctggcctttccaggtacctggtcaccgagggccagatcttcatcctcttcatcttcaccttcttcgccatgctggccctcgtcctgcaccagaagcgcaagcgcctcttcctggacagcaacggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcggcactgagtccctggcaccaggctctggcgctctgctgggtgggagggtgggccatggagggcatctgaatacaggagtagggggggtgtgggtgtgtaaccagagaccgagagcatgagtggggtgtgcctcgtgtgcgtggattcgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtrtggagacaccctggcccccaggagctggaggcaccgcccactcccctggcattccagctttgcaggtgaccctcctctacccaaagctctgtccccctgctcccactccagaagaactgcggcacgygcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttccygtggggggtctacagagtcagggacagaagggaagggacccacaggaagtcacagtggtgcccagggatgtgtcagcccccagccacggggacgcgggattcaagaatgaagtaaatacrgtcacagccccaagtggtgttagaggtgttttttgtcttttctccctttcgtgctgaggtgtagcacacacggtgcgccctacagcatggtgagttgctgtatcgtgaaccctcacgcagccattgccccacgctggtgttttccatctgtgcgtcacccccggagacacctacacacataaggagggagttggccggggcaccccagcacacactggcctaactccaaggaggcacctcatctcttctggagccccttcccacaggcaaggggattcagagggagcatgttggcctggccgccttcaggcttccagagtcccaagtgactttccttgatgtccttctctccatcctctgcacagaggcagccttccctcctcttatccctgccatggggtttgggagggggagcctcaaactctgacagggaggagtcggagtccccagctaaaattctctgggtctagaaacaggtgtaaagcgattctggggatgtgatttgggagaaaagcacactttccacacagaggcggtcaggaaaggagcggggaggggagagtggggcacaggcagcgcctcccgtctatgcgcctgtgtgcaaagtggcacaatgccccccttcctattggcagtgcagcccctggccagcaaccactcgcacctgggctgggggcctttgtgtagggcacacctgtgcagccacacctacttgtagagcctcatagactcagctgtggacaaaagcctcacgccccaaacagggaaatgggatctcaaggggaagaagctggggaggcctcacaccctgcccccatttcctcctatgtgggggaggggagcagcacgaactcctgaagacttgggagcgtcagcagcttctgcggaaggggtggggctgagggtggagagaggaagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggctgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttgggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggtgagtgtgagggtctgtgtcggcctggccagggctgggggcgtgaacctcaggtggagccctcccctgactgttttcctttctctgctgcaggccaagtttctttcccaagaccaaattaatggtaggttgggtttgttctttgattagcaactcagcaaaatatgggtctcattaggcaatttgctctgctcatgttttcttggtgggaaggaaggtggctgtgggagagctgggcccacccagggccaagagctgcggggaggctgctgttggcggggtgggggttgggggtaagcctccaaaatagacatgtggctttatacttgtcagtgtgacttacaagccagggcgctaagacagaacttactaggtttccctccagaacctgaccagttggatttggggactgaggggactggggatggagagagagaccattaaaggtatggctggcagcagggaaagaggaggggctttgtaattgagacagaacagaggccaggtctgcactctctggcaggatgcgtctactctctgcgcctcagtctccctatctgtaaaatggagggtccactgagccccctttgccctggcatcaagcctggtttgggcgtgagcactttattccctgggtcccctactctgccagccctcgaccaggcttcagtttcacaccgtgcagggttctatttccagaaggccaagagcaaagagttgcgttacaaagaacttgggggcccagacctgagccaggggagcctcatggctgcagcccccctgcacctggcaggagaggcccaggaggcacagccagctgctgcttgaggttgtgaccctgaaacctgtcccaacagtggacgtcaatgggcctgagagtcccccgaggcatcccattcctccaggtctttgctgaaacatcgccttctcagtgagtccttcgctgaccactggagataaaattacaggcaccttgggcccttgtgatccagggtagggtcctgagagcccagccaagtggggttagggttacctgggcaggagttccagagttctgggtattctgagcttggtccagaggggcaggaattgtgagctccaggtgggcacctccacgtagaaccctggaactctttatcccaagaggagggccagggcaggagcagggacttttaaaacacagggcccggggcagtgccctcttgtccaggtctaacggtgataatgaatggtggactgagggctggagtccagccttcagcctcagcatcctcccacccatgcctggttttgaggctcactgaccctccctcctgggatagccaaagctcccagaagggaagaaggtaaattgtctttgtatcccagtatctgacaccaagaaagtggccaccagtgtttaatgagtgtgtgaaagactggatggggtggcctagcgaagtgggaagaacaggggctttggaggcagcagacctgaagcctaatcacccttgagcctcggttttctcacctatgaagtaggatatgccaccttaccaggctgctgcgagccacggacagaggggaataatgtcagttacatgctggacgctgggccaggcatagccaggtgtcacccacatgtgggctggggctggctcactacagctagcaagagccatagttttaggaattttgcaagcaggatgttaaagccagccattattaaataatgtaggatcaaacagtgtgtcaatccctacatctatctgtacaaaaagttaaaaagacagccctattgtgatcagtggagatggagatttgaaagaagtttcaatttaatgaatgtatttggtaaaagggtgagaaatagtttaacagtagatcacatcaggtttaatgaccattcattcattggaaaaagaatcgcactcattggcgcgcagcttcatttgtcaaatcatggttgaatcgaaactataggttggcaatggatataagagttggcaaaacttgggccgagtgcagtggctcacgtctgtaatcccagcactttgggaggccgaggcatgtggatcacctgatgtcaggggtttgaaaccagcctggccaacatggtgaaaccccatctctactaaaaatacaaaactggccaggtgcagtggctcatgcctgtaatcccagcactttgagagaccgagggaggcagatcacctgaggtcaggagtttgagaccagcctggccaacatggtgaaaccctatctctactaaaagtacaaaaattagcctggtgtgctggcaggcacctgtaattccagctactcaggaggctgaggcaggagaatcacttgaacccaggaggcggaggttgcagtgaaccgagattgagccactacactccagcctgggcaacaagagcgagactctgtctcaaaaaaaaaaaaaaaaaaaaaaaagccggtcatggtggcacatgcctataatcccagcttcttgggaggctgaggcaggagaatcacttgaacctgggaggtggaggctgcagtgagctgaaattgtgccattgcactctagcctgggcaacaagagcaaaactctctcaaaaaaaaaaaaaaaaaaagttggcaaaactcatttgtggtaatcaagtggctagatggaatttatttatttgagacagagtcttgctctgtgcaatggcatgatctccgctcatttcaaccttcaccacccagactcaagggattctcccacctctgtctcctgagtagctgggactacaggcatgcaccaccacacacaaaacatttgtaaatattttgtagacatgaggtcttactatattgtccaggctggtctcgaactcctgggcccaagcgatactcctgtctcaccctcccaaagtgctgggattacaggcgtgagccactgcacccagccctagatggaatttataataaagaatagtgtacatttctgtattatttgtaaattgtgtgctacacatcctttatgtttgtacagtgcagaggacacaagtacatttatgatcagagctggtggttaaacatccagcacagctggtgttatcctaggccttgcacaggtctctttcttgtcctgggggatttgcattttcaaagagaagacttaaaggggatttttaatccaattcatttaacccaattaatcctttcattcaacaaatgtttgtgtcccttctttgtgcctggagctacatacaacagtgaactcaaagacaaaaatcccttcctcacagggggtcaccatcgagggaggggaacgtggtgaaatatatgtgctagtatgttagagggccgacctgtcaggagaaaaagcaggaaggagagccaggaggtgaggagggagagtgaagagatggtggaggaaggggccagcaggaagcccagctgggtctccagcaccctgttgtcttgttccagtgcaggaatgcaaagttcagatgtggccttccaggtctttaaaggcgtctgaggcagggagacagcacgtatctgatgtgaaggtttgtgaggaggtgggcctctatttgagccctggccctgctgctggcaaggaccacaggcccccagtgactgacagggcttgtcggggagtagtgaagtgcccccatctgcagatccaggctgattctggaccccaagggtgtgatgagcaccttccagcacaggtcaggcagggagagcagtgggccttgggcccaccctcacccaagggcaaacccagacagaaagacaaggtgagggtggccatgagaggtccccaggggtaccccctgtagtgctaaggttaagctctgtgattggggcagtcctctctctgtccccctgacgtgaggtgatggcattgtcccctctggcactgggccctcttgcaggcaattgggttttatgggaactaaacctggggtcttaggccaggctctggccctgcttcccctgggcctttttggcccctgccacctggtcctgactttggtttgccccttcggaagctcaggctctggaatgttctgaaagggcagttgtgcggggctggggctttcctctcagtctctccacaaaggccgcgaatttgtctctaaatggtacatggcgatctgcctgtctttagtgacccccctgaaatcctaccagggaggcctgagtgccttcattagggaatatgaagggacccctggtctgggctggggatttggggggctccttctgcatcctctccctcacccta

SEQ ID NO: 12552 - DNA, 15756 bp, Homo sapiens
ccatttcctccccaaggaaattcaacatccctactcactggtgccttcatgtagtacattgtagagggatccatacggcatccagtgtgtgatgagagtaggatgaggagcaggtggagactggcaggcacctagcactgggagcacatttggatgcgagaaaatcctagaagagggagggagtggttgagacccagtacaaaagatctctttcagtgctattcagggttccttggaactagcagcttccaggttacgccttgcactacctgagccggggacactcttcattgaagtccctgctcttccttgtactccagtctcgaaccttcagcaccttcacgacaatgtcattgccctgccagcggcccttccatagctgcaggacaggtaggggttaggaggcttgaaatgttgctgccacttccttgcccactaactggaggaaaaacttaaaacaggtacaaagcaagtaatttatgggggtttagtgagggaagggcaagaagggcaggggtcacctctccagagtgattctcgttgagcttcgtcaggaagttaagctgtttgaagtcaatgccagagtgtttgttcagggttccatttcctaagagtgtgggcaggtcaggtacccagcttcaccctaacccagccccaagaggccaggattatttccttttacaacccttcttcccacagtggtgactcacggggccgagtgcgggtggtccccttccagaatgtgtccttgtatggaatacggttgagattctggcccatcttctctgcccgctctagggaagaaaaacaacctaagctgtggtacagagggagaagacaggtgggaagggacgagaggacacaagctaggggatggggagatggacctcggagaagctctctcaggggtgccttggctttgtccacaggcatctctccatacttgttacagatgctgacaagggccccatttgccaccaggtcctggaatgaaaaggccattatgatgagagccactgctacctcgctggcagtcactgaaccaaccatgaatgcacaaatgtagaacttaatcctgtaagtgtcacacagtagtactgacagaatgggttgagggttccaaaatctcccaccaaggctcagactttacttcctacccatctcaggaattaagggctgagtactcacctctgccacttgatcttggccccaaaaacaggcatagtgcaggggcacattcccgtgttcattcactgcattgatgtctgccttgtactgcaatagctggaccccatggccagacaaaaagaagaggcagaaagtacagtcagttccaaatgagatactggtgtcagggcatgggaaaagggggaagagcacacatgctttctactgtatgttacagtgcctgtgactgaccctcatggcatgtatgtgatgtggatgacgaaggagtttgtacgtaccttctgtacaatatcacggtgtccatgactggctgccagatgcaggggggtgtcatccccacggttcattacattgatccgtgccccccgcatgatcaacatctcaaccacagcagagcggccctctcggcaggcccagtgcaagggggagaagccatgatcgtccctttgaggaaggggcaatggtcattgagctggaggtgggatggggcaaaggttttgattcctgaaaaactgataattacatactctctgggaaggcttacctctctaggactttgattctcattcatgccagcaactcccaaagctgtccatttcagaccttcccctgagcttcaaaccaaaccaaccacctagatatctcaacaacctctataaaaaaatgtgttatcttcaccatatcccacatctcatttccttaggtggtagtgctcttcccctggtttctcttgcaccccttctgcaacatctattggtcctttctgttttccaccacatcttatatgtccccctacttcagcacttgttgcactggattgtaaaaatctgttaatggactgtcttgtctgttagacctttaagtttcttgagggaatggattgacagcagctgttcagtgcatgttagtgggggagaagggtgtcttggagaaggcaggccacaacttatagaagagggaacaaacttactatttggctctggtactgaaactaacatctaaaaatggaatggaatttaaatgatgttttggaagggtttatgttgaaaaggagaaatgcttttgactactgatgaggtagataacaaaccaccatgcaaagcaggattcccctacttagcaatcctgtgcatagaaaacagaagaaaatgagaatggctgttttgggattaaaactatacctgatttttttcttttccaagaaatatgtattttataaagtaaagtatacaaacaaaacaaaacaattggtttggagctgggcctgcctgacagcctggggccataaaaggaaattccctccagttcggggctgcagattcaaggggcggagcagggggcggtccgtggtctgggccagcagcctccggatgccttagtgttgtggtcacttcctgtgtgcgactctaggcaaggcctggagctgatcaggggtctggccatccagatgcccgtacagctgaaggggttggggggtgtggcctttaagttaatcattttcctccacaacttgctcgcatctgctaacacagaaatagccaaaagcttttccttgagatgggattatccccaggaagcattacgccccctgtttatcagttggtcttgcctcctagacctttaatttgtgccctgacttatcagcttccagtactgcctgtggcgccagggcaggccaaactcggggggcaaaagtatgggcacaagggttctgttcactatcaggctgcgtgccacctcagggcctggacttctatctcaagaagacctgcaaggaattaaccccctcttcatatccagcatatagccaactttggcccccatactttactcctcaaaccagcaccacaaccttccagtttcattaattccaccccttttccttctggcagcatcttcctagagtcttcctagactcagctagagtcttcctagatgctaggcccactgggcaactgcctaagcctctatttcctcaccaacaaaacagtaacagtgcttactgtctttatcagggtaccctttgagaattatatgaaaaatggaacaaatgactttgcaaagtattaaagagaaatagtgtagaacctaatgggaaccagtgaagtctagactaagatgacaggtgatcctgacctgtcaaacctaaaaactaaactccaccaattttaaaaaataaagaatttgaatttgccactctgagtcaccatcactactgctcttcttgccttcctatctcagccaaccttgtagaactggtgtacattcactttcactatttgctcacctctcaacttttgttttctttttcttttttaagacagagtcttgctctgtggcccaggctggagggcagtggcatgatcttggctcactgcagcctctgcttcccgggttcaagcagttctcctgcctcagcctccgagtagctgggattacaggcgcacgccaccacgcctggctaatttttgtatttttagtagagacagggtttcaccatgttggtcaggctggtctcgaactcctgacctcgtgatccaccagcctcggcctcccaaagtgctgggattacaggcgtgagccaccgcgcccggcctacttttcaatctgccacaaatctgctgtatcgagagcagagattatgtcagattctggactctagcacccagcacagaaggtgttcatcatagtgccttaaattaaggaacccaatgtagtctgatttcttcacccattattctgaaacaacactcacagatggtcaaatacatcctaactgcacactgaggggagcaacagacactggggcctaccagagtggggcgggtaggaagagggagggatcaggaaaaataactaatgggtgccacggcttaatacctgggtgatgaaatgatctgcacaacaaacctccatgacctgagtttacccatccaacaaacctgcacatgtaccccttaacttaaaaaaaaaaaacccaactgtaaattcaatggctactttaaaatattaatgttctttgatctctcagtagcctgtactgccgttgactacctccccttcattaaaacattctcttctgtaagctttactcacacattttcctatttctttttcaacttgcggttgctccttttctgtcgtgcaggcttcctgtcccctgacctcttgccttccactctcctgagacgttctccttcacaaccacgtcttcaagtatcatctatatatatgatatatatatgctatctatatgctgatagctctcaaatctgtgtctccaagtcagattcctcccctgaattgcaaatctgcataaccaacaacacactcaacatttccaccttgctgtattgtcaccttaactttaacatgtccaaaataaaatgcctcatcctccagttttctccatctcagtaaaaacaaccaagttcccaagccagaaccctggtcctcatctttgcccttactcactccccacaccaagttccacaattcttcgtcctaaagacttctggaatttgatcacttctctttttcactcaccctaattctagtccaagacatcattacttctacgatgaactaggcaattgcctcctttccacctgctcttcacaaagcatccaagacgatactgaaaaatggacaatctcattatgtcactatacagctttaaaaccttgcttttaaaataaagaccttcttatagcctaaatatgcttgcatgatctggctgatccttggagacctctacagtcttatgtcctgttcttttcctcttgtacccaatgctccgacccacagagatcatctatcctccagccatatggaactccagacaatttcctgttctctctgctctgtgccttgccccctagcctttggccatgcagtctactgaggctggaaagctctctgtagcctctgcctgtgaaactcttattctgcagtcaagattcagctcaaactgcgtcctctgtgaaaaccctctgccccccacaggctatgcttagcactcattacactggctagcaaaggcagccgccaccaccagacatgagcactccactccacgtagccaggagatctctagccttcctctcatccaccaaccgtttcagctcacccctggttgaggtcgttctccgtgttgtccagccacaggcgaacggcgactgcgttgccctcccggcactgagtgaaaatgtcgtccatagcagcgtcccggcgccgagtcccctggattggggaagcctgaggactgtggagtgatccagggaaggaggatgaaccccaagctttatcctctacaggagagaagtgtttgtgttgggggtagggggcctgagctgcgtccccggctagtgggggtctgtgaaggagttcggggctgcgggatgatccctggctgtgtcctctagacgcgaggtaaaggcgggtcagggtgggcagggggtgacgaagaggtagtgtctgctgaacggatgtccgagagcaggcaactagaccctatccgcgaacagagttgggggaagtggggaggttcaggctccgtatactctgggagaggggaccgggggtcctccccagggttggctccgttccttacttgggactcaggagaagtgaggggtgacagggggcgcgggtcctctcgcactcaccgggactcgggctgcaggatccttctccggggaactcccgtccggccgcgcccgcagcccgccgccggccccgccccgcccgtggcgctcttgggcagcgcgggcctccgtccctcccctcccaccgcctccctgcccttctagccgcgcctggytaaactcgatggttcgctgcgccgcgccggccgctctagcaacccctggctgtcacgctttggtttccgggtcggttctggcaggtctgagcgctccgacttccakaggagcgctgtgcacgtggagaagagcggggactcggcgaccctgccctcccgaccctcatgttcgaagagcctgagtgggccgaggcggccccagtagccgcgggccttgggcccgtaatctcacgacctycgcctgcggcctcctcgcaaaacaaggtgagtgactcgcgggagcaatgggagctgtttcaggccgcgaagcggacattggtggatcccagcgctgtgtgtattgcggggagggacacctgtggcaccgttaagggcgagtcctgatctgaagatccgagaacttccaaaagaaactgacgttgggtcagagagagttgttgagtagaagttggtgaagcgaagagggttcttcagacaggaaaaagtacgtacaagggccctgggacaagagagcatgttctgtyagagtcacaaacacaagtggtccttgtggttgaaatacatagtaaatgaaaggggcatatatgctgttcaagttcaagaggtagaagttttgcgtatattgagaatagaagccaatgaaaggttttaagcaatggaattatttcttcagatttgtattttgaaagggtcgtcggttacagtgtggaggatggrttggagacagtaagagttgtcagtatcattgttcaaaggagggtgtgggaaacttagaatcagggtaagtgcctggcctaggattacctggtaggactgcaacacagaatcagccttcccgacaatacatcttctcctttgagcctctgcagatgtgagggccctgcttcctcaggcttttcttacccttcagtctgcctccaacatggaatcggcctgctttgtttcctcctttttcatcccctagccccattaccattgtycaagccgctggcctctctgtctgcaatttctccccttcagtttgttttctacactgcagctagagacatgttaaatatttaatatacgtgtgtgatcatgtgtctcctgtgttcagaagcctccttacctcttacagaaatgtatcagctctaggcaaaagctcaaggtgaagggttggaattcctggtctctggccttggtcttgttgcttgtggcctttgcattttcctttggggaaacctccattagctcatttacacattgaagaaagtgggataggtggtttctctgctctccagcttcccagaagttggggtggtgacataaaagttcttctgggttctggcaggcttgactgggaagaattcagatgcttctgccagtctgaatcaggtccacatctctcccttcttgttctccaggcctcatccattctctttagrcccactgtcatcccctgttttcctccagggctccaagcgcygccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcascccagcacctggacaatgttgaccaaacaggtaccattggatgtgtatatgtgtgtgtgttggtgtgtgtgtgtcggggggtcagctggttctacatacaagagtgattatccactgycattaggattggggctaatggtgtactcaggcaataagaagtayttctctgcaggccacagtcacgatctcaaagacagaggtatggctgggatgacttgccgtgactccgaatgtaagagatcttgcctcatgtgyaccttcccatctccctccctgtaggtcccaaagcctggaagggtagtactacaaatgatccaccaaagcaaagccctgggtccacttcccctaaaccccctcatacattaagccgcaagcagtggcggaaccggcaaaagaayaagagaagatgtaagaacaagtttcagccacctcaggtgccagaccaggccccagctgaggcccccacagagaagacagaggtgtctcctgttcccaggacagacagccatgaggctcgggcaggggctttgcgagcccgyatggcacagcggctggwtggggcccgatttcgctacctcaatgaacagttgtactcagggcccagcagtgctgcacagcgtctcttccaggaagaccctgaggcttttcttctctaccaccgcggcttccagagccaagtgaagaagtggccactgcagccagtggaccgcatcgccagggatcttcgccagcggtgaatgggggtcagggactgtgagaagccatgtggtgggtcagtcataggctcagatcagaccaatatgtgacccttgccttccactctcaggcctgcatccctagtggtggctgacttcggctgtggggattgccgcttggcttcaagtatccggaaccctgtgcattgctttgacttggcttctctggaccctagggtcactgtgtgtgacatggcccaggtaaacccctatgttatctggcttgtgctctagggccaacctccgtatgctaatctctaacccttccttcccctttcccatcctggtatctcagtgctggctttcttcttctgcactgtgtgccttatacaacactstcactctccacaggttcctctggaggatgagtctgtggatgtggctgtgttttgcctttcactgatgggaaccaacatcagggacttcctagaggaggcaaayagagtactgaagccagggtaagagcccccaggacacagatgcatgtatgtatgtgtgcatgcatgagtctgtgcacttacacagaactttctgtctttctcaggggtctcctgaaagtggctgaggtcagcagccgctttgaggatgttcgaacctttctgcgggctgtgaccaagctaggcttcaagattgtctccaaggtgagggccccaagacatctgtacctgtttttgtctcatgtggccctattcagggtactggtgttcaggaaggaggctttaggcacaggaacagacattttgctccccaacggaagtgggagccctgggaagctttgtgagcagaggcagtacatagagggaggtgttttaaggagttgggatgaggatttggttctcaytgggtcttttctgcccctaggacctgaccaacagccatttcttcttgtttgatttccaaaagactgggccccctctggtagggcccaaggctcagctttcaggcctgcagcttcagccatgtctctacaagcgcaggtgacctctgratcttccttgaaaggggaggcagatctcaaactccaggctcagaactgtgaagactgtttccagcctggctgtgagccaagacctggttcctggtggaccctgaggacaaagtgtgataaaacctctggctcagacttgctctrctgaaggcttcttggttataagatgcataaagtcactggggctagctaaacaataaagagtttattgtgagaacatggggatatctgtctcatgacacttcaggtgttatgaaaactagatggtttggaattcaaggcatctttaggttttgctcttctttccaactaagaagccacatggccttcctgtcctgccatctccactctgctgtcatctgatctgtctacagatcagcttcctctgctcacccatagcttctgctccttcagcttcagtttgcccaggccttcaaggttgcagacaggcagctgttgctgtttgactctgaggcaactggttgtccaccaacatcttggctcaagacatcagtctgagccaccaacttgagactgtttggttgtccccataccgagcatttctagtggtttatctttcccctctcccctcatctccatttttggaaccatatagcatcaagccactcccaacacctattgtcctgtgggactttgggatgtatatagctgagagcacagattttggaatcaggtagacctggatttaattcttggcctgctacccagaggcacttaaagtcatttaatctctgtatatcacattcctcatttggaaaatggtagaatttttgtcttgcagggtggttgtgtgggttaactggagaaatctgtagccagggctgggaacataggaggtgctcagtaaactagctatgactattatgtgttgtaagccttattgttttttgaagatcttccctaggctggttggaggctgaggggtaaagaatggatttgttgactaaggaagcctctgggagaggctagacctttcaacaggcctgcttcataggctatttaatgacttttaatagattctgagcttctgtccttggaggggtagtgagggagctgggtctctgttcataaacaacttgttgatgccatgtgggcttgggggcattgggctgttcattggcggaagagtctgtccactatctctgccttgcagtggactcagatcagcatgtcctgggaaagctataggcaaggtgctgagggaaggtgagtttgaatgatagattctaggcctcccccaaaaggtatctgccatgtgcccaggtataaagatatggcctcttgtacttgtttccaggaatacctgacagtacccattgggagatcataggttctatgccctgagccagttggatgcctctaataaggggatggaggttttgaaacaggctgtagtccagagggcatgtttggaggctgggctgtgaatcattaggcaggcactacacagtgcctctacacgtactgttctttctgctggatattcatcggactggcagtttgctcatctttccgaacagcctagttgtttcctattctactcccaaagcaaaatcagttcttcatctgtactctcaaagtactatgtgaagagtgctacttcagcttctaaatattgcattgtgattcctttgtgcatttggctgctgttttctcaagccatgtttatctttgtattcccggagcttgtcatttgagatatagccagtgtacttattcacctagggagagataaggaatgacagggtccagttgagtgggatagatgagaacaggggtgttatagaaacccaggtactagggcacaagatgagggcactgttgactagtcatgatggaagaagtaggcagacaggagaacttcattaggtagaattggtgggatgttgaggttggtaagagaggaatctgaagtaagttccaggttgctcaactgtgggtaggctggtgatgccattcaaagtgttggattttaggaagtgggacatgcgtgaaatctgtgctgggggtctgggaatcagcagcctagaggtggtaattaaagtcagaatagatgagatattcagggtaagataatgagaagagaaaatggctcagaatagaactgaggagcatgtcatggatgggtaaaggaaaatgaagcagtgaaggtgatggaagaggagaaggttcacccagagatgtaggagtaaaaccaggagagttaatttttttttttttttttttttaagacagagtcttgctctgtggcccaggctggaatgcggtggcgtgatctcaggtcactgaaacctctgcctgctggttcaagcacttctcctgcctcagactcccgagtagctgggaatacaggcacatgccaccacgcccagctaatttttgtatttttagtagtgacggggtttcaccatgttggccaggctggtctcgaactcctgacctcgagtgatcggcctgcctcggcctcccaaagtgctgggattacaggcatgagccactgtgcccagccagtgtttttttttttttttttttttatgggaggatgggcaggttgttagctgtcgagtgctattgagatgagagagaactcagaatgcagtggggtaaggattgctgagtaatgtggagggcctgtttgaggtaaatggcagtggtaagaggttgctccattatgaaagccctcttccagagttcctgatagggccccagaagttcatttctgattgctttgattttttttcaggggagcaggaagccagtttatcatttgagagtgagaataggggagaggaaatatcttccaggcccacagtgcatagaaatacccagtcagggcaaaatgatttatctgtttacctctcctcatcacttgggcccagagcaatcagcagtgattaggtagagaggagccgaggagagggaagagcataccaatcactcctccctttcccagtgcaggctcctagacttagctggggcagagctgggagaggaaaaagggatttaaaactgcaacaggtgcagattattgttacacaggattagacattctaattaattgagattatgtttgttccttaaactgatcacaggactatctattaagaacatcacaacctcgctgcagcttttctccatagcagggagagtacctcccagtgaataaaatttggagggtggtaagagacaagaataaaattgggtttggttatccgtgcctcatgcttgttcagcatccctttgagagttctccaaataaatagttactgcttctgcagttattggtgtgctccagcttctgttcccataatatagtccagtcctaagggaacacagttctaaaagaaacaacatgatcttggcagagacaccgctcagctccaaacccaaccatttatgtaactgcacaaaactctctacagcttttcacagagaccagtaattagaacctttcatcccctggtcatcctccttcccaggtgaattctctgaccagccatctggttttaggatacccaactcctgcagtaactgccttactggtggtctaattgcttctactcgtgtccctaaagcaattaattttccacacagccatgtgatctttttaaaatgtaaatcagcttatgtcacttctctgcttaaaatccttcaatggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccagaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccctataacatgactgaaaccaatctaaagtattaacattttaaatatgtttttgggccaagtgcagtggctcttatctgtgatcccagctactaggaaggctgaggtgggaggattgcttgagcccaggaatttcaggctgtagtgagctatgattgtgccactgtactccggcctggataactgagatcctgtctcaataaataaataaaacaattatatatatgtataatatataatattatatatacatatgtatgtatgatgcttttcatccccaccctttcccacatctcaggaacctgtcagcaacttatccagtttaaagctgctgttcctctacctcagtggtttgggagaacatggtcattatttcactcattctttacttcctgtctcttctaggattggaatgggggagggcatattaaacgaagaaagtctcagcttacgtgattaaggtaccattggtgtgttctgtgcagacaggcatttaactgttgactcctttgtgagctcttggggttctctggagctctccatgaggactggggcactaactgactttggttgcctctttttgatgcacagcccacactgcccttcagctcttcagcccctgaccctgacaatgtacccacagcctcctcgtgctaaagtgcttcacccttgtacgcagctctcctgggaatggtcccaacaaaccctcaagactggttacctttcatggaacccacaggaaatgcatgcatatttgtcctgccaaactggaagtgcagcccagccagcagcttgcttttctcaccctgccttgtcgcagccagcctgactcttacttatacatctgagaagtgccagtctctataattcacatggctccaaatcctcataagtggttcaggttatgttctcccaagaatcctccatgccacattccaccctggtggccagatggagatgggtctgtacatttctgagcttaccaagtctctatctagagaatataatgctgaatgaatgtaatgcctctccctcacatgggaacactaaatatctacaaatggttctattggagccctcctcactcagtttagaatgaagggagtgcactactcctttgtcttgcagggagaagttatccctattcctaaagattcccatcaatgaatcttttatttctaatctcacatataatagaaagtgtagtggtctgtggatcagctttactatcttagaataaacttcatgtggatatatctagtacctttatttggaatgtgttggttcctatcacctcttgtcctcagtttcggtatgttatccaaagatcttagataactgaaaaactctaatttaactttctcttttat

SEQ ID NO: 12553 - DNA, 20538 bp, Homo sapiens
tcagagttctgcagctcacagaagcaatttcagtttccctggatccggagttttgcatccccatcatggggaccaatatgatttatatgaaagataaatgctcacagcatcaactttataatacggtaatccaattccatctctttaaaacatcataaaggaactactggtttctaaggaaaacatcttattccatacccccattctttgctgtacacatggcttaattaggcatctaggctgattgaaaaatgatgaaagagcttttccatatggcacttgctgctagattaagaaagaaggtcataatactgagaaaagatgcatcaacatgtacatattcatcttatcctgggaacatctatacagcacgatactgacatttcccacacagttatttgatcctcacagcaactctcagaagcaggcaggaccagagcattccaggaccaccggccctgctctcttctggaagccctgcaggtgggctccacctgccgtgagcatttatctttagaatagatcatgcagttagagctataaaactccaagtacagggaaatggaaattgcttccatgagctgcaaaactttatgcacctgctctctcaaaacacccttactctgggctaaaactatcattcaattctcttccctgaaccaaaccaagagctgcacagggcctgctggagggtaggggatatgggatattcatggatagcgtgagtaagtggggtgtggggcttgaacctgggctttctgaccccaagttccaagtgagccttccacaaaggcttatgaacatgtgtgcgttataatacaaatgctggtccccccacctgcgatggttttctcagcttgcttgccttccaaactcctattcagccctgaaaacctagtttaaataatcccctgccatgaattcttccccaactctgcataatagtcgaggttctctagagaaacataaccaacagaaaatagataaatatagatagatttgttataaggaattggtttatgcaattatggaggctgagaagtcccaccatctgctgtctgcaagctggagacccaggaggaccagtgatgtagttccagtgggattgtgaaggccagagacccaggatggccagcgagaaggtgggagaagacagatgtcccagcttgaaaacagccaggcggagagaaccaattctcccttgctgctccttttggttgtattcaggcctccgacaagttggatgccacccaccatgtcagggaagacaatctgccttactcagtctaccaattcaaacattaatcattcaaattaacctaggaaggttaaactcgctcacggcccccccagaaaccatgtttaaccaaatatctgggcaccccatggcccagtcagcatgacacataaattacccatcccactccacctcgagcagaactcatttttttcaaacctcacactcagacacagcctcagaacttcattgccactctgctttctacaacatgttgtcactggatgtcagcttgtccctgtcctcagccatcccaagagctccttaagtgggcacggagtgggctgtgttcgtctatgcaccccctgtgcccacacagggcctggcccccacaaggggtttggcacatgtttgttgacataagacaagctattgctattatatacttatttgtaatacatagttatgaatacactcagcaaatatttgagcacgtgctacttatcagccctgttgtacaagttgggaagatgaacctaatcaaaagagataaatccgttgcctggtggagcaggtggcaatagggctgtgaagagcagtggagcaggccaagaggaggagaggttatttcaggaaaggtctctctgacaagggaggattggtgaggaccagaaggacctgggggagcaagcatggggctctcgatgggaaggtgctccatgtaggggaacggacagtgcaaaggccctgaggtgggagaggaggtggtacattcaaaacagagaggaaaggctgggcatagtggggagtgcctgtaatcccagcattttgggaggccgaggtgggaggatggcttgggcccccaggaatttgagaccagcctaggcgacatagtgagaccttgtgtcaaaaaacaaaaaacacagctcgaggaagccagggcagccaggcaccatgagacgagtgctctgggaggcggctgggtctgtgcatgtgccctgggagacagctgggtttgcgcgtgtgctctgggaggcagctgggtctgcgcatgtgctctgggagacagctgggtctacgcatgtgctctgggggacagctgggtctgcgcatgtgcaaccttgccgccgtaaggtctctgttttcctgggcctgagacagcagcagaggagttcgagaagagacgtgagacggcctggcttcggctttaggagacagagaaatgcagctgattttcctggtacaagccccttctgagagcatgtgcactcctgggattctcgaggctccctaaagaggaaggtctcgtgatcccctgctctgcctgggcgagaaggctttcatctcccaaagcagggccacacaagggcggggaggaacccctggcccagtggagctttatctgctaagtgggcaccttcccaccccagagccagcacccaggacccttcacttctgggctggctgccaggccatggcagcacctggagctgcctgaatgcccaggacgtgctcatgtccaccctgtcatcctgtagatctccaagtgtttgtgctttgctaaatgtatatttgggattttctgcttacctccccccttacacttagacaccgtctgttcaccccatccattccccgcttcctatgtgctagacacgcatgctcttctagggtggcatttgcctggcaccagctgggtgctccatatgtgtttttaaaataaaggggaaagcactcaggccccgtgcttagagaaaagcagaggattacaccaggacttgagtgatggatgaacactgaacagtgcgaggaggaggaggtcattttcagcaaatgctcacaagcaggatgcattcagagcccatgagtcactcgctcagcatggagggtggctctgggtgttacagcaagaccgttggggagctcttgaattccaaggggttgggtcgttgtcctgtggcatgacaaaatccaggtgtttccagaatattaatccagcagaaggatagactgaaggaaaggaatcagaaagccaggagattggtttacagtcctttgttgcagacttgtatgtacgttgcatgagtttctaaaccctgtgatgggaagaaaggtgtgaccgccaacagccttggtcgggggtgaaaggacacgagctggaccacagtgagggtgctgcatttcatcctggcaagaattctgcccagctgtggctttctgtcctccgtctacaattgggagaatactggagacatcagatgtcgtgtaaggactaagaacgaaccctggagaggctcagcatctgggtgctatttgtagaggtctgctgggtgacatgtactagagtctttcattttgaagaacctgctggatatgactagaaaagtaaaggagaaaaaaactccaggactgatggatgagagaactgaaaagtggcccttgatgtcacagtgggcactgggactgcatgtccccaggggccgcaaactccagagctcaccttcccttgaatacacatccagtatggcccaagcccacgcatactacagggagtccagcctgcctggagtgccccctcactagtatttaggacaccccagggaaggttggcctgtcctctatttccagaggcaggcctttatcctctgtgaccacctcttcacccaagtacccaggggacttcatcaagcacagcacacatcagactgtaaggtttaaccaaaccttatagaggctgtgggaattacaaacaactaaattcagaaaaggcaagcattggccgggcacggtgtctcacgcctgtaatcccagcactttgggaggccaaggtgggtggatcacctgaggtcgggagtttgagaccagcctaaccaacatggagaaaccccgtctctactaaaaatacaaaattagctgggtgtggtggtgtgtgcctgtaatcccagctactcgggaggctgaggcaggagaatcgcttgaacccaggaggcgaaggttgcagtgagccgagatcgctccattgcactccagcctgagcaacaagagcgaaactcagtctcaaaaaaaaaagaaaaaaggcaagcgaagcctcagaagagggtcctcagtgcctacccacttcttagtcccctgctatcttctgccacactatagggacctgcttttctttcacagatttggggtcccctccccctgccctcagccccactcccttggccccagagacagtaggagaccctctgctcccctgagcccgggcctgtctcgcatttcccgtggagatgagcaacaaggggaaacgtgggtcttcttaaagaactttcctttccgccctccaccaccttggcaaggcagccagatgcatctccgaagtccagctcactcaggccagctctcttcacagactgtcttccagcaagaggcaaagcagagatgagacctgcacgtgctctttgtggcagagctggccttatacgcactcctgggtgaataaacagggagacatctcctaagaacaaacgcttctcagaaacagtatagtctaaactcatactgaagggagaataagccagccacgggctggagagacccccgcctacattactaagtaacaggaaaggctaagatttggagccttcctccggttcagatctatcccgggagtaatggaagatgcttgcctgttgacaatttttttttattaaaaatcccacccaggaggtctctcctgataggaggggaccatcctatcctctaaggcaaattccagcttcttccctgaaatgtacatccgctactgagcctcagaatgctatttgttccacctacttccacagttttaaggtcttcagcaacaggagaagacagcaggaaaacttgaagtgcagttggctcccgctgagatgtcactagcagaaaaagggaacacaagcaaaaggcaagattctaaagacagaggtgacaccttctgctccaaacatttggagggtcacctttccagaagtcagactcgaagtcctgaattctggcatgaatgagttctcctacgtgtagggggtggcctggaaagatcttaatttgtaagttgacaggtaaggggccttcagttggagaatcttgtcacctgattctcaaagccaaaaatatcttactgtctgaaacatgaggtcttgagtagttcaacttgacccatgcagacataatttgagagacgccaaggaggattaggaaaaaatgtatctggtcttactcaactctgaacattgcatgagtcaaacgttttcctagctctctgtttgtgtgatgggtccactctgatggattcttggcgatgtatctttcatgaccaaaattcaaaagaggccattcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacrccttcattttctgcctgagtaagtaaatgaccaccttttttttttcttttatgagagtacaatatgagaggaaatctgtgtctcttagaaaaacaaaaaacttccttttacacctacctattggcaaaattttccacttctgtgagggtactttttaaaaataattctaaatcaatttaagagacttttatttcatgcctagtttgggtcttaattgcttttccagaacaggaggaggagggaaaggttttagaactcgtaggaaggttccagtagctccttatatcaaagtcaggtgaaacatgtcagggctgaatgcagccaccagagttcgcatggactgaccagttacagcctgcaaattctgaatcataaaaattaaattagtctctctgggatggcttacaagatttcataagaccaataactggttgggttattcgtggcttgaaagtagcatcttactatgtgaccgtgctgatggtctttaacatctgtggctgaatttccaatgcctttaacatcaccatgctgttgaaattggagttaatttgaagaattaactaatttgttgaagaaagtcacactgtctcatagcctaggttaaaatgtgcagaattcagaaaataccacacaggaattacagaattgccatctcttgtagacttgcccagtgccccttctgagttcttcaaatagggtcacatattactaacaatatccagagatattgtttattgagcacctactatgttccaggcaaatatcagagctaaagctgaaaactggcaaaggaagatttctcctctctagccaactttataaacacagacagcagcaggtgaggacaatccctttaaaaataagccccatgtgagcagacacatgctgtggctgcagtggccccagccacctccccgtcctggggatgggggcggtgtccactgacctaatcaggttcgagctaaagtccctgcgtagctggtcgtctctggcttcctgggcagggtgcarcctcacccccgtgctggtttcctaaggctgctataattaattatcacaaagtgagtggcttaaaacgatgcaagttattatcttacagttctggagatcaggagttcaaactcagtctcgctgagctaaagtcaagatattggcttggctttgttctccatccccatgattcaattatctcccaccaagtccctcacacaacacgagagaattatgggagctacaactcaagatgagatttgggtggggacacagccaaaccatatcagtgctcaacaccctcccatctcttctcaaactctcaatgccccagcccctccaccacaggtcaggacctcgcctcctttctccctgagaaatcccaaccaatcgccggggaattctacagattcccacctgccagcctctgtcaccatagacctcagcttcctggccatcatcagagatagctaggagagggatggtcaggccatgtgtgtgcacactgccggggcaccccaatagtcaaaaattatttcccccaaaaattagtatttacaggtagaaagagagaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaartggttatattatattgatggtgttataaagtagttctagataaaaactattttcaaaaaagtctttaaatatatatgcatacacctatgaatattaaagcaaaagaaaacatgtttatgttaatcaactgaacatttaaaaataagataagcaaaataattgttcttgttgtatattcacatgctacagtttcttgtacctgactgataccctgtcactggcatttttcacaagaatgtattttcttcagtggggtcttgttatttttaatttttccatataattgcctgaaatcttttttccacaaattttacaattaacaaatttaaattagtaccttcaattgactcttctcttgaaccataatatattgagaaaatgttccctgtgcaggttctgagtgataagctctcagcaaattctgccaggcagaggctgttctcaagtccaattctttgcatatggaattgcataaatattttagcccagatattttcacaggtgctgtctttgtgccttagtttggaatgtagtggtgcgatcttggctcgccacaacctccgcttcccaggttcaagcaattctcctgcctcagcctcctgtgtagctgggattacaggcgcctgccaccatgcccggctaatttttgtgttttcagtagagacaaagtttcaccatgttggccaggttggtcttgaactcctgacctcatgtgatccacctgcctcagcctcccaaagtgcwgggattacaggcatgagccacaccgtgcccagcccacacgtatttttttttaaccagattaaacctttcaaataagttgtacctacttataagttttgaatgttttgtcagattcagatactgcaaaaaaaaaaaaaatcattggctttctcaatttcatctcatttcatacagaacatgaatttatccaattaaaaagattcttcccacaagctgaaatgttccagagctcattttagaatttcaaaattaactcttgtacagcatttgattttgatcattttctgatacattttataatttttctgcataccagctttgttttcaatatttataattcactaaaagctttgaaagttgacgttttgctgctctattcattgaataacttgactaaatatttccaactgatttggaacaaaattcaacgaaaatttatagatctgttttaatacactgtttaataacattttaggatgctgagactcaatgtccactaaaattgattgataatgggaaaataaaagagaaaacacatgtgaaagtccagttttttaaaaaaattcatgaacaactttatcacaagtttgtagttcagtaaatctgtgcatatgttttaacattttgtaaattttgtcacgtacgtctataaatgtcaatttatagaatattgacatttatttatatgcaataacaaattgtgtgtgcaccatgacctgttccaatcacatttctgtttcattagtgtcttaatttagtaggaatattattgttaccatgacgctggactccaccacaatttgtgttttatcctcacaaaaatgcaatgactttatttccaatgtggaaaatttaaacaacttaaatagcattcacaaaaagtcagttgtttcactttgccagaatgaatgtcccaaagccctgcttggcttccatgagctgaatgaaagaatgaattgtgattggaattaacaggtttttctgtctgaagagtccgaggatactggtgttgagctggcaccattttgctttctgtgatgttcttcttatggagccaacacacagtcagccatcacttccactgttgcacgtgcacaagaaaagctggaattaaatgtgagctgagttaacttaaagaacagtcatttgatctaagggaaaagtcatgcctctcagaatgatcttatatcagcatcttttgcagctacatggatgagaaccgtgtcttagggtgcaattttttttttttttttttgagacagagtctcactctgtcacccaggctggagtgtactggtgcgatctcagctcactgcaacctctgcctcctaggttcaagcaattctctgcctcagcctcccaagtagctggaattacaggcacctgccatcacacccagctagtttttgtatttttagtacatacagggtttcaccatcttggccaggctggtcttgaactcctgacctcatgatccacctgcctcggcctcccaaagtgctgggattacaggcttgagccaccacgcccagcctggtgcaatgttcttaaaattactaatttctaaagtagcagctctgtgtcttaggttttcttgcaatcagtgaaattgctacagaccccatagtgatgcaaatgtcaacaaacgttctatgcaagctatctgctcatcaacaacttccttgagcaacagaagtgcagtacttaaatttccattaaatatttgttttttagctcattactccaaaagggtttatttcaaattctttaagtattgccaaatgataaaatacacatagttttggatttatgccctgcaaaaaatgaccaaactattgtaacaagagcctccagcctcctccatattatgctctgggtggggactgctcagcttccatgtgccatggacatttcacaaccaccaaatcataatttcccatgtctcctgttgatctgtcaaccggcagctgtgcaacttctgctcttttatctactctctcccttggtgatttcatccagccttgtggctttaaatgccattcctatagttacaactcccagttaggtctcatcatcccagatcttgtccctgaataccacacttgtctacctaattgcctgctggatgtccccatgtgatgtccaatttatatctcaaccttaacaattccaaagttgaactcctgttcttccccaccccccacaaaaaaaactgcttcatcttcattctgtcaccttcatttcagctgatgacaacttcatacttcccagtgttcagtccaaaaaccttggcattgtccgatttctcctttctcccacccagatccaactgaaaatcacggtgttactacctccaaaacacctctagagtttgatcacttgatcacttctcaccacctgccctgctactctccccagctgtcacccgcyagcatgtttatttagtgtgtgtattgtttatcaacttcttcctcctgctaggcttatacgcacactgagagcagggatttttgcctgctgtattcactgctttgtcctaaatacctagaacagtgcctggcacatagtacattctcagtaaatacttgttcagcaaataaataactggaggaaccagtgaattataccccggtgtgaataactccatgtgagtgacatgacagaatgtcagagctagaagggcctcttgaggacatcatgtcttccttagatgaggaaagtcaggctcagagacatgaactgactctccygaggttacacagccaaatatgctcttccaaggttaattctctgctacacaatagcttttgttggtatctgtgaggctttgcggggttgaaggaatctcaggtgtcacccattaataacaatcatgacrgtgacaactaatgtttgccacgtgcttacaataagtcaggaaccctgccaagcaccgggcgtatattaacctatccaagctggggaagaatgtttaggctctgaagatwgtctggagccgcataaatcccgcagtgtaggcagctgctcattctgcagatagtattctgtggatccctgagttggctgtggccggttttgccagcaggaggccacgaagccatgagcacaggatgggatctaccccttgtgggatcgcagagggctgggagatgcagtcctccctatggaaagagacagagctttctatccctctcccggtgaaactcagcatgggagcatgggaggcaggtcagctgcgtggctatgaacatgagctatggggtgcatgcagaccaaggttcatagtgtacactgtacccaccagctgtagctcctccagcaagcgtgggargccagtcagctgcatggctgtgagcacggcctctggggtccatgcagaccaaggttcctggcgtagcactgtaaccaccacctaggtcttctccgacaagctggttaacttctctgagcctggctttgtcattcatcgcgtggggacaggtgcagcagaagagagcagacagaagcacaggatctcaatcaggctcttgaatcagactgcctgggtttgaatccaggccctactgaccagctgtgtgacctcagacaggcgactccgggtctcagcactcaattttctaattggccarctggagatgacaatggcccctaccttgaatggctgccaggaagattaaatgagaaaatacttaaatgtgaaacacttagaatggcgcctggaacacagaccattaataccatctaacagatgttagttgttawccttatttattactcatgctttcctttctmttttttcttttctctctctctctctcctyytttttttttttttttttgttgttgttgttgttgagacagggtytcagtccgtcggcccagactgaagtgcagtggcacaatcatagctcgctgcagcctcgaccttccaggcttaaacgattctcccacctcagcctctcgagttgctgggaccacaggtatgcaccaccatgcccagctaatttttgtattttttgtaaagacaggatttcaccatgttgcccaggctggtcttgaactcctgggttcatctgatccatctgccttggcctcccaaagtactgagattacaggtgtgaaccaccacacccggccaatactcatgtttttcaagcctgtaagaggaacctcctagcactgtccccaccccggccaccacactggtcccagccccaacaggtcagcttcctttgctgttcccgggcttccctcagctctatctcaagccatgacctctgcytccatgtctgcagccccatgaggctggggctgctctgtcytgcatatctccagtgcctggcaaggggctggcaagaggtagaggctcattaaatgcctgttaaaaccctaatagtaataataataatggtacagttgttactaagactaatcactaccttccaaagtctttcctctatgcaaggcacggagctaagcaccctgtagatcctgacaacagccctcccgtgatcccacaagagagacacgattctctccaatgtttaaaaaggaaagtaaaagtcaatggttctaagtagctcacactgagtgattgtacygggatttggactcaggcaccatcccttaaaccagaggtcagcaaacttttccccctcaggaacagatggtaaatatcttcagctttgcaagccagacagtctctgttacaagcgctcractcccccttgtagcatgaacacagctgtagataatacrtccaggaatgggtgyggctctgtgccaataaaactttattgtccaaaaacaggtgacaggttggtttggctcataggctgtagtctgccacttcctgttttattctaccttctgttcatttcaggtcactgtgcatggcatcatcctggccccctctagagctccaatcctccaaccagagccagctcttccctcaaaatgctacggcctgtgacaatgctccagaagcctgggacctgctgcacagagtgctgccracatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggytgcgatcgtcttcttcaactaccacatcctggcctccctgcgaacgcgggargaggtcagcaggacaaggtgcgggggccgcaaggatagcaagaccacagygctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccrgctcttcaggaccaaggtctgggaactttataaacaatgcacccctaaaagtcttgctccaatatcttcatcccataggaaagaaatcttccaacttttctggcggaattaaaacagcattgaaccaagaagcttggctttcttatcaattctttgtgacataataaatgctattgtgataggctaaatgattactcccgtagattggggggtacctaatccctggacttgatgaatgttaccaaattaagggtcttgagatggggagatgatcctgaattatccaagtgggccctatataatcacaagggtccttataggagggaggcaggaggctcagagtcaggagatgtgactatggaagcagaggccagaggaattcaggacggccactacgagccaaggattgcaggcaccctctagaggctgtaaagggcaaggaaatggcttctcccctggagcctccagaaggaatgggtcctgccaactccctgtcttcagcccagggaaacagatttaggatttctggcctccagaactgttagaggatacatttgtgttttgttttgctttgtttgctttgctttgctttgcttttttgagatggggtctcgctctgtcacccaggctggagtgcactggcacaatcacggctcactgcagcctcaacttcccagactcaagggatcctcccacctcagcctcctgtagctgagactacaggtgtgcaccaccatgcctggctaacttttctattttttgtagagatggtgtcttcctgcattgcctaggctggtctcaaactcaagggctcaagtgatcctccactttggtctcccatagtgctaggattataggcgtggccactgcgcctggccccatttgtattttaagccaccgagtttctggtaatttgtcatagcagcagcaggaaacaaataacaagtatcgggtaatggcctctcttattacacttccatttgtctattcaaagctttctaggctaactgccaggaatacagggatggtatagctagaagttctatattcaaggaacttacatacatctaaatattataatataaaaaatgaaatgagaaattgcatgaacacaccacggatccagcatcttgcgccttcagagagaaaggatatgggttccctctcaggttagcagagaagacgctgtgaagggagtcagccgtgagcctggtttccacaaagggtgcaatctggatacgtggagacagggaggaagggctggcagaggcgggaaagggtgagctgctcacaaaagaatgcttgtgcatgctcttattgaacgtgtaatgcattggtgcgggtcttgctatgagagacccaacggtgagcctaatggtgtctctaccctccaggggctcacagcaaccaggacaataattaagggattgtcatagagcaggatgcccgccaccatcagggtgaggggtgccgtgagaaccagagcagggctccagtctgggtggctgggagggatggttagagaggggttcctggaggaagagacacataaactgaatcccaaaaaatgagaagctggccaagcaaaatgggggaaaggagtgttccagacagaaggaacaaagtaggcccagaggcaggtggggttacaggttaggagggagaggttgaaggatggcagaggaggaggcgggtcatggagagaattggggctggaggagaatggacaggctgggtccaccatggtcagctggcaaagacagttcacccaggaaggatggtgggctccaggcggctttgagggccccattgaagctggaaagcgtggctgtgttgtgtgaatttactctgataatgctcgacagacccaggaaaggattgctctggagtagggtttagccagatagacggccatacgtcatgggagttggggatcctggtcagactcgggggaatgatggagagggaagaaacgagcacagggagagaaggaagtgaagtgagatcagtgtgttaaaggacggatatagtgagagaacctgggtgacagcaagaaacagaagaagagccaggcgtgatcttctgtacactgtgaagggagtcagccgtgagcctggtttccacaaagggtgcaatctgtaatcccagcactttgggaggctgagacaggtggatggcttgagcccgggagtttgagaccagcctgggcaacatagcaagaccccgtctctacaaaaaatacaaaaattatccaggcgtggtagtgcacacctgtagtcccagctacttgggaggctgaggcaagaggatcatctgagcccaggaggtcaaggctacaagcagtgagccaagattgtgccactgcattccagcctggctgacagagtgagaccctgtctcattaaaagagagagaggaaggcatagccacagagcaggaatgtttgagtagaacattccagaggcagagccatctcaggagatgacaaggaccaagtgtatccctggcaccaggtggctgaagtagagggaagaagaaggaggttggagacaacatagagaatggagaggtcaggtggtgggtgggccctacctgggccctcacaggcaggcgggacattgtcaggccctggggaggagagagtccgtgggccaggaggccattccaaggtcagtttccatggagtgggggagagggtgtagtgactggactccaagacacttgggggaatggggagaatggcagtccccacagctgcacgggaagggctggtcctcacagaatagcagcaaagactcattcattccaggaatggaaagaatgccatgttcttggagcctggagacagggtttgagaggctggcagcggctgggccaccaggacctcatcagtgataaccctgtgatcagtgttccagcccctgcaggtttcctggagagcagagtgtcgtcagaaggcctggagctgagccaacaggcaagatccagcctgcacatgtgtttaatttgaaccacatggtattttttaaaactccaagcccccaggctcttgagttggttaccagtactgaaactccccattgggagccagctttccagtttcttttgaaagtttggaacatccagcaacactgattcaatttcattcattcagcagatatttattaagcatctactttgtcagacactgttttgggcactgaaaatatggcagtgaacaaaagagaggaacatccctgggcccttggagttgaccttccagggtccccccggggctccaattctttggtgctgtgtagcagaggccccgtgaacagggcgccctcccatcaggttcacacgcatggaagctatgggaggttaagtttgcaacccctcatccagaccatcccttcacatacagtctaggaaacagagagcagtaagacctgcccaagcacacccagtgcgactcagcagccacacacaggagtaggctcagtcatctcatttaatcgcctgactcccttgtgaggtctgtttcaggatgtccactttctaggtgaggaagaggaggctaaggaaggcagtgcctgctcagactgcagaggctggattcacccaactcatctgacaccaacaccaatgtgatttccaagcccccaggcaggaattcattgggcaaaggctctgtggcaaagtggcaaaagtaggcaggaacaggcaggaatagagagtgggaaagggaaaataatacctgattcctcttctattccgagtgagctgacccacatatgccctcctttcttctttttcagccggccttaagcaggtggcttatcaaaatcctttcgaggtcttgcaaaaaccaatcccacactcgagaagaacgtgctggccggtgaaatcggacaacattgctcacgggatgtaattcaatggtagactgcagccacagcctgagaactcagacacctgatttatgagacgcacataagtaacgtttaccgaagcccagcaaatggccccacagtgggagagaaactggcaaacccgtacagtagaattctgttgcccttctgtggggaaggccagttattcatttacagagggagaaatttctgccttgactaaaaggatcgatgctgtgggaaaaggtaatatatctgagttcccatggatctggttgataggttcacctggcgtgttccatatggggccaggcccaggccacacctgtggtgctaacacctggggtggagggaggaattagcaaatagtcttccagcatccccagctccagcacccatgtgggcttccactctctccctgagaagggccaagtagaaagagagaacaaggtttcactccaatccgttcccagctctgggtctgtcctgggctccagaaccgcgtgatcaggggccatatgtggccttcactgctctctgcagtgggaaggtaagaaaactgcccccaccctgccccatcatcaccccaatccatcatggggagtgggtggcactaaggccctccaaatcccagcctcggggaaactccctgatgttgcaatggccacaggcaggctcttgctctccggagatgagtcacaaatttgatgaggagcaggtcggaagcagccctggaaagtgttcctccccacccctgctcccaccacagctccgaggagcctgggcatccaaccagggctgatccaagccttggctccggctgagctccgctctggcctctgtgcaccttcagctccttcctgcccttctctttccctgtgcccagcccctttctccagacccccttgattccttctcagcatcctcttgcctccccggaccacccccagctcaggcccctgcccaagaagggcctcaccgcggggctgcagagtgcacagtgcagccggtcagaggcccaggtctctgagtcacacatgccactgttccagtcctcactccaccaccgcatgggcctggccgaccaccgaaactcggcatcccatctgtaaaatgggaatgaggagagcagtgcctcactgtgtcgttgtgaaaattaagtgacccaaaaggacggccttattccctttttggaaagaggtaatgggcaaagaaagggaaggaaaggcgagaaaggacaagaggaaggtcagagatgtatgtgagacaccaggacagcgccaccccagcaagcaccaacaaccattttctcctatgagcagaagaggctttaactatgactgaaatgaatgcatgtcaaagcacagtctgaataaaatcccaaaaatggtgtccgtgtcactctcctggttgtgatatggcacgatccttgtgtaagatgttactattgggggaaactgagtaaagaataatggggccgggcacagtgctcatgcctataatcccagcactttgggaggccgagacaggcagatcacatgagcccaggagttcaaagaccagcccaggcaacatggtgaaaccctgtctctagtaaaaatacaaaaattagccaggcatgggggtgcacacctgtagtatcaggtacttgggagaatgtggtgggaaaatcagtagagcccagggttcaaggctgcagtgagccatgattgtgccattgcactccagcctgggcaataaagtgagaccctgtctcagaaaaaaaaaaaaaaaaaagaatgagtacaaggcatctttcttatcactgtatgcaaatctactaaaaaccttaaaaagaatgcatcattaagttcaaccactctgccttacagatgaagaaaccaaggtccagagacaagcagacttgtccaaggtcaccgagtaagcagggctcctgctgaagggctctgttcagacccaagatgcccgctgggccctggtgacaggtctcagtctcaggctgaggtcagagaagaggcctgagtgccagggttctcatttgagtggccatgatgattgcagagactccctatggccaggattgtgtttaaggcagtaaacaggaagccaagcctacttttcaggagcttcaggggacagaaaactatcaggaaggattggttgggacccagcaagtacgagaggaagacatttcagggcttcagtcaacaaggggctcagtgtactgtagctgccaaaat

SEQ ID NO: 12554 - DNA, 12797 bp, Homo sapiens
ctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccaagttcagagaggtgaagtggggggctgggggtctatcccagaccttgttgtcacctcctcactctcccagtagcgccagccagagcacctgtcttgggagccccgaggcagggacaggctatgcatccaggaagcccccaggctctaaggaggcggccctataactgctggatgaccaaaaatcaggcagcgatccctaagtcccttctgagccccaggctccaggctcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagaggggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacttccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatccccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaaccctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcaacaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccatcttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacctccctgcgttcaccaactcggaagctctcccaatcctgtcttttagggattttgatggagacttcatcatataggcatgatggataataaattcaatctccagcccctcttcccttcctggaggatgtggggtgaaagttccaagctttgtatcatggtctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgccatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtagggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctattacatcccctcattctcccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctggggtatgaggtcttggttttgacaatcagacaatgttagcacactgctgtgtcttccacctgcaatggagcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcggaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggacggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagcagttgccattcactgatggctaagtgttaaccaactcagtggagagtgagggtgacagccttttacaccttgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtatgggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaa

SEQ ID NO: 12555 - DNA, 96602 bp, Homo sapiens
cataatgaggtaagggctgtttagaggtatgcagaaagaggaagagttaggagattatagtagcagttcaagtaatgcctaatacacctgtctccacacaatggcagctggaacaaggggtgtgtgtgtcataattggccatgaggcaaagaatggaaaaagatgatttcaagtttgactgacacagagggtgatactaaaaagacaaatggataagacaagagaaaaagctggttttgataaggagggaggaaaagaatttggctctataaatactaagcttgaagaactttaagatccttttgtggaaatatctatcagacagataaataggccagttgaagtctctacagaacatatctacttggggttcatctacacagaggtgataactataaagtcatgttgacggatggagggatggagagtgaagaaggaaggggtctgggtacagaactctgtgaacttgtaccaagtaggaagaatcaccaaaggcgagcgtttgcccagtgacaggaaggtaaaacagacttgaatgcacttatgatttacccacttgcagactaagaatcaccaaattagagaaagggaaaaagactggtccaagaagtagggaaatttgcatcctttgttgcaaaacaaaccatgggatgtcagctttaaaccagagatggtagtcaacagtgacaaatgctaaagaaaagttaaaggacaaggaactaaggaaagtttactttaattggtgattagttgtttattagagacactgaaaattgtgatggtttcatgactctgcaaatactaaaaacgactgatttgtacagtttaaatgggtaatttgtacggtataggattatatttcaagaaaatacatatatacacatataaataaaataacatttttagaagtgcaatagggcagaaggtgtagaaactgcaaggggtggtaaagaatgaacagactaggaaataggttattcttttttattcattttttaattttttgagacagagtctccctctgtcatccaggctggaatgcagtggtgctcactgcaacctcccgcctccagggttcaagtgattctcctgcctcagcctcctgagtagctgggattacaggcataagccaccgtgcctggctggaaataggttattcttttgaggcatctgttctcaaagagagtaacagggaatagtagggagtaggttttgttattgttttggtttttatatatttttcagcataaaggagaatgaaaaatgtctgcagccagtaaaaacaaaaaggaatcactagaggagtcagaacaagggaggctaactggtcaagggataataaaaagcacagcaagaaagttaaccttagaaagaaagctctttcttcccctgagaatggaaggaaaagtttgagaaagatatttttaaataatcttttaagggggaggaagtaactaaaaaatctcaagagtacctccatattctctaggaagtataatgccaagatatctgttgaggggaaaggggcagaacggggaacagtgttaggaataccccagtagggatgaaactggaatggaaaagaacctcggtccacaagcggataaatcgtgagtatattcaattgttttaccttctgtaactggccaaactcctggtccctttaggttccaaggcagaatataaacaattcatgaaatgtagtgaaaatattatggacataaacagaatagagacagtcctcaaaatcgtagaactccctgaaaaagtttttgcctcaggtctataaacctgttccctattactcttcaattattttttcacaagaccctaaagttgtaagttttctcattagtagcttgtgattcctctgaaaatgactgagatttatgaactctgcaaaatgaaaatccataaacaagcaacctgtcaaggcattttagcagcacctttcaggaatgtgcttcataaatatcattttacatcataaaagactaaatatattttcaacatttagaattatggaaacaatagtaaatgtcaccactcaattatctcacccaatatcgaaatcccctcttagtaatatttggccacttatcaatgaaacctcattagtttacaaaacagcctatggcattgctgggtatcaataactggtgttcacataattcctgtattcctatattgatttttatctgtcctgttcatcccctagatctgctacacagatggcataaaataatgcatgaatgaaatctaccttttagcgactctttaacttctaccagggtccttaaactaagccttgaaaatacatttcccttatctattgattgtctttcaaacaggtaaaagcaatttttacattctcttctctagggtaaacaaatctaaccatttttctcatcatgatttttctttttttttagtgtttcaagtcctccctaaatattaggaatcaaaacagatatgatgtgcatagcacatgggaggggggtggtaactaacatgcagtaacatgtccattgtgtgtctgctgcgttgcagcatgtctgcaagctagttttcttatcctcacaatttatcactgagaaaatggagccagagacacgaaacaacctgactaattcacagctagcaagcagcatcacaactagtcttactttataccaagatactgccttccctcaatctagacactgcttttcttctgtttaagtggaatgttacatcctagaaccacttttgtcaagccaggaaaactcaggttttgtaaatgtaatcacaccaagtaaatttatttattttttattttttttgagacaatctcacctagtaaatttatatctggccagttctggcctattattatatttcagcctttaagaaatctttgatttctgagtgtcatctaatgtgctcattatcactacatggtttgagtgcatttattaacttgagaatcacgctgcttatctatttaaagttggtattaagaaagtgttaatccgagtaagggcaagaccagagtcctgcagcatatctccaaagacatctccccaggcttacatcaactcattaatcaacatttcgggtttggtaatttgcatggatataaatccatctaaccacaccttatccaatgcacatttaactcttgtgtctacacacagtattagaatcttgttggaagactatgtcctaaataaacttaaatgaacttatgtccaacaatccccaatcaccaccagtctagtaaactgtaacaaaaggaaatatgatttgtgtcacctggctttttcttgagacagggtcttgctttgtcgcccaggctggagcgcagtcacccgatcacggctcactgcagccttgatctctcagactcaagtgatcctcctgcctcagtctcccaagtagctactacaggcatgcacctccacatctggctaattttttgattttttttttgtagtggtgaggtctcactatgttgcccaggatggtcttgaactcctgagcttgtgtgatcctccagctttggcctcccacagtactggtattataagcgtgagccaccacctctggcctcacctggccttttctcactgaagctctgctggcttcagggaatcagctctcctttcccaagtactcataaacttgttggctcttccaacaagattctaaaacagattattaataggttcctagtagccaagagccatcgaatggttctatgtgaaaacagacatttaccagattctagtcttctatcattaactgtacttttaggatttttcaaaatctaagaataacgattttataaagtcatctgcaaatactctggtatacaatttacctgagcttaaaaatatgatcactctgtaatctcctcaattaccttgaatttaattcctctagatttttttgtccttatccaattttaaagaaaacaagcagaaaacactgtcctccctttcagacactcagcagagtcactgctttcaaatataatgtcctgaaatgaactagcccattttataggccacagctatgaccaatttttctttatgacattcaattttagaaacagcatttaaaatttaagaacctcattaacaactcgaatagtttttattgcttgttagtgcaaactacattttcaaaatggaacaaatttaaacaggatttgcccagaaatcaactaatatgcttgaataatgcatcacaatataatcgaaatgagataaaagagggaaaaaaaccctaaaagacaccagcggtggtcactctgaataagacaatcttggataattattatattcatagtcaagattatttaacaggtaagcatcctaagggcactttaatccaaatgtctatcaatactactaccactaccatcatccatccattctttcattcagcaatacagagggcttattaaacgtcaggcagtgttctaggcgctgaaagctcctcgctttcattctagcaacatcattcatacaaacctttagcgggcacctacaactgcaaggcattgtgctaggtatctgtaaacagcgatttagatcgagatacacaaacatcaccaagtttctcctaaaaacacagaagaccacccttaagaaatgctcttagaaatagttcctaacctcagatgacttagcgaaagctccgtttaactggcagtctaaatttagggagcattaccgagcctatcttgggcagacaatcgtttaggagctgtcacataacctctagacttacgctccaattttctaaagaacaatttctctcataacaaaccaaatcaaccaccaggagcgggtccgtaaagacgatgtctgggcaagaacgaaatctaatcccggaagtgccttttcctcatcttagccgcaccctcgttacgtggctctccaaaactccaaagtcggagtaccctagacatggaacaacctccaaaaagtttcaggcctagccaaggttgggactaatacgccgcgaaataatcggggagatatgagaagtctgtggctgtgagactgtgcgcggttaacaccgctgccccttttgcccaacccctagaaagttccccaactctgactgccccccagtgcgagggccgctaccagttctagggtgagtccggcctccctgccccgccccggcgcctcagaccctctctacacgcccgccccacaaccccgcgtcgcccgcaaagttcaatgtgtaccggaggttagcggagggaggcagaatccggaaagagagactccgccagtggatagcggcggttggccataacctactccgacctccagatacgcgggaggtgggcggcgctgccctcagtcggtgggtcactcacccctcgcttcaggcaagcccctcagcgacgtctctccttgccgactgcggccatcttgtatatggaatgtcggggacctacgtcatcacgctgcgtcctgagacgccaccaagcgaccggaggggcggagagagtaggatgcctgtcaaccaatgggaagaaagcagagctctcaaaagaggaacgagccgccgctctcctccccgcccgccccgcgggtcagtggctgctgcttacagagggaggagccagccacagggcccatcccgtcggtcccgcccctcggggcgaaaaggcattctggagcaaccgaacctgctaacggaacttgggcgcgtaggcggggcccgggtcgagattcgtccaatcaaagctctggcgggggcgaacgcagccagttgcgacatcgtggttggcggcggctgagccggccgctcttgcccccgggagctgccagcccactggctggggaggaccccgaacggaacgccggctgggtggcggggcggggccgcgcccatgcgtccgaagcgtgggccaatgaacggcggcggctgcggcccgggggcggggtccggggcgggaggagaagcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcaggtgagtgctggcggcggtctctgcgcccgcgcggcccgcgggggaaactcgcgccgcgtctccgagctctgcgaggccgtccctcgccctggccagcgcccctcggccgaagtccggcccgcgcccccgccagggtccccgccggccgctgtggccccggggcttgaaggggcaggtgtgcgctcgggggccagggcgaggagggcccggcggggtcggagggcgccggtcggcctctgcccgggcgccctgcggggcgagaggcgcgcgctcgccgctgccctgtcccctctggcgcccacgctcccgggccccgcgccacccggtctcgaggtggtgccaggtgcaggcagcgctctccccgagcttgccccsctgtccccggccctcgcgcctgctctcgggtggggcccgggcccctcgcgctagtcggctcggctctgcgcgcggccgggtcgcgctcccatttccttccttcctcccgtcamcccgctgctcggggaaggctgtgcggttttatgttcctctctgcgagttctcggtgcccaccagsgtgcccggggaccagcccccgcctcctcccgcgccgtccagttaggaagacggacgtaggaaataggtcgtctttcttcccacgcgcccctggccgtgctccacacgcgcagtgccctactagggagaggcaattcggtgctttagagtttgtcattccggcgttaactcttcctcctcgtggctccagcccggcgatgcaactcttgtcttttcccggtctccacttgggaaaaggagctgacagtgacgcgcgcccctggctgcggggctcacccctgcccggccggtgttgggaggagggcatttcagtgttgcaaaggcattcgcgggttaggaccactcggaccgtgttattttgcttttctaaataaataaggtgatgtttcaaaagcaaaaatacttttaaagtatgctgacaaatcaattttgcttttaagaatcctcgaagagttaccccatcttcgtagcctgattgtggtgctgatgaggccactataaatgcgtttgtcagaactcagaaccggacactgaaaagtgtgaattttatcttatgtaaaatatacctctccctctcccgtttttcttcttgaaatgaccttgccrgtatttcaaaactgaactaaccagtaataatctcggagaagtgtttattattttaagcgaatacatttaacccaagaatatagcaaaataaagcagtcttcctctccactgttaaaatttgccaagacttgcttgaaccttgctgtatgtactgtgtttatacgggctaccatgcgtgaaagtccagcagtactggattagtcccaagggctgccgtgattgatactttggtgaaattccaacagtttaccgaggagtttttcttcggcctaagaaagtagtttgcaaagccaagttctcaaacagctacagaacctctttattgggaccccagacaaccttggattttagccttctgctacccctttcctgtctgccctccaagtgattgtaagttaatatctgaaatggaactgtagtctgaaggagtaaaatggttgcttctccagtgtgctaacatctcagtgcttttttttcctggaattggagtggtgttggatttgaagattagaacrtcttatgtctgtatgtacggttatagcgaaagcttctygtaagagcacagtgactgtcagtaagaaagtgatggctgctgcgctgctcttccgtgccgtggacatttaggccacattttaaatgataattaagcttttgctttagaagccactggataatgagaaaaatatggaggtgatatttttcctatttaaagcttaaccactggacaactgttttggttttgagagttctgataaacggtcacaacagcctccttggaacacagtactctcctgcctggaggagaatgacaggatgacggcgccggggaaggtatgaccatcagcgacggaggcttgcttggagtgaatatttagtagacaatcattgaattcaatgaaaaccaggtgcatagtttgtgctgtgtagagttgtagtaaaaatatgagcaaaaatcctacctccaagtcagggttactctgaatgctttgtgactagatgtcagtgtagtttgaggcgtaccagttttcttcaatgttttaattacatagagtcttttttcttatcacaaatccgaagtagggtttagaactgtaactagtaatactgtatctttcttttgtgtagttggatgaatatccttctctgagaggttatttatctttagagactggtttgcctgttccctggctgctgtgccttgtgcttctgttgagggtggagaggaagagtttcaagtgtgtttctttcccttggaccgaagtcctgggaatggagtggtgactttgttccctcaaagagaactcggagtcatttattgctatggcattaaatgtttttaacagaacggtgaacttatctttattcttatattactttggatgttgcttgtggccagttataatatttgctttctcaattacctacccttatttttgggccctttttttatcagtgaaaaatcttttgattagccgtgcatcttttctctcctgctatagtcatagaagtgtttatctggstaacagtttgttttgggtcatatttaaccagtcgagagtattagaataaagagtcttgctttttcagttttctatagttttcacttctgttgcctttacaatggwtttctgtcattggatttccttttatcatctcatttttctattcataaattggagaggttaactaatttgatatgcaaatagaattaatttacataatatttactctcaaggtaaaaaatttctatcaaaatattaatatatattaatatattttcctattacaaagaagttgagacttggcttttttttttttttttgagatggagtttcgctcttgttgccgaggctggagtgcaatgtcgtgatctcggctcaccgcaacctctgcttcctgggttcattctcttgcctcagcctctgagcagctgggattacaggcatgcgccaccacgcctggctaattttgtatttttaatagagaaagggtttctccatgttggtcaggctggtctggaactcccgacctgagatgatccgcccacctcagcctcccaaagtgctgggattacaggcgtgagccaccgcactgggctgagacttggctttttaaaaagttacttaacagtcttttgaaaaaaaatttagcatctgcaagattaagaagtcttgctttttaactcaagccagagattagctgtgttgaccccgtttccacttgggagtctcctctaagttttggatataaacagactgtaaaaacgagataaaaacacagatattgaacagtttcgactgagataaatttgaatggaagaaaactgattccaaatgattataaaattcaaataccaaagttaagactttgcaattttttttttcttctatcaagtactttccaagtagaagtgaactagtgagtccaaacagtcttggttgacaatgraagacacatctatctttgaagttaagattttgaaagggatctactgattactaagccaaagtgaatcattagccttttgcaagcctaacctcagtactgggatggggaagtaggggagggcagagggacagagcaggaagaaatgtttccactgttttttagaaggacaaaaaaaattgtctagagaatgtagataatcaagtgtctacacggaactttttatttttagtttttaattgacaaaaatatatgatacatagaactcttaataaaatatacacttaggtttattactatctatgatcctgagtttcacgttccattttttaagaatacaattcatcaggacataacaggtctaagaaagtcttccgactaaatggtttacaatgttcagtctcagaaaatagacatgccttttcaatatcagcagttttctattacacatatttgagaggaagtaaagattagtgttgacaaatacttataaaagctgcttttaccataaaatatttactagtgtctaataacatttttgatttgttgtttgtaaaaatttagcttcgctgcatgtcatggtcacctcatggttctgcgtttttccctgcaacaaaaatgtggcattgcagatatggtggactggatggaagctcttttggaagttttgcccatgtcccaaatttaacctgcagctcctcctatgtatttggacaaagccagcaaaataactatacttttaaaaggccaaaaaataaaacctttacatgygtatgttttatcagtgcaagggaatagtattttgaatattagcgataacagtgaacctttggagctctcataaatgggttggttttgagccgaactcatgaaatattattatcagtaagatttgtcattgaggtgtgctggtgaggctctgacacaaactgagtctatcattttgcataaattaatcagtctccgtaagcgtcagctttctcatctgtgaaggggacttgttaatacctatcttatattgtgtaaaatgcttacctcaattcctgatcatataataaatgcccaaatgacatgattgtgatggggacgatcatattggagaacttccataggacacaggacatggcaaggatgatcctgaaataacatgacagcatgaatagttgcatttaggttcaaaaactcagttgttgaatatagcacatttatcttgctgaagatcacgaaaggctttagttgattactgtcttgtcctaaaggctatgggaccatgttgcatcatcttygtgtttgagattagattctcaggaaatgtgcaggaatgagggaatgaattcactgggctcatagaaaagctagggcagtcttaggaatattagtcaaatttctttgagttccaggaaggtgggtagtccatctcagagcacatctgaagggttttgttgactttaaaaaaaaacagttcattgaagtataatatgcttaagtggttttgctcacttttgagaaatatgtagtaatgaggggcacattaagcctggagaagacaaaactttggggagacacaaaagctgacaggtcagagaggatggtgaacttctctgcaatatcgtactggaggggctcacaaagcaggagattgccttggaagtgaacgtgcagctctgctggccgcctaaaggcgaagctttggagctgcctttttctcttactggcaatctgccttaggctgtgtttgttaatcaggaataacacgctctctctgtcctgcctgtcttatatccttctcagacttggatcaggtgaagtactgatcgtgactgctccataacatccggcaccatgatcttaaacacgcgtgggattgagagctactatacataaccccagaggtctcctctaatcctgttgctccttggttttagaatccagaatcctcatgttaaggaatgtgggtggtttgaaggtaatttcttgacggattacagctgtttcttcacacataacattgtcttttttattttagaaagatataataggaaatgattattcatgatacccaatgattttttgctttacaaaaggtttttttggtaacttccattaaataggaacctcatgttaatttatttgcaacttcattcaatggcagtttaaaactaaaacctactatgtaatgaaaagtcagtcagaaatgtttagttatttctaaaattattgtgttagtggaaaaatagcaaaaaaaaaaaattgcgaaaagcaacaactgtgcttttttatttatttatttatttttgagacacagtcttgctctgtggcccaggctggagtgcagtggcacgatcttggctcattgcaacctttgcctcctggattcaagtgattcttgtacctcagcttcccaagtaactgggactatttttagtagagacagggtttcactgtgttggccaggctggtcttgaactcctgacctcaggcgatccgtccgcctcggcctcccaaaatgctgggattacaggcatgagccactgtgcctggccaacaactgtatttttaaaatctcaagttataatacttacatgggacagcccaaattgttctgtatcaagattaaattttgatcaaattaaaattttatttgcatgcaatttatagatctttatacatcttggtacttaagtagttactgagttgaaattaattccaccttcttccctgcctgcttgccttgacttcttggtacttttgaattgtggcacatcagttcttttatttatttaatttatttatttatttttgaaacagagtctcactctgtcgcccaggctggagtacagtggctggatctcagctcactgcaatctccacctcctgggtttaaacatttctcctacatcagcctcctaagtagctgggattacaggcctgtgccaccataccaggctaatttttgtgtttttagtagagctggcgggggtctcatcatgttgaccaagttggtcttgaactcctgacctcaaatgatccacccgccttggcctcccaaagtgctgggattgcaggtgtgagccactgcccctggcccagttcctcttttaattagaagattggaatgataggtgccggttagccgtgtaaactggtatgagttggtatggcatggcgctgctactaggccctgctactgtgcaaagccagaacacgtttctgatatgtataagtttcagctaacacggtaccatggcactttatcggtatctgtaggaaaggaaacattgtacaattaaatccttttcagtttgggagtgccttcattttcctaactcgtcatcctgtaatttgtgtatttaattctgaatgtagtaatctgatcctgatggccggcaaagtattttagtaagagtgagaaaagagtatttcctattcttcctacatgaasattaggccctcacactctctcgagtgtgctttacagctgagagcctgaggtggaggaagccatccttaggaccattccctcccttagtcaacccagctgtgaagttgggtcaatgcaggatacattgaaaaacagatgctgtgcttgagctaaggtttcctggataaattgccagataagtgtaatcaaaaatgtttattctagttctgtttagttgaaagcagcattttcgagggaactcaagaaatacacaaataaatatcctttccatttagagtgtttgaaaaaaaatgcaagtgaattacatccaaatcagttcattatgtgtgaactatactttgtaaaaatgggttaggtatttagcaccccttaccccacctccgctcccactgcccacattagccaaggtcactaaatgtgctttcttgtttctcctgacccatttattccacgattcagattcgatggaaaagaatcgcttgattggcagaggtggtggttgattacagatgcccctgtatattagtcagcactttaaataataattgagtttgtcattcatttctctgtcttctaaagtgtgtcttgtctgttagatggggaggttgttggtggacttgtaagtggtatgtggtgttttaaagggccaaagtttgaagattctgtagattttaaaaatatcttgatggtgaagaaatgtagatatgtgtgaaactcttggcttagctgttcctttttatagataccccttcctctgaatgactaactataattgtataattcatgtatcaatcttgtattgctactcttcgtattttcttttgtcttaagtattatttaaatcatttttttggtcctattttcctgttttctttaagataattcagtaagtatttgtaaattatacctgatttcagtctaaactttgtggaaaaaaatttttgagttagcattgtaccttctggctaatatctgtaatttaacttgagttcgtatgtgtatgcacatataattaattcagtatgcatttatattttcctaatataaatattggaaataattattgaaaataaacatttggtctttgtgggaaattgatgaatgtttaatatatttttttcatgaagagcatgaagtatgttcagaatacctatttgagtgtctcatttgtttaaacttgtaatttagccccaaattcagctgaaatgatcatgaaarttattcacggtatataacagacttttgaatcataaatgaaaagggtagttatttaaatccataaggttggggaacttacatggcatgaatcttttttgattgctaaaagaaggcaatattgggtgaatttaggaaaccacacatactggatactaacacctcacactgaatcttaaaatttagtcatccttcttgaattgtactttatttcttgcccttctatgtttagttacttatgtgttttaggaattatccatgctgctttgagtgtgagtcttggtttcccagcctcatccttgggaactgcaggcctggttttgtccaattttgttgtcttctgcaacagcgaacatagtataggcagagagacgttgtgcagcttagtttaatcaagcttgcgtatacttagagtccacctatatgctggagctaatgcaggatttcaggtttgaagctatgggtytgctgcttggcagctgtggtctcttggccaagtcacagccctctctaagcctcctgacaactggctgtggtcactgccggcctcagtgggctatggtggggatgcagggaggtcrtgggcggatgctcgtgtccttggtcacaagtgcccatggagcttttccctgtgcttgggccgtaagctttccttttctatcagaaacagactaattcctgctttattgctttctaaagaccaataatgctttaaaaattccagtgtgtttttcagagtctctcttattaaatgtaatgtcctaaagcttttctatctaaarctggattttgaaaagagatcatctttaaaaaagttttttttgagacaggattttgctatgttacccaggctccagcccaatggctattcacaggtgtgatcatagctcgctgcagcctcgaactcctgggctcaagagagcctcccacctcagcctcctgagcacctgggatgataggcatgtgccactatgccccacagaaccgttttttaagtgtgatattacataagcgtaaccctaacccctgtccttcatggtatggccaatctatctctaattatctacatctctctatataaatttgtgtttttacttctaagaattatcatagttcattagtagaattaaatattcagtaaatgtttcattttgactactgtttaatcactgttgggagcaatgtgaaaattggtaacaccaatatattcaaatatactatccaaagattttcttttactcaacaaattttgaccttctatgtgtctgtgacactatattagatcctatgggtaatatagagatggaagctttggttttttttctgccacaagacagtgggtaaaagagtttagactgcagtgggtgaggtcacagaggttcagggactgtgctgtggaagtgtggtgaggagaccttgttagtgaggtggggttttagccaggtaaattttaggtggaggaccctgatatactcaccaaggggtcagggcatttcggctgaagtaacagagcgaagagtgtgtatgtcagggaatgacagccaggccagggggctgagggaaggtgggatgtggggagctggcaaacccacatgaaaacctgatgttttagggctgaacggagtacatatagggcgtctgccttcaaggtgctttgagttaggggtgtcccagaaatactagaattagtgccaaaccatactgaacccagagacaaaggaatcttacagacagtgatggttccaagttcatagtagatgggttacagaactggtaccgagaaacacttgccttcagtgacttaagttcacgcccgactgcctgggattcagggtacaggggactgaggagagccctcsgacagggtagacccagccagtggggaggcttactggaagagccctggaaacttgtttttggggggaacagattgaggagatggcttgggtctaggatcctgtgccctagggagatacatttactggaagaaggataggcagcccccctgcccccatccttaattaagacaagattctttctgcctaacctaggctagccactttttctaccttatagcctgtatccccgtgggagagaaacagcccaaagaggttgccaaaagacagaatcccaatataagccaactctttagcatctgtaataaccttgagtttgaccctttcttactgactttgttgggcgtgagggttgcatggaagagtctagagtttcccttaatgccacagggsacatttcggtagagcctcaaagtatgtgaaaaatcttgccaggagaagacaaggggacaggcagtgggatagctgcattccagaaaaagggaggaacatgagcagtcccctggagctgtgttgtgtaaaggtaggatgaagctggacatgtaaaatagagtgaggcagttcagtcctcgaagaccttgctagggaggttacgcattatcccgtgagctgtggaaagacgtgtgagygaaagaaacctacacagtgtagaattccacttatatgaagtttaagaataggcagaactaatyggtaatagaagttgaaatgtgggctactgggggaaggactggttgtgaaagggttcgtcaggactgctggcaaggactggtgtgtttgctgccttctgcaaggctggggccttgcatgcatggggatgagtccatgaattcgtgcactatgcggtttgtaggtttctcttttttttagtcagggtctccctctgtcacccaggctggagtgcagtgacgccatcacagctcattgcagcctctgccttctgggctgaagggatcctcccacctgagcctcctgagtatctggggactacaggcttgcgccacggtgcccagctaatttttatattgttttgtagagacaaggtttygccatgttttccaggctggtctcraactcctgggatcaagcaatccacctgccttggcctcccaaagtgctaggattataggcatgagccactacgcccagcctatgcagtttgtattttatacctcaatttattaaggctgactgttgacattgtggtcggggaggacttgtaggcagggaaatgaatcacgaagggattgaaagagctggagatgagggtcttagctaggagtggcttcagtgactgcataaacatcacccaacaggacttttgaagattgcgttctagcatatctgccttcccaggggctaatgtactggtgtgttttgaagttacacctctgctgtaattatacacctgtttgttactcattctaagagccagcagttttctggcttaaaaaagaaatcttgagaacaattggagttacaagtactcgactgtagaattactgtcaacggaatgtattttgttttcaaatcattgtaaccatatttttaatggtctgtcacgcggagcaggaattagacatttcctgtctgttccaaggggatggaaacctgggtagaagcttcagaaatgaggattgtaacctgacctaagacctgtgcagatgctcttccctgggagctcagggyggcatcctctgtgtagcacctgccatgtgttgaggcctaggctgtatgtcctcaaggagcctgttacctgaagggatgctggtatgtgagcacgtcttttagtacagtggggcccagcaataatgggagaacatacaaggaattgcagaggtgcagagaagagaagattgtgactagggggaccaggtagactttaaggggattcctggacagcatttttagagagaaccaagagttagtgartaagtgactaaaatattacagtcaaggggtgaacgggggaggcagagataggaggtacatgatgacgtctgtagagggactgggagcccttggtgttgcygggagggtgttttacatatttttgctggtttccttttattccagggtgactgaccctgtatattttacactgatttttaggagacttattagattaacatgttacacattattctttatacattagatacataagagaagatagcaatgttagcctgttaaataatgtgatttcctactatttagggtggtggcagcgtgagggtagatttaagcagcagggacaggcttgggcagggagatgtacgagactagtgttagggtctaaccatgaggactcgttcaggaggtgcaggaggaagtggctggagctgcctaggtgtgggctgagtggctgctggcagggttgtggcggggtgtggggccatatcccatggtatttgatctggaagacctgctgccatgtacttttttttttttttttttaaatctgtatttaaacagaggcagtgtggtagtggttctgggttcagattctagctgtacctcttacctgatgcatgaccttggacaaagagaagggacttaacctttctgacaatgtcatctgaaagatgaggatggtatctactgcttaaagtgcgaggaagatcaaatgaagagctctgtcttagtccagcacctggcagagggtaaatactgagctccagggaacagctgctgttacatcaatgagcaactggagttgggtggatmgctgagagaagactttggaggaggtgaggggctgcaggcagagcgaatagagcctgttttgtrgctgttggtgggcaccctgtgagggccggtgcagaacagccctgtcccaggctcacttactgttaagagaagggaaagggtcttggagctcctcatcaaagtgacgttcttgcctcgtttacaggctcccacagcagaaggtctttcaggcaaggctgaagggagaggccagctaagccattgctgacaggatgcttctgcgtctcctcctgccaagccagcagacccactatatttggaagtgtgattaacgtccttattaccagactccttggtggttttagttattttcaggtcaagttcgatggtcctccagagatgccctccgcagatatrggaagcctgaaatgcccagaagggtggaggtgctgtgtccaggctgtgcccttgctcttggctgtgagccagaaccatggggagatttttttctcttctaagaagacatttcttaagcataggaaaaggtgcttaagctgtctgtcatcctgccctcccctcacttaaattttctgcttttgatcacagaaaaaaaattccttgtattgctgcaaaagttttatgtatttttaccagtttccttttattccaggatgactgacactgtgtattttacactgatttttagaagacttattatattaatgtgttacacattattctttatacgttagatacataagagaagatacacacgttagcctgttaaataatgtgatgtcctactgttttagcacatggccatatttgcatggactcagttacagcagagtcaatgatcatctgtatagtgggagaatatgttttaaacctttgtcctagcatagttcttcacatggtgatagttaccactttttgtaaaaaacaaatggaccaaagtctgctttttgattctcacttgagataaagtgtaactgactggggctcctggaggccatcctcgtggtggtttgttattcattagcttatggatcgccctaccagcttcttggctggacactttttccatcttccttggtcatgatcttagccccttgtctctggagaatcaaagccagactcctctggcagtgactatcaccctgtcttgagtggctgcctcgctaggcttccctagakaccccctctccagccgggttcccttcctcactgtgcttccctcacgcttctagtcctgtccctgtctttgaatgccscccccccccgccattcttcacacatccatgtcccttactttctttgagacctattgttaaaagcacttgcaagcaagcattatctcatagggtctttacccaggacaccatggcgtgtcctataccacatggtctcatctgcgtgtgaaaatatgctcatcatttctcacatgcccgcagaggacccgtgtgtggcacactggaatgcgacgggagacctcgttcaagtcccgggtctgccatcagcttcctgtgaaatcccaggcaaggtgcttgggatttcccatggagcaaaatgcaggagttagactagctcgccagagtttyttccagctctaaaacgtcttcagcatttgtccagagagtgtgatcagttgcttatgatacagttatggttaatgggaaatgattattttaaggcaaagtggggagagaatatataggtctttatgcccatatgtgtatgatgtatgcatgggttttatctctctagtatcctggaatatgttagtctgcacagtgaaatctatgtaattaaaaaaaaatctagagtaaaatttgctctactatagtttttgtaggtgaaaaagaacgaacttttcttccagrgactacaaagcagakttttttttttcccatttgagaacctctagatactaatactacacatttctttttctggaagaaaacttcatgtaaggtaagatcttagcctctgaagactaagacactgccatgtgttggacatgttttattacttgattttgttctttggtaatgtaatttttttctcttttctttctcttctctgtagtcagaaaaatgggtaagaagagtcgagtaaaaactcagaaatctggcactggtgctacagcaactgtgtcaccaaaggaratcttgaacctgaccagtgagctgctgcagagtaagtcctcctctgggctctccctgccttgatgtggtggctgtgcctttttcttctttgtcaccagaatggggacgcgtgcatcagacaagctggtattcaggtccaagcttattagctgtgggcctgggcgagtcacagaggttcccaggcttgcagtcctcacctgtgaggatggaaacacccgtcagaactgtgtggctgttaacaaggcttgggtgaagtaattgtgagcttccatggcacagtcacctggaacatggtcttccctgaggacctgtgggcgagaagaagctctactgctttttcacagtgtgccgctcggcagattactgaacccttccgaaactcagtgttcttgtcgtaaacatagataataactgtctcagggaatgagccaagggccttgtgagatgtggtgtgtgaaggtacttcacgggctgttggcccaggggagtccagcgtgcctcttggagacctggccttcagagctctgcccctcactggaatggctcgcctttctttttggtgattcaattaacagtgcttctgattttttttcttttttaaacagggtcccgctctctcacccaggctggagtgccatggcactatgacgactcactgcagccttgacctcctgggctcaagtgatcttcccacttcattctcctgagtagctgggactacaggcctgtgtcaccacgcccagctaatttttttgtagagrtgaggttttgccatgttgcccaggctggtcttgaactcttgggctcgagagatcctcccacctctgcctaccaaagtgctgggattataggcgtgagccactgcacctggctgtgtatctgatttttacatgctgtagtttgagagttcttrgtttaaggaagtgaaatatctattaagtgcctctmcttgttttagcaagttagtgtaatttggtaactttttaaaattatgaatttgaattggtgcaattagtgccttggctgtagctgtggtcactgcgttgccctttgtccatgtttagattatgtggcaggctaaacctcaagtaaaaatgcagctttccctttgagacagaaagcaggccgcagccaagttggagtcaggtccctctcgagtgctgccctggaccctactggccggtggagtgtggctgtcctgcccattcctcgctgagctcccctgcctctggcagcttgaggacaggctcgctgctgcttcatctttgaggcctgttccaggcctcagtgagtgcttattgttggagaatgaagtaagactggctacccttcatagttaagactcagcgtgtgtctagttattgttagttatttgccacatatactcttttaatagagagcaaaggggccccaaaggttaagcaggagtgtgggaaggggctgtctaaaccaatgcagttgtgtgaaaagaaagagctgccaataggcggggtgcccagtgtgcagtctttcaaactcacacctcagcctcgggtgttggtcttttggttctggccccacagtggaatcttggcttcttttttagcagtgactatgccatctcattttgcaactcccccagactgctgaatatagtgccgtacacatggatgtgaaatgtttgtcgactaattgtccttatgtccaatttaactggttcccttagggaatcagtgttatggggtttaactaaaaagaaaggttgacttttactattaacttttactattaacttctttttgccatatagaagagttttggggggatagtttgcattttagcttagctttttatcatagattttcctgttagtaagtatattctaaaaagagttaactaagaataaggtggatgtgagctaggtgcttgctcagtgctctctcttgggtamgttaagtgggggatgtttttatgatgccccagggtttgtctgctttgagaagtgtacctgccttgtacttctcacattcattatcatrgctgtcatatgtctgtcttttaaaaataaaccaaccccagaacagcaacaacaaagtccaaatcctctttcttgtgcagactagtaggttaagttgaaagagagaagtgtttcagtaccatgcctcttatgttacagaatgcagcagtccggcgcctggcccaggaaaagagtgggaagagtatgtgcagatccggactctggttgagaaaatacggaaaaagcaaaaaggtaaaattgctagaatgataaytgtattttaataatgtcatgtagaaacttgattaggtcaaagggttgacgagtagtaaaggtctcagcatcattggtgtcactctgaaaggtcttgtactggggcttgcagaccgggagagagagcagttagcgggatttctcccctttctgagatgctattacctgcttcggaaagggtgagaatgttgagctttaggagaataaaatgtttgtatctgggtgctaaaatgatacaattttatttatttacattttataaagtattataccgttatttccttttgagtttcaggacagtgcatatagtgtatatcgtcaataacaaataaatgctgattggttaatgcattagcaaggtttataatgaactcacacacatctcagttaaataagaggtgtggtcatattccttaagctgtgtttttacaggacgtatgcagtcgccattgtaatgattctcatccaggctggcgtggggctaagtgtgagtttgaaaaagctcattcactatacctattgtttttgttctgtaaagcacaaaaagtaaagattattatgcaggaccacatggaaggtagaagcagaaaacatcctaaggagcatgcattggaatgtggggccctttcttattgtcatgaagggcctcaggagagggtttgttttttatttgctctctttaagtagtggttttattgctcttccatacacatctctaaacatgtagtcttcagtttagatggtctcagactccaaaatggtgagttcataatgggtgttttcaaacaggttccttcataatgggtttatttgcactaaataggagtctgtgctaatcctttgtcaccaagtgggtagcgccttagtttctcttctgygtagatactgtttactatacctgacactgagggtaaagcatttgccagttctcaaggagtgaataggaagttccgtctttgaatattcctcattctggtcattttcgccatttagcaggtatcttcrcatatccagcatgccctcttcacatatcaggttgactgttaattatgctgtggtaagatggccacaggcgcctgagctatgtgccacacccagcttcctcatagtaaagttcctgttcccctccttttattcatccaaacagaatrgttttttctatgcatgtcttttcatctttttgactacataggacatgctgaaaagttcagaaattaatataacagatgtccaagaatctgctaccccagctgagcacatgtcaaagttgtattctcattgtcctttcttttattctcacccactgatcagctttcctttcccttcctcagcccttggttttgtttttgtatttgtttttaagaaataaaacatcacagatacagccaaagcctcacattttcatccccttccattccctccctccttgcagggtgttcatcttcactgtgaatgttttctacttcataaataaccccataaaaatatatggttgtaattgatatttgaaaaatttacataaatggtgtcatattacgtgattttttaaaagccactgtggtacatttagtgttatacttatgttgatacacatagctctagctcatttaaattgccttacagccttctggcttacagctctacagttttgtgttcttagaatcagggctgtggggctcatcctttcccatgtctccttgtgcacatacgcgagctactcatttttgttttaatggaaattttgttaaagcaaatgtgaacatgagaggtggcatgtttgacttttaaggagaaaactgctctgtaaatcatagtagtggtaatagaagctctctgccctttgccatcgtattacytaatagtacctaatagtcaatatttatattacctagtgtcagtatatatttcactgtaactgacagggagtttaggattttaattcttcttccctgtcaccagttaaggtatgtactgtgaccatctggtgattagttttgatttcaagattggcgtgttaagactatttccagtgttagttatggcctgtttttattttctgagagacgtgtgaatgatatgtgtcctaaaagtagctcttgttttctaaaacgtggattaatataggtctgtccgttacttttgatggaaaaagagaagaytactttcctgatctaatgaaatgggcctctgaaaatggggcttctgtcgagggttttgaaatggttaacttcaaagaagagggctttggtttgagagcaacaagagatatcaaggtgagtttataaaatgttggtctcaaggggtctatgtgtttgaactgtggtgtgctgtagagggcgcagggtgaagaggtagacgtgtggtgggggagttctagttctgagcctgtgggcagataggcagcctggaagggccttgggctcatgttctaagcagctcctcccaccttatcctcctggggagccaagttgctaatcagtgactggggcaagtcagttcacatttctgagcctctgttaggagaccatagaacatgcctcacaggattttgagatttacctaaagataaggaggtggactcatggtttggattttgtaacttactggaggtgagtgggtggaggactggcggygtgggtatgcctactagtgtctgaaatggatgactatgaggctgaaggtactaggagctcactgaaatggcaataccagtggcaatagggagaggagagagaaacagccacctactaaggaagaagggctttttctcccctcttggttcttggttcttctttccacatgaagggagcagcagtcactggccatgcctggcctcttctcacccctcactcatgtctcttctaagaggaggcactccttcatctgttggccaagtttgggagaaggaactggacttggcctttttctcgatgggagctagttgcccgtatgcattcattccactctgctctctgccctggaagctttgcaggggcaggccacatgtggggagggcggtggggatccagctctgcctgtaactaggtgggggagtctgtctaattctgggattcagtaggtgatattttgggtgaccatctgttgtattctatctctctctcagttgcttcagaacttgggtggaggaaggggtgttatttgggccccctcaaacctccagcaacatttttggctaagttgtagttaacctttcattgatagattgataaatcacatgctggtatattagatacctgttaaatgtctactgtgtgaatggtagtatcttgcttccaaaaaaaccagtctcttccttcatgatgcttataatctatatagtaagggacaagacaggtacaaataacttaatagttgacattggtgaaagcaagatgccacatgttcttctcttgtgacagattcaaggcagtatttgtgtggatgctgcccagaagatccgagctgtggactttcctcactatgtgcttttgtggggaggcgagggttggggaggaggtcttaaacaacagacatttatttctcacaatttggaggctgaatgtccaagatctcagggtgctggcatggtctgtttaggtgaagacattcttggtttgcagacagctgccctcttgctgtctcccacatgttggagcgccatgtgcatgttttttgcagtgtagatacacaggacacagcaaaaggaagcagcctgtattgccaaaaaatgagaaaaagctttgggaaacaaatttctaaaccaatgtgtcttctgggcatgtgatttcactagtaactgttgtgctttaaagataagtatgtagaggaaggaatgttactctggcttcaaaactcagtagtagtagtaattcacgtcgacagattagggtttttgttggaggcaggaattttgttttgatttggtctggttttagaacttaaaagtacagtaaagaatacagtaaacgcctttatgctctactccaaatgttatatttgcttcaggttaaagttgaaagtcccttttttgattatttgcttctcagcatatgtagtttttagtttttctgttggaaacaggattttaagctatacttctactcatttaactataagataaatgcttacattttaaaatgtatttgaatatttatttgaagtgctgatatgcagccttaagttgtacttcatgtgtgattggatttctgaccgtagatatggttggattgaagactgtaccrtgttttgatgattctcctattattatttttttccctaggcagaagaattgtttttatgggttccacgaaaattgctaatgactgttgaatctgctaaaaattcagtgttgggtgagaataatttctgactcttcaaggcaaagcacaaatgacaaaaatatgtaaaattccattttatggcactaaggataatacttggtttttctcgactggcgaaatattccctcaaatatgcattaagtgtttttcatttaatgttataaaaaagatgcacatgacctttatttattattattattatttttgagatagggtctcgctttgtcacctaggctggagtacactggcaccatcatagctcactacarccttgatctcccaggctcaaatgattctcccacaggtgtgcaccactacatctggctaattkttttttttttttttttttttgtagtgatggggttttgctatattgcccaggctggtctcaaagtcctgagctcaagcaatcctcccaccttgacctcccaaagtgctaggattacaggtgtgagccactgcgcccagcctgtacctgactaaatgttacaagaccttttagtttttctgtaatttgtaaacgtatatttaaatgaagtttttaagaagtttgtggaacttacgctgttaacttctgggttaattcagggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccaggtgagcagctgtttgcaatttaagtatatatttcacagagtggggaggaaagaggaattgagtccataaatattccatttgatgtcttattaaggatacttaaacattttactttttaaattgaaaatataaaatacatttcatcgtttgtttttacagaaatatcaatgaaatgcggttacatatatatatctgatttcatcagtgcccagtgttaatacaagcagcagttgttcctgagttattgaaatcaccaagtttttttgtaaacaaaagatcacaatgaaattttaaaagccttaaagcatatctaatgcaataagttactctgtgtataaatttttcaagaaaatgagggttaatttttttctatatatgttagtgtaaaatattgayagttaatttagcaaattataacatttatgtttttcaacgtgtactgtgtattaattttaatttgttctcagtgaaagtttctcatagaaatctctataaggctccaagtatttgaattacctgtgatgacacctttctgtattttggtggtgtggccaccgttatctttcatttgcagttgaayagcagtcagaaggaacagggccagtaccacagtccccaccaggactgagaggcagtgtggctccttctcctgattctgcacaatctgaatcactcaagagtcagctcctgggctgctgttcttgagatacgacaagtgggcaggtgaactacttgctcgctttccttgtctttggttggtgtgacaacctgaattaggtttgatttggttgttccttaaatggtctatccttgctatgttttatttgcaagaagtggtaacctcatttcattgctacaggtgatattgctttccgtttattattttcactttgtagcatgcttactacacaagaatgttacactcagttacatctcctcctccagcaagcacttcaaatatgtcaaaaattatacatgactrttgtcttcatgtggaaatcaatcactcggtttttctaaactttaggaagtcattaggaatggtcatacagtatgtatatagcttttatttcaagttggcttaatttaaaaactattgatgaagccaaatcaaaactttgcttcttcatatagtgtgcacctgcagtcctgcagtctaaggttggtttggctcttcatgacctggaagggttatacttttattcttagttctcaatggtatatctttcatgactaaaggttaagctgactttagtaggtctaagtatttgtcattttctcttgctggacaatgaactacaagctggccctttttactaatgtgcttctagtttgcaaacgctggtagcctgctctgagaggactctcttctgttggcaggttggagggtctaggatgatggcaggtcttctgataaccgacttggcgtgaatgagctttggctgtttctttgtattaactggtccatttacttcagtattaactaagtagtgcagctttgcttcaaaatttgatgagwttttcaatggctgtgagtcactaaaatactctgttcatatagatggaaccattttttgtcaatttgtttaagagccaggtgtcttcataaccccctgaaataagcttccttagatgatgctgagatgctacggggattaaattataccaccttctatgtaataaacggtgtcattgtaaacatctcaggaattagagaacattctaaaagtaaacgattgagaagctttcccaagagtaataaaattcctacatgactaataagaacaatttgtataatttataatgagtacaaatatcctttttaaaaacaacattcttagagcactaatctttttaaagaaattattcctctttactaaaaaatttagtcaacgacgatcaaatatggaacatacaaatgtgaaattaccaggtaatcaaatgtctgcacagttgattatattttttgcaattaaatcagtctgaatatttgaaaaaagtaccatgatttagaaatcaaactggttacttttatgtcaaaagtatgaaactgagaagagcaaaatgtgtctggtcasacatataagttcttttattttatatcagacttttttttccttttgtgagacagggtcttgctgtgtcacccaggctagagtgtagtggcatgatgatggctcactgcagcctcgacctccgggctcaagcartcctcccacctcagcctccccagtagctgggactacaggcatgtgccaccacgcctggctaatttttcgtattttttgtagagatggagtttcgccacgttggcgaggctggtcttgaactcctggagtcaagtgatccgcccgccttgtcctcccaaagtgctgggattacaggcgtgaaccgcctcgctcagcctgaagacattttttattgttgaattgggagtgtggggtaccactggcatctaggttagaggtgctgctacacttctacatatagggcagcccctacaaaaggcattttccagccccaaatgtcagaagtgctgagaaaccctgctttgtatttatatacagaacagagcacctcagttacctatatgatttagaaaatcacagttcttcccacctaatgattggaagcctgaggcctaccaacactggttgtgagtgactttcaccattttctcatgaatgtcttctcgttagctgattccagaycccttcctggctgtaagtgcatcctgtggtgaggagaaggtattttagagcacttttttggtcactggcatttaacacataccccttctttttaagaacctacaaataaaagaccaggtttagagatacttgacttattaaggatacaaatacaggggaacaaacactgaaaaaatgtaaacctaagattcaggttataaaatcatgcagatttggagtaaggggctgagttgagatccttggcattgcatgttgaaaatgcgatatgcatgatggggtggggtcagttctccgtgttagctgggggacttcacaggaaggagcatttgagtgatgggagggaaggaaccctggcccctgggccgggtattcctgagtgtggttaggaagagttgaaacagctgtatccactgtccaagtgagaggcgctgtggctgcgtggaaagagcacatgctttgtagtaagacaaacctgtattgtatagttcatttgctatttacatataatttggaattaaatataatttggaattagttgctttacttctctgagtttgtttcccagtctgtaagataaaaatatgaagacctgttttttcgtgtgaccattgtcagcccaagttggagtgtttatcaaagcaactagcctggtgccatagcacctgtggttgttaggagtcagtttcctctgggaaactgtggaaatggtggggtgaagctccctcagcaagtgcagtgtggtaactgagagggcaggctctggagccagcctgctcgggctgaaatcactgcagcacccttagaactgtgccattttgggccggtctccgcgccttccttcccgtatctgtaaagggggctaatggagtgcctgactcccagggttgctgagcgagcagagttgatccacgtgaggcccttagcactgtgcctagcacacagtgctcattgtagaaatgctctatttatgctattactattttgtgtttgaccctcaggccatgttatttggttttgttttgttttgttttaaatcacttctcctgtcccttcagtatcttatgttagtatttcttagagtgttttctactaaaacaaaactcctggtggccaaaaataacattcctgcaagtctaggggctaaacccatagtgactcrtcacaagctcaaagttgctgtcaagcctgggcaacccatctctacaaaaaattagccaggtgtggtggcatacacctgtcgtcccagctactcgggaggctgaagtgggaggttggcttgagcctaagaggtcaaggctgcagtgatctatggtcacaccactgcattccagcttgggcaacagagcaagatcccatctaaaaaaaaaaagcatttgctcccaagattcatgtttttgttgttggtttttggacttgtgtttttaaatcttaaaaattcatgcaaatgataatgtttgctatttttaaaaccatgttaagtgacttaccatcaagtcagatgggtattacaggaaaacaaccctgctttctcctaagaccttgggttgtctcacgctccagtgtgaaaagcgcagtctttacgtgtagtaagtgccatgaagctgaccacgtgggcagttcagatgtggttctttttcagaagaagaaaatgtgacagtcacttaacatgggtaaaactaaccagctgtgaagggatcattacatattgataatacacaataatgagctttttttttttcttgaggtggagacttgctctatcacctagggtggagtgcggtggcatgatctcggctcactgcaacctcagcctcccgggttcaagcaattctcctgcctcagcctcctgagtagctgggataacaggtgcccaccaccacgcccagctaattttttgtatttttartagagacggggcttcaccatgttggccaggctagtctcgaactcctgatctctggtgatccacccacctcggcctcccaaagtgctgggattacaggcataagccaccgcgcctggccaatcattagaaaatttctaatgatttaaagtaagttcctattggaataggagctgtaggcaccctagaatgaggtgcactgcggtggcaggaaggaataggctgtgggctaagagcttttgaatgagggttcatgacaaagcaaaacacacttaagcaaaaattatctttttaaaaaattgtcttttgagtctagctgtttttctagttttagaatgttctcatyggttctaaaagtcttaagtaataaattggagtgaacacaaatgtaaacattgcattgctgttgttttataaaagtgtcgtattttctcatctcagtaccaaaccatgtatctttcccatgcttttccaggatcagacgttaggcctttgctccttttagtaggtcacctcatcagtgcattgtcactcagggagagagagaggattattacatcagttcccagttcatattccattactgtgacctgctctcagttttttttgttttcggcattgaggctgttaaccttttccagggtcatggggaccctctccctagagaaatgaacttgcagatcatttggcagggtgctccaaattcaagaacctcattcgcaatttttatctgtgatttcccatttaaaatagttttcttgggggcctgtaccaaactctgcatgtgaactgaaacctattttgttttctcmccccscgatctgcctgctggctcggaggtctacaggccatggcttgcagcccctgtctctgggtactttgggagtgacagcaagcacaattcagttctgtgcatccccggtggtgatcctggtttttgggagaggagcatggagaagtgataatagtccattcaaccttacagcttgcttcaggcttttagggtttttaattctaaaagcatcagtactgacttctggtatttatacatctctttgtgtcgatttctctgtattgcattttttatttattgtttttctctctttggtggtggttgcctaaaaactagaaaaataatttcctgtgctctgtcctcccagcagatttccttgatccaggaccttttagtgtggrcacttagttcagatcaccttctgtctttaacttgcttttatagtttgtttaaaacaaaagtcttgggctgggtgcagtggctcacgcctgtaatcccaacactccgggaggccgaggcaggcagatcacgaggtcaagagtttgagaccagcctggccaacatggtgaaacctcgtctctactgagaatacaaaaattagccaggtgtggtggagcgtgactgtaatcccagctacttgggagggtgaggcaggagaattgcttgaacccgggaggcagaggttgcagtgagccgagatcgtgccactgcactctagcctgggcgacagagcaagactccgttttgggaaaaacaaacaaacaaacaaaaaacaaagtctttctgggcccctgctctaactcgtgtgtatggtaggggcttgggctttacgagttttgaggagtccttccagtttttacattgtaaaatgtaaaacacctgtatgaacacctgaatgctacatacagtgtatgtcaaatatcttcttcttgacatcttcttcatgagatgtttgacactcactgtatatatccttcaggtgttcaacagataatagtgtgtaaccagaagcctcacgctgcaggaattttgagagcattcgttgtattaagatacagcacctgggccaggtgcggtggctcatgcctgtaatcccagcactttgggagtctgaagtgggagggtggcttgagttcaggagttagagaccagtctgggcaacatggcaaaatcctgtctctactaaaaatacaaaaaatagctaggcatggtggcacacgcctgtagttccagctacttgggaggctgaggcaggagaatcgcttaaacacaggaagttgaggctgcagtgagccgtgatcacaccactgtactccacccctaaccctaatccagcgacagagcgataccctgtctcaaaaaaagaaaaaaagaaaaaagatacaacacctgctgctgaaacatcatactgcagcttgatggttgaggaaagtctaccacccaaactccagaagctaagtttagaaattgtggctgagccaaaggctagaagaggcttgtatgaaatggagctaaaatttatgtcagtttgtgaaacagaggccagggaagaagagagggctcatggtggaaggccgaacttggcatttaaaactgttgcaactttaaccctagaaaaatactagcagatcagracataccaaagttcagctgtaagttgagacttttgcttggaaatggatgaccagttttgtgatagaaataagtggaaaagtagggtttggcttaaaccctactttgaagtactataattgtgtgaaagcaacgtatatcctatcagattttacttaccttaacatagttgaatgattagctcagatgtttttcatctatgccaatgaaaaataaattaatagaccctgtgaatgaactgtttaattgataatcagtgccatgtaatgggcccggtgctgtgacgtggggcaccagcttgtctgaagattagcttatcttagagacatgtacatttttctatgttgttgagattgaatgtaatgctttttaagtaaatgcaggcatacagggtttaacggaatagagacatatctattaaattgattactactatttttcagttgatctcatcacttaagtgatttgtcacaccttacttggatttcttcttttgtgttgatccaaccatttgaaaggtgcaggggaaggtatggagatggagaaactcatatgtgtatcaactgccatgaattttgtttcgaggcaagcatcattgcagcagcctcccccttttcctgccttatgcttcaggatggagtaaggcaatttcaagttggccatcttcctcgaacaggcaactcctacctagccagagctgagtggcagaagagacaagcagccatgttcacaacttactgttgctgcagcctgtctctgaaaacagggcccgccaagaggcagaggaagatgtcacttttggttcttggcatcctgtggcagttgtggctaaatacaaacattttctgctgttctacttgtctctgacagagctacacaagaatagcacaagatgtgaatttccagagatgtatttagcctatgttttcataaagctctcatctacatttagaactctgataatacatgaggccttcaggaatgtgtaccaaattagagtgaaaacctctgggcatcagcttaaagatcccaaggccctgaaattcacggaaagggtttagacgctcagtagcatacgctgtatatagctacgtgtcctttagcactgtaagggaaaatacacatatgctttatataacttggactcctctgtggcagaggttgtatacaggagtgtcccagtttatgcatagattgtattgcagattgtcactctgagttggcatggggctcctctccctattcagcttcttctattctgttggtttatcttaagtgtgaggtatcacaccagggatagggactagtatttctggggatgtgaaatttgtttgtttgttttttaactttttattttgaaataattctagacttacaaaacagttgcaaaatttgtgcacagaactcccatatacacttcacctagcttcacttaaagttaacatcttatacagccttcagtttaatgatctaaaccaggaagtcaaccgtggtacgatactattaactgatctgcagaccttgtttgaatttcaccagtgttgtcctggcattaatgcccttttttcccttccagaatcccgtattgcatttagttgtcgaatcttctcaaatcacttccagcctgggatagttccttggtctctccttgtctttcatgaccccggcacttttgaagagcactgctggcctgaccggttactttgtagaggtccctcagtatgcatttgttggatattttatcatgtgtagactgaaattacgcattttatgcaagaataccatggaagtaaagtgtgtccttctcagggaatacatgaatcaatatgtctttttggtttttccatcagaagttactgtttttctcttataattaatgaataccttatagaaagatactttgagactatgcaaatgtcctgtttctcaccatcaaatatcctgtttctcaccagatgcaaaaacctgatagatactggtttttgtatctatcatgatttttgtctgtaatagttactactgtagtgtttgccaagtggtgattttctgtctccgttatttcttctacatgcattcattgggattttactaaaaggaagagctgtcccttcttccacatttatttacttattcagctgttcatatcggtatggactcatggatatttattttatttgatagactatgtaatccattactatatatttgatacaaaaatggttttagatggctcttcatgtaaagatacctgatttcctcgtcactgataatttgagagtatgtgtcttgtgcagtttttgcatggagtgcttaataaaaaattgctgaaattgatgcataacacagcagatcatttataaagttcacttggcctcagagttccaagagtgactgtggccactgcttcctgtgtgccattttcctgacctcagtttcacttaaatgtttccctagaagcaaacgtgttccatatgtgacattttttgttctcagccaacttcatggtaacattgcatctgctgactgaggggtatgagctacaaattgaggagggacagaatagagtcaaagatgatggtgagggtacaaggcggtcagtttcataggccggaggtgttgaggttgatgagccgtgaatctagatttaatccttgcattctatggtcatgggaactgggtagataytatggggcatagaagggaaagaatgatgtctgttttcaggttgttcatctaggttggctggaggacttttccagtgaggtaagcagcattcttcacagtgtgcccctggaactgttctgtcggagcggctcttttccacgtcgtaggaaacccgtggctgcagatggaagacactgcgtgagaagggggctgaagctgtgctgagagctgcagatgacgcttctgccactgccactgccactgtgacagtggattcagtaagagtgactctccctggtgcagtgtcggctctcttctcaggctttgatccttaycctgtgagggagtttcagtcctcatttttcaaatggggaatgggagaagttgagcagcctgccagaggcttatggtacctgcacttggaactggactccaagcaggtctgttagacccaaagcctgtgctcctagccacaggggctcaccaaaccactgtcttagtctttaaggttgtgtctggtcttaattttgggacaaagaaatagtctagttttaagggcagagcaatcttgtttaaaatctcctctctcgcactggtatttcacagaaagctgggtgtggccctgctgactgaggactgcgggcctgtcagtccagcctgtgagcttgctggcagtctcttccagctccctaaagatcactccacctcttcgttttactctgtgttgggattgaaagatactcgttcttagaggaagtaataagcctatttgctttttttcccccaagctatgaggaagctggttgtgctctatttttttcttttattgttatccttaccggttcaacttatttaatgaaacaaagactgaaaaaactaggacttaggacatcagtccaggcttgcctgttctctggagagttgccggtgcctttataaagtttggtagagccactggctgtcttggtgaaatgccctgacctgtgaccttgcctgttcgtgatagctgacattgagattaatttgtgttcagtgtgtaagcactgccttcgttgtgtgctatttaaggtttccaattttgtaaattactcattctaaacacatatctcattttcatcatttccataaatgaaaactgtagctatgtcatttaaaagatctgtgcttttaactatgttcttgttttgtaaatgttatagatcacatggagacttcaccttctgtgaatttagtgttcttcattttttctattttgtccagctttagttccagtggcttttgggggactgaagaaatgaaatgggctgggcacagtggctcacgcctttaatcccagcgctttgggtggctgaggtgggcagatcacctgaggtcgggagtttaagaccagcctggccagcatggtgaaaccccgtctctactaaaaaatacacaaattagctgggcgtggtggcgtgcgcctgtagtcccagatacttgggaggctgaggcatgagaatcgcttgaacccgggaggcagagttgcagtgagccaggattgtaccactgcgctctagcctgggtgacagagtgagactctgtctcaaaaaaaaaaaaagaaatgaaatactttttctttgtccttggggttctgtctggggtcttctcggtggtgtgtgtccctgccttggagcctgggggagggtgcccctagtgtacactggtgtgtccccctgaggcgggtttgagttcccaggtcagaccccagcatctgcatcctgccctcgggactggcaacgcttctgctctgtcttcctcgctgacccttctcactggaagtcctcctattaaaccatggccttcctcctcttcctcatctctttacctgactgcggtccttggcccttttaggaaaagtgttgcttttgtcaatcagtttgggagctgatgtccagcaaagtgatgcacgttttccctagcctcccaccttacctgtgacgcaggtgtttgcatgggagtagaggcacccataggggcatggaatacagacttaaagggcaaacagttaccatggagtcccaagtgatataacttgggsctggcatcctaaccaaggaaggttaggcaatgcccgctgtgggctgagcacggtaagacttttcttactttctattatataaggaggtgtctgaaactataccttcctagaataatctgagacagaattaaacaaattagaagaaagctccaataccaggtctaggctgtcattgatcgtttaatttgtgtactgagaagtcagaatagaggccagaaatacagggctttctcctaagacagtgttccttggcgcctccaaatgccagtggtgggctgagggccctgacagaggctccctaaccctcgctgttcctccagagctgggcaccgtccccattttataagtgaggaagcaggtgtaggaacaggaaagctcgccagagccactgagtaagcccagtcaaggcggaagctgagacctgtctgaccctagacacagtttttcctccatctcctctgtctccacaggcctgtcccgttctgtgattccttctctccccaactccagtcccagctttacttgtcctgggccctccctatgagtctgatcaataagagctttgtgaaaatccctagaagtttaaaaacaaaagaaacttcaaaaaattcctttttgaaacctgctttaaaacaaaaccaaacctaagatcttccctgagtagattctctatcctctgggacaggatttttagaccttgtttttgttttgtttttaatgtgtatgatagaagagggaacctgttaatgtttttgaggtgaccctgaataagtatccttatgagaacactcccacattacacacatttgtaatcactcacattcgttgatatattggtatacccatactctggtgtccctgaagaactgtgcaattcttgtaatttcttctgctcttaatggtttagactgcagctatcctgtggccgccctttgtagctataatctactctcaaggaagaaaacggaggtgataaaagcacaaaaaggaggaaggggttagaggaccctccaggacatcagctattattaacatgtgactttgaatctgagtctgggacctctcagcagcccagtgtggaagcacagttgtgacttttcacccctgctgcattttaatatcaagtggatagtagatggcttaactttagttgaacttgagtgaatgtatagtgagttggtgaaatgattgccttaacggaaatgctggtgctgatggatctttgtagacagagagtgagggcgtagtatattctgttgccgttagtttataaggtaccattgatgagaccaagttcaggtcgtcttcctgatttcttcgaatttgagagcctgagtattggtgaggcttggctgccagtattcatttgggatatttgccaaggaggattagataactttctgcatttgcatsgcatattacctctacctggaattgatatggcctgaacactgtttttgaatattttttgcttcatttgagtccttacgagcttgcagtccactccaggtggaccatatcttttaccatcatggcctttttaaaaaaactttacttctcttatttttacgttttttcaagatggttaaaaacattttctttaattgacawattataattgtacatattcatgacatatatcaagttgtttttttttttttgagacaaagtctagtactgttacccaggctggtgtgcagtggctcaatcacggctcactgcagcctccacctgccaggctcaagccatcttcccacgtcagcgtgcaccaccatgcccagctaatttttatatttttttgtagagatgagtttttgccatgttgctcaggctgatctcaaattcatgagctcaagcgatccacccgcctcggcctcccaatgtgcagggattacaggtgtgaacctggcccattggtgatgttttgatacatgtaatgtataagatcagagcagatggataattagcatatccatcatctcagtttttcatttctttgtgttgggaatgttcagtatcctcgctatctgaaactatgaaatgtgttaatgttaactatggccatcctacagtgccataggacaaaaatatggaagtcttcactagtttgtgtgtcatccttgcgcaggtgccatgctcatcttcccagtattattccagttttagtatatgtgctgcctaagcgagcatggaaattcattttagctgtaagtttgtgctgggcagattatccaataaaagtgcccttgtaatctaatagttctgaaatagccttgtgaatggcagatcccctgactgccctgtctgttctgcacccagcctgccagctttgccttttccactgatgtttttgtgggatgcagtggaccccagaagaacagtacctcagatttcaagcttgtgacccactagctcagcctggccaggttaaattggtgtcttaggttccctgtagaaagggtctgtgattgtcaacctggctgcgtgggagtaaagaaggtgatgtctgtgacaggcccagcactcagggactgagtcctgcactgatgcaggagctgtgtactcagcagtgtagtcctagcctccttccaagagtcatgaccctgctcaagatctgattttgcaaggcagccctttccagagcgagaagactatatagttagaaagccattccttatattgaggcaaaataggcctccctgtaaccttcatcttacagttttgtttctggtttttagagcaagagagtcaatctcataatctgcagcatgagwattctttttactcaccagtgaagcattcataacctctgtcaggcacctgcttggaattacaggtttacacagttaatcggaataaatcctgtcttccaaagcttacattctaatcatatataattcagtaaaaagtgatgtcaggacacagattaaaaacaaaatcatgggaccaggcacagtggctcacgcctgtaatcccagcactttgggaggccaaggtgggcggatcacttgaggtcaggagtttgagaccagcctggccaacatggtgaaaccccgtctctactaaaaatgcaaaaatcacccaggcctggtagcgtgcgcctgtgatcccagctactcaagaggctgaggcaggagaatcgcttgaacccaggaggcggaggtttgaactgagtgccactgcactccagctgggcaacagagtgacactccatctcaaaaaaaaaaaaaaaaaaaaaaatgggagttcagagaaggaagattgctttatggagaaatttgaggaggttgttttatttttgtttttaaatgggaaaagtggcatttggagaaaatgatcatgatgtaaaaacccacatttgtttagatccttataaaatgtgttcacgtccagcttcacagctcgccctcacaataaccttgtaatacaggtatgtaactctccctatcagaagataagaaaatgaggctcaaaggggtggcttggccaaggcaaatggggtctgtgccacaacatcagcgtcccgtccgcgtcagagtgtgtggttggtggtcgttctttgggccactgttccagtgtcttagagatgcacctgggtattcgctcccctcttacctggcagtcagtacctgtcagcacgtacatttgactcttgaacagcacagggggcagtgatgctgaccccaccccatgcagtcgaaatccatataacttctaactccccaaaacttaactactgttgaccagaggccttaccagtaacgcaaacagttgattaacacatatgttgtctgctaaatgtattacatactgtattacaataaagtaagctggagaaaagaaaacattattaagaaaatcataaggaagagaaaatacatttcctattcattagtgggagtgggttatcatcagggtcttcatcttcgtcattgtgacattgagtaagaggagaaggggtgggtcttgctgtctcaggagtggcagatctggaagaaaatctatgtataagtggacccactcarttcatacccgtgtggttcaagagtcacctgtatattccttcatttgtctatcttcccaacttgaatgtaagcccactgaggacaaggactttccttcattctcatctagaatgtgcccaacacagagatggtgctctgtaattgtctgttgaatgaataaagcactcagtagccaaaacagcaaacaactaacatttgataaaactcagccagaaactgtgtatttcatttcattcttttaataacccaatgagaaggtatgattacttttattttactgaggaactgagactccctgaagtttcacagccaggaagtggctaggttggggctgattgagatctgatgcggagcckgtgtgctcagtcagtgtgctgtgtcctccacagccgcttcatagtcagaattcatgccgtgggcgtctgygcaccagaggtcatgagttttggtctggagagattgggactgtttaaaatgcytgggggctttcttaccatgatttctctcactttagatacattttccttagccacgactccatcacccagtcctggccactcttctttcttccaaagggtccctgtgctcttgacctcctcaatgtagctccaccaaggggctctttttggaatataaatagtagtccatgtctccccactgacttttccttacgcttagaacaaactcagagggctgggctgcccagatggccctgcccctgctgtggcctcatcaggggctgcttcctccctcactgcagtccactccctctggtggtgatcagggcccaggacttgccagcctcttctcctcaggactttgctgtggacccccttcctgcctgctgcaggcttccctgggttcttctagccttggcatagagtctcttctgaccgtgaagaccccctgacatctgtgctagcgtgcggttttgtcctcttgcagatgtgtcgctgcctgtgattgcttttgtgtttgtcatctgtccccttccctggagtttgagctttaagagtggggcctttctgtccttgggcaccactgtggcactgccgcctggcctagtgcctgtcacacaggagggctcaagcagcgctggttgaatggggaactgattgccttgttctctacgtgtaagtcacgtgtggccaggctctctgagggctgtgagccctctgtgcacacagaagcacctgattaggtcctgtggttcagtcgtaagtggtataaggagatataaaaggagtgaggtccagcccatccgccacaccccacgctgggtccccactgggctgggtccctcacagacagacaacttttcccagtttgtacaaaggtccctgttagacacttttgtccctctatgacaggtttacccctactgggatgaatgctaaacctgagaggagtctacagcagcttaggtgaggattgtcgagggtgtgacagcgtactgtcactctgctcacaggcctcattggccctgagcatcagcgttcctgtcctttctttgtcttctgagaagtgaaattcacagggaggaatttatcagatccttagcttttattagatttaatcgagcatctcttcagataactggcttgtgttctcttgggctattgtatttttctgttgctttttttttttaagtgctttctgtattttccaaaaaatggggtgatgtgaaatatactcccacaacactgtcaagccccttttgttcttttttttttttcacccagtgttccctacaaggcctcttacctccccacagatgccgagagctctcttcaggtgcaccctatgccctctttctgcaccttcttactggctctgctttaaacgcacaagctcccattgccacgttccactcctgagtcctccagccagggctcactgaccgcagtgagacttagattcgctctctgagctgttccagtgaatygccctcccctgcgcatgatgtagacaccggaggctgtgtgtattgctcctgaccctgtcccctactggctctactggaaattactgggtatttccacttcgcacgtgtagtgaaatgcgattatcgacagttcgagcctgaattatatttttggagagctgctacttttaggcccacctgtgttgtttagtccctgagcttggtcacgtgttaatggtttgcgtacttttgtcattttgcaaatcaactttatcctttcagcttaaaggaaaaagtgagttctaaaaattagtaatagagaacatagcatggatactgtgtttatttttatttacattcagtctcatcgggaagaacatagtaacattcatattcttttaaaaataagtcaaattactacttattgaaaatattttctgctgggcttggtggttcatgcctataatcccagcactttgggaggccagggcggggagatcactttagcccaggagttcaagaccagcctgggtaacatggtgaaaccccaacatggcgaaaccctgtctctaaaaaaaaaaatacagaaagattacctgagcatggtgatgtgtgcctgtagagctacttagcagactgaagtgagaggatggtttgagcccaggaagtgatggttgcagtgagccaagattgtgccaccatactctagcctgggtgacaaagccagatcctgtctcaaaaaagaatatttatacatataaatacatacatttatgtgtataaaaatataaatacatacatttatatgtataaaaatataaatacatatatttatatgtataaaaatataaatacatataaatatataaatatgtattatatatacttacatatttatatatgtatatataaaaatataaatatgtttatatatttaatacatagatatgttttatatatttatatataaatatatgtatttcagaatatatatgtaatgagttttgctgaatgcttctcctgtggttcggtcataggtactataaggagatataaaatcaacatgaggtccttgccttctagaagtttatcattggaaattgaaggaaaacaaacaggaaatgttgacgagcaaaagtggtaaactgaggcagtgctctgttgtctgatctctgtgaagcttggggcagtcaggtgatacctgagtggggcttgaaaggcaaagttgtctggttggaggaaataggtcagcagcagtctggagttgggggtgagaagggcatgtatggaagaacttgagaagagcagcctttgcctctcagagggcacagccctggagctgagaagcctgttgtggatttccagcaggagctgctcctatgagtctgtcgcctgaatctcccagggttgcctgtagtgcctgtggctcccgccaaagttgggatcaagtggctgctgctttagcagttctctttgtgtgatacgtgctgaagccactcggatgctctgagcctcagtttccatatttacaatctaccctctgtgacagacttgtgaatgtagctgagctatcatgaatataaatatgttttttaagtacaatcattcttctgatgtaattaacctgaagctggatgtgagcaccttcctatgatgttggaaagcaaagtccctgtattggatgtaaaaggcaagaagatgaaacagaaaggcctgttcacggtgagagggagaggactaggtcctgaagagcctccagcaagccttgccaggtagttgggatcttatcctgtaggggcacatggtcagactggcactggtttggttgcttgcttaatgacaaccccagcggcagggaggtggacggtttggaggccataagactacttagcctggtgaatccgagaagtacctgcaggtagaattgacaggatctggtgacaaactggatgtgaagagttcgggagataaggatgatcttgaggattctggaataaattggttttaagtttaccttgcttataacatgacattactaacctttctctgttttgaagctttatggtctagaatggaaatcttcaatgctaaattcctagcttattctaacttgtctaaaccagagacacaccacaggtaatctactatgctttgcatccgagctttcagttcagacaggtttattttattctttggaatatatatttgaaaccttttgtatgcagaagtcaagcctagagcaaatttttattcttaaattatargcttgtgaaagtgaaggttttaatggaagtgctcacccaaccttaaccgtagtgacacacacatggtagcatgtctgaacgaaaagctgtcagaaagagcagatttcaatttaaatatatcagtgatttcaagaccagctctaatgagtttcagaacctttgtgtcagtctcatgttttttccttaaatgctctgaagtcatttaaaattaataagccagtttttatttgatagagtttacaacagaaatgctgccatcggctttgaagtccttgttcttgtgtggtctttaaagtgaattagtggctgtggtttctggaaccagaaggaggttggcttctcatgaatgggcatgtgggctgacctgagggactgcttatgtacagttagctggtatctaaatgcaggtactgcctcaagtgaatgtaggtgaygtagtgacaaaggaagaatttcagttaatgtagatgtgaaatggagtttctttgagtgactgaagtgttgagccaagttacattgaggcttttgaaatagtatctcaaaactgaaagagatttattgagacgaatcaatctttctgtgtgtcacacacacacacacgtatacacgtacaggcacgcacacacatcatatcacacagtcacacrgtcacacacaagtctcactgatctagtgccttttcttttttggtagttacctgttatcaagcaccactgacgtgtgaagaacgtcgttaggtgctgggattgcagagaggtgctggtgtagtttccatttgcaaggagcattcagtctagtggaaaaccaaatgcagtatataatgtaatcacattgaggggttggcggagtagcccagaggcagggaaagcagcagaaagagtgggagtagggaagacttcacagaggtggcactggtcactgacccctgaagaggacgtaggagttttcctggtggagggtagagggcacagcatggccatgcagtgggcctggagtgtggtgtgcacagggaggtggcaaggtagacatgctggaagggagggaacagaactcttgaggtagcactttactcaatgccaagatccacattaacacaattccactgaatcctccgcgtgcctgcgaggtctgggtacttctgttctcatttgacagtgaggaaattgaggcctatttgctggcctgtctgtttcaggacctcagttcatacctagttggtgataatccctggacttaatctcatatctaactgaactatcttctctatccacggtactgtgctgacttcatcctgtaaccatgggagctggtcattcattccataaacatttattgagaccttctgctcacctactgctgatttacatttcaacacaagctgtggaaatgttttaagcagtggagggaggtgctcaggaatcttgctaaaatggaaggacttaaaccggtgctgaagaacccagggaacacttactggataaaaaaatacagctcctgtgtggggccacgagtagtagtgactgtgttgtttgcaaggtcaacacttttcagcacagtgctagatttttctggtgtgtgggtaggtacttccttcctggagaggctgccgagaagaattaaaagcaccataagaacacaacagtggaccgaagcaaatttgcattaagaaaaggccattccaagccaaactcacttacttttattcttttgaatttaaggagggccgcttaatctcagcctaacacttatccctgtgctgtaatagagaatgctgtctgagcatgtctggggagtactagtggatggtgtcaggctgcagtgagatgctggtggccatgtccaggctctgtgcctgaccctgtcttgcctaacacttctgtcaggaatgcagaagaccctgtttctggatgatggaaaactgagaaggaaagctctatgtagaccaggccgttcttgatttagaaaactattcgacacaagctgtttgatgaactttcccgggagtcacttggaaggcggaagtacggtggtgatctggttaggctttgtgtttccacccatctcatcttgaattgtaatctccatcattcccgtgatcaccacgtgtcaagggagagatcaagcggaggcaggtgaatcatggaggcggtttcccccatgttgttcttgtgatagtgagttcttacaaggtctgatggttttataagggctctttcccctttgtttggcacttcttcctgctgccttgtgaagaaggtgccttgcttcctcctcctctgtgattgtgagtttcctgaggcctccccaaccatgctgaactgtgagtcaattaaacctcttagctttataaactaccccgtcttgggcagttcttcatcgcagtgtgagaatggactaatacaggtggaaagaccgatgaccagacattggagccctggagtcatcttctttctttgtcagttattcactttgtgaccatagccaagtccctcaagcaatctgagcctcagtttccatacttacaaaaaaaaaaaaaaggtgggggggtggggaacctgccttgtttctcctacaggtgtgtgaagccaggtgtgaaatggaaggaaaggtatttctagatacagaggatttttacaagtgcatgttttacaaatagagcttcctgtcatggccctttaggggtgctgaagaggggattcttggactaggtgtgaaagacgttgatggcccaggatagtccttgccagttctgtaaactattgagtaactgtttacattcagggcactcgtgggtgttaaaggcactgcttcagctccgttctgttgaatccctagttgacaagctatcgggaagtaagacacatggggagaagctaaatgtcaataaaatacttgaataacagctgatcacaacaaaggattttatcagtcagcataggattaactaccaaaattctaggtagaaattgccaagaaaacttgagaggcaggaaagagtcaaatgatttatgagtttactacctaaaaaaatatagctatactttaaagacaatgacagcttccaaacattgagcattataaacttttaaaataaggtttattcatagtctatgaataaacatgacaatatgcatggcaaataacagaaaaggatgaaaatatgtacctggtggtaaatggtatcagagtaataacgaataggcctttgactactttgttaattttttaaaatagctggtattaatagaataaaaatataattttttttaaaaggctggggccagttagtaaccctcctatagcaaagatgagccagtttggggagttttctgtcaacttttaattttttaaaaattgagatttaacttgtacataatgaaatacatgtatattaaatgtaggttgttttttttttttttttttttttttttttgaggcagagttttgctcttgttgcccaggctggagtgcagtggcgtgatctcggctcatcgcaacctctccctcccgggttcaagcaattctccttccttagcctcccgagtagctgggattacaggcttgcgccaccacgcccagctaattttgtatttttagtagagacggggtttctccatgttggtcaggctggtctcaaactcctgatctcaggtgatctgcccaccttggcatcccaaagtgctgggattacaggcatgagccaccacacccaggcaggttagtttttgtactcaagtagcacaaccaagatgaagacatggaacatttctagcaacctagaaaactccccactgtcttttccccgtcagtgccccgcccgtgtcaggggtaagcgctcttctcattctgtaaaactccccactgtcctttccccatcagtgccccacccatgtcaggggtaagcactcttctcattctaaggcctttgggtgctttgcctccttggggtttttgcgttgggggagcatgcagtagggactccttggtctctggcttctttggctcagtctctggaattcacccatgttgctgtgtgtagctgtagtttattctttttgaaaatttctgtatagtttctcactgtatgaatgtaccacagttttttatctgttctgtcgatggacatttgggtggtttccagtttttggctattacaagtgaagctgctagaagtaatcttgtgtttatcttcttgtggacatatacattcatttcttctgggtattctcttgggagaagaatcattggggtattgagtgatcgtatgtttagcttcagtagatgttgataaaccgttctctgaagtggttacaccaatttacactcgcaccagctatccacaagcatcctagttgctctactccctcattagcgcttggttttttgcgatattctgatggacatgtagtattatttatggtaattttgatttactttccttgatggctaatggtgttgagcatgttttcatttgcttattagctacttagatgtcctcttttgggaagtgcctgttcaaatgttacgctcattaaagaatttttaaggccggatgtggtagctcacacgtgtaatcccagcactttcagaggccaaggcaggtggatcatgagatcaggagatcgagaccatcctggctaacatggtaaaaccctgtctctactgaaaatacaaaaaatcagctgggtgtggtggcacatgcctgtagtctcagctacttggaaggctgaggcaggagaatcgcttaaacctgggaggcagcagttgcagtgagccragatcgcaccactacactccagcctggacaacagagtgagactccatctcaaaaaaaaaagaacttttaaaatatatattttttaactcaagatacctgaaatatctattaaacatgtaattaatataaaaattattaatatattttacactgtttttataagttttggaaatccagtgtgtattttggggatgtatattacattattaatttgtaaaattgtaaaacacacataacatgaaatttgccattttaaccatgtttaagtatactagtgtcatttattgcattgacaatgttgtgtaaccatcaccaccatagaaaatttttaatccccccaaacagaaactctgtgactgttaagtattaactccccatctcccctccctgccattgcctgtctttaacttggctttttcttctggatgcgtgtcctttacaagatacacattttgtgattatcttctagtttgtggtttgcctagtcactttcttaatgatattatttgatgaagttcttaattttaacaaagtctaatttatcagttttattttttaaagatagtgctttttgtgtcctttataagaactccttgtttagcccaccggttctccaccaagaatgactgatcccttgggggaatagagacattttggctgtcacacctgggcctggggtgctgtaaacaccctgcaagacagaggacatccccacagcaaagagctgtctgtcccagagtgtcagcaggttgaagctgggagcctctcagcatgagatggtgagagtgttcttgtgtgtttgctactggaggcattgttgctttgtgtgtcactgttacgtctgcatccatctcttcttaatccttgtagatgtgatgagaagaatttaagagaaatcttggtcattccacatctgtgcccttagacttttgtttagaacaaagctcagtacattaattatgggagctttatgtggaccatattagcatatggaactgaagttttgctttttggtggcttaaaagcaatacttaaagtgtgaatataaatggcttggcatttgcagaaaccagagatttttttcctgctttgattcaattattaagaacttgatttagcatttttgtcattgttgctttttaactttcagattagaattgtaatgaagactgaaatactgacattttttcctgcacaaaatattcaattcagaaaataaatggactctaaagcatgctgttaatttttatcaggactcttacgggttctttgcactcagtgccgtgattaactaactggacatttgccaggtagaagggaatttgtcctttaatttttttcatgtagttcagtgtatttttacttgtcaggtctcccataaaactgaccacttaaatatacgaatcttagtaaagtaggtggtgccatttaagggtagtcagaggaggggaagcagtactttcagaagaggtgttcttgaatgacagctgtcattcaagatggatcatgatgaaaaagtggtgttatgaaaacttctctgtgtattcatgaccatgttgagcagattcatagtattcccgagttaaaattgacttgtaataagaatttgtggtggtagagtggtcatccagtgtgtgttgtgggatggcagttgctttgctgtgtgagaatgaccctggcaaggggatcagttgctctaggtttagacgctagggtcttgttttaaaatccctactaytgtaatcccagcactttgggaggctgaggtgggcagatcacctgaggtcgggagttcaagaccagcctggccaacaatggagaaaccccgtctctactaaaaatacaaaattggctgggcgtggtggcatgcacctgtaatcccacctactcaggagctgaggcaggagaatcgcttgaacccgggaagtggaggttgcagtgagctgagatcgcgccactgcactccagcctgggcaacaagagcaaaactctgtctcagaaaaaaaaaaaaattcctactaatgcatgttgctattttaggccactgctggctccctcttgtacttttctgcgtttttgtgaatggtgtgcactagaaggagtgctagagttggaatcagaactcctgcgtttgagtcacagctctgcctgtaaatcacaaaggggtggcaggtcacttggccacagtttctccatgtggtaatggggttgccaatcactgccttaggttggtattggaaagattggatgagaagtatgagagcacttcatgaagtataaatcttcacaaaaatgtaagggacccacttggtggaaatacctatttaacaaaatccctattatgtgttatatttgtgcagagacagcacttgaggtggttaggtgaagaggattggaatctcctgtactttctggttggatgacctggggcagggcttttctgggccttttatctgtaaaacaggagtgatggccactgtgtggtttacatttgttaatacatagaagatgcttaggacattttattgtgtctggcacacagtaggcactcagtgttcattgttacttttattgttactgttagattagagctgatttgagtgagtgaaatttaggacctgccccatgtctgcacatactgaccagtccgctggacccaggtgaggtttgtcctggaatatttagtcctggttgccagccctttgtgggcaggtgggcatggtgctcgtggaggatctgctgtgagaggagaaggtggcgcctgggctcagcagtgccaggttcagtcactcgctgatgcatcacctgcttcctctccctcatttcctcagtggcgccacgtgagcccctagaggcctgagagcaaactcccttcctggctacagttcctagcctaatgtttggcacttgataaatgtctgttgaataaatgttcgttgtttgcaggtcaggtcaaaaggtgtattaaataccctgaggaacaagtaattaatatagctggagtctttggtgctggtgtcagaaacctttgacttttttccctattttaaaaacatgaaattatttttgaattttaagtcatatatacatggaatagaaaacactagaaaatataaactagcatcaggtagaaaattaaagcttcacatattctgtttgacagggtttcagtgacccagaacctcaagtgggcagatctggatgggccagaaacctcagtgtgaaattcagcttctcccagacttcactcccattgtgcatgtgtgtgtgcatatctgtgcacccagggcagggagggctttattcagagagcagagatctttctttactcttctcctcctcagtgggagccagtgctaaacttggttcctggattcaactcgagtgagcataagtcacctgggaaacttactgaaaacgctgtttcctgggcttccctctctgggcccatcaggcccatcttgagccatcaaggctgggctcactccccctcccctctcgtttaatggctgggggtagtgactgcttgtctttggacccactccagaatatcttaccatttcctctatacttcacagttttcatctgtttcaaagaatgaaaacaggtgtgtggaattgaggagaccaaaataaatccttaagcatataaggtaggccttatggaggccttaaaattacttgattttcataagtaactttgggacttaaaaagattcagatgggtttctatattggatttgcttctgttcaagactcctggtgttgaggcacctcttcctcacgttttaactagccagtgtctgtctggagtacagagcacatgtttcaaagaacttggatatatccaaaacccataaatttaggactgaaataggatgttagttatcagatgactgagtgaatgctgaacatatatggaaacaaaagagacaagaaatggtataaccatattaatgacaatcatgaaacagaccaaatgcctcgcaccctaagcaaagtctcttacatcccgtttaagagaatcggggtgctctgtttatgtttagatttcttggcttctttccattccatctcagagtttcccctgcgtctcaccagtgctccttttcttcacttttcttttcttgtccagcctgtgcccttggtggtgtgatgcctcctgtgtctgtgttctgtcacttacttgccctcccttgtgtctttcttttttcttcatccttttaaatcctcttctttttttcctgcaaatatgtttggttcctgtgaacagaacagttcagtgcagaagggcactaacatttactgggttcctggatcatggagtggagatcccatggagcagaggcacaggcagcacccagggagcatgcagtgagtgagaaatgactcctggagacaccgtattatggcagattccagcccatcttgactaatagtcatatgtttgtgtgaatttttttgagaagtacacccagaagttcataattaaaatttttttttctttgctkcttagaggcttaaaacacacatttattatctcacagtttgtgtgggtcagaaaggcaggcatggcttagttgggctgtctgctgcagggtctctctcaaagctgcagttagggtgtggtctcatctgaaggtgtgactggggaagggtgccttccatgcccactcctgtgattggcagcaggcttcagttcatcagtgcctgggtttcttgctggcagttgctagaggccaccctcagttccttgccacatcaggcccatagattttatcagattctcaaacttcacctaccccctccccacattttctcacttcctccatcacttgttttgtttttctttcttttttcttgagacggggacttactctgtcacccaggctgagtgcagtggcatgatctcggcttactgcaaactccacctccttggctcaaacaatcctcccacctcagctttccgagttggtgggactacaggtgtgtgccaccacacctagctaatgtttgtattttttggtagtgatggagttttgccctgctgcccaggctgatctcgaattcctcacctcaagtgatctgccctcctgggcctcccaaaatgctaggattacaggtgtgagccactgcacccaacccctccaccacttgttttgattcatcctttggcagattacttttcctaaatgctgaagaccagggggtgctcagtgtctacaaagtccttgttcctggatggatactaacttactgacacctctcaagtgccagcaaactctggtagcagggattgtcttcattttacatgtgaagtaacagaccagatgggtagcactgcttggggccacatagctaatactctaatgctcctgccgtgggcactgtgccaccctctgcagggcctcatgtgttgggactgcactggcattgcaccttttcatccctctgtgtgccaatcgattctgcaaaccccagctgctcagcttcccttaacaagccctcctttccctgcctctgccatttccggtactctctgtctgggatgtctcccttcccacatggaaaatcctgcccatctttagagacttaactcgcatgccacctcctctgtgagtcattgccagatccccctcttcccgacagtgactgcagcttcttttctgaattcsagcacgtgtcatgtatcctggtgtgacacgtcacagtttgcctgtctgggctccctgctccaaagtcgttggctccttaaaagcagggaactcatcttgctcattgtccccccacaatgccttgcacgcagcagacacacagtgcaggtttggggagttgacggacgaagctttgctgggaagctttaagatgagattaaagtggctctgaagctgcagaaatgtgcattagtacatcaaggataaaattataccactttatgccttggcctcctttatcgttttctataaaataatagctattttactttgataacttttgagattaagcaaaatctttcttgaaagtttaacacctgttccttttcctacttttttgcagatatagttcatcctacagttttcacacttactcacaagagtagcacagtaaatattacatttatttcattatgtcctgttttttaaaacatgggcatatattttaagcagttaaaggctaaaagatgtggttattttggttatccttatgatggggtaacgtattttcactgaaagtcagtgggcatcttccagtcaaatggagaagttgtctgtttcgtaatacaaaggtatgttttccttgtcagcatcatgtgcaccattaagtttctgtgaataatttgaagtacctagctttatttttcgagctaaaaggttaatttgcaaaatgaccacacttgggaaagttagcagcctcgtcataggaacatgacaggaggcgctccggatgctccccagctgccccccacgctctcttgcctgccaagtaaaaccctgacatcaccgcctgcttctccctgcgtccccacctgagttactgattgcagcatgtggggcatgcagtgtgggggaggcagaaggtggggagtaggtaaatatgaaaggcaaggcctctgccctcgttggccgagcgaggtgtaagtggacactttggaggctgggatgatcctgaacctaggaactgaacctgggaacttgcttttctgagcttggcaggccgttctggtgtgaatttaaatatgctcccccctgggagaggacaccttaaaaaataaagggcaaattttaaagggaatctacacgttggtcagtgatcactactagatgggcagtctcttacttttcttccaacctacgattatgacttctggggaaaataggaagtggcaatggtgaatatggagtcagttcatatttatcagcaccttctgtttgccaggtccagcaggagagctaaggactctctctgctgggtccccttccgccctctccccacattcaggcctcagctgctctgctgctttccgtgctctgcacaccccagcacctgttccctgttgttgcttccttcctgtttgtgactatttgtcagtgtccaccatccagcagacaggaagatctgtgagggcagaagccaggtctgtcttgctccctgcttttccacttcactcagagtgggtgctgtgaatatttgttgaatgagtgaatgaatgaatgaaatccatgaarcaactcaggagcaatttcacgtggcataaaccagagtgctacgtggtattttgtagactgcatgggttagacatttagaggtcactggaggtcatatgtagatttgaaggcaaaggaatcttaaaccttgtcttaggatttggctaagtggatgggggggcggattattccaataattggattattattccagtctggaaagttgtgaaaatgtgtatgtttgggggaggagggtttgaactgttttccacaycaagttttttttagggattaataatctaagattacctctaggttaatacaacagcttgttttttttagaaattaaaaggtaaataggaaaaataatggtcattttgctgagcatagagtcttaactgacaaagctaatgatctggaaaaacctatgttggaaaatgtcactttattatatatgtctggaagtacagatgggaaaacagatttttttctttttgcagtagattcattaagtgcttaagaagagattctcttctgtaccatctttacagcctgagtaattggaggctaaatctaaactccacattgtcttatgtttcttgcaaaagaggtagctggattgctattttctgacacttaaatggaggtccatttctaggcatctgccagtgccttgcttagagcgagataatcccttctgcacctgccgtgtacaaagcgattatggcagaaactaaagactaataacagctgacrcctactgactgcttactgtttgctgagaatgttccactgagcacagaaaccttaggcacttgctccaggtcttccaggttcagagctggcgctgggctttgcagggctagatgccaggcaggtgctctaaccacttggctctgctgggccacacggcagctcccagtgcccgctggcaggcctttcgtgttcttgcatgcgcctaaccccttgtggctcctactctaggagagttaaataccaaggtgtgcacgtggatggcggagttcctccttgaacctctgactttggcaagatagttggctaaccatcttgtagagggtaggactccttagttcagcaaacctgctagagtgttattttgtgtgccagtgcataaattaaccattattatttatagtcctgtttcttttggtctggtgcagtttaatttaaaagaagtagggagaagtgaaactggtttgctgtgatttagtccatcagccctccctctggactgcctcatccctcctgttctatagggcaccctccgaagccccgtgtcctccccaccatcccctttctcagcttctgctcccgggtgctgagtgttgtgaagtttccaggtgccataacagttagtgcaaggtgagtctagccttctcagcctggccggtgagtctccttcctgcctggagaaaggcacagttgtgtcttaccggcttctctctcacttccctgggtacagattcagggtctctgtgtctcagctcttcctgggctcccctcatccctgcactgctgagaaaactgagaccatgtgacaagaacttcctttccttttgtctccacctgggtttcttatgtcctcctctcctcccctccctctgaggaagggaccccccttagagctaagggaagccctggggcctggtcaggaactcaggtcaggagctcagcgacattggccctgtgttttcactctttctttctgtcctggctttatccccttggtttacagacagcccccatgcctttgagatgatgtcctgtctgtcttccacctttaatcacaacatttatcaagaacattccacactgagagttcttccagccccagcagcctggctctccccgccctgaagtgtgatgccctctgggagggcctggggtctggcttctttccctgcccagtcccctcatcctccccacgttcctgcttcgttcttcctgctcttctgaatctccaggcttttctgaccctaccattcctgtcccccgaatgtaagagctctccaagtttctgggctccgagttgggagtcagctgacctggatttcaaaacccaattctgaagtcttttctcatctatgactatagtcaaacatcttatagtaaaagatagcttaagtcagtctattggatttcctgcattctattccaggtggacaatttaataattacctgttttctaggtagtgcttaaaagatctgcactgattaaactattctttcattgaaaatttgtttccagaaattgaatgctccaacaaaatggtatcattcttaacaatgtgagatagtatttcctctggaaaaaaaaaaaagagagtgaaatccattttaccactattgatcagtagagcatttaatgaagaaaatataaggcaaagtatgatttttatgaaaaaggaagtaatcagacttgaattttctaacttgtgctacttggatatcccttggccgttctcataagagaaaccaggtacaggtgggtgcactctgtgtgatttggccttgcttctttgttcttccagattttaccctgttcagtttaagacagagtgtacctttaacagtacttatggaagtactgtgaatgactttttttctaacatatcttaatgctaatggagaaatagcaagtactgatggcatcttagtgcctgctcttttttttttttttttttttttttttgcataacagtgcttaagagccttctggtatctattttggactcctaatgaaatgagaaaggcaattaaaaaaaatcaactgaagataatatgaaatagttttgcttaataacaaacctctcaggtactctacccaaaggtatggagattttaaattatgtttggttattcaagtgtcttgacttactataataccattctattttgattctaataaattataatcctataattcagttcgttgccgttttaatgggacattttactagtaatgttaaaatattcattttatttgtcaaatttcrgggtaatatgtttgagggttcccttctcagaggatacaaaaaagggttacttagattttgagagctatagctctttctcagtgactgtatattataaacaaagaagttttgttacttccctctgaaaggcctttacacctccctgctgtaggtgagaacagtaatttggctgtatctagaacaacccagggacagtgttgcggattttctctttgattggtaccttttgaacamtctttgagcgtggggaatagagaaaaggagggaatatgaataactggaaactgcttccctcaagtaactgagcttcctgaggtggaggagcagagccagtgcatctgcgacttgctggtgtccacaaaccctctgtccccaggcgccttgggggccgcggggctccacagagccgcacactgagcctttgatgggggaagggtttttgagctgtgttttcttccctgcatccccacttccctcctttgtgaccagcagcccggtatggtacagtggggacctttaccttagattttgttatcagtgagatttacctaagtaaactcctggcagctggtgacaaggcagtgtatgtgatgtgtggatttagatggtgctctttgagaatgtggctgtctcaggctcagtcaattgtggcagtcctcctaaatcagtgggattgacttattacatcaggatttggcttgtctttgttagaaccccaacagtctacagagaagggttctcagattctgtggtgcacccctagagctcattcctcatgagctcctcatagactactcaacttcctttaggcttaaaagcagaatgtttaagggaccaaagttcatttccctaacaacatgacaataaggagagttgaaagtagccaaaaagataatgctagtataataacttgatatagtggtttaatgattggcaaagctgtggggtgtctttgaggctgttaagagttatcagaaaaatgatagaattccagatgatggaatattggaaattgttgggacatcgatgtggcatcattctagtgaagaaaatgccaaatatgacctctctcatacatgtatttgatacatatgttttctggtccaaacttcttcatgtgcatggtgaacagaattagaccaggtaatctaagttaccatccagggctgagattttatgaccgaagacttaacagctaaacatggtattctttctgatggtgcgggaaataatagactcactgtcttagttttgctaatgttgcctgyctttaaacttcataatgccttttataatacctctatggtgaattttaaatgagaacagtatttaccaagcatttttctggaatttcaccaagcaaaaatatattgattttattagactttataagactatttataaaagtaggacaactagatatcctctgccttgaagtaaactccagaaaactcttgtctggattgttgcctagcctcatcatttattaactgggtaaacttgggtacgcttttaatgtctgtctccctcagtttcctcatctgtagaatgaggctaataagtgccatttcataggaattgagatgattaaattatatgcacatagagttctcgatagagtgcccggcacagagcgctcagcaaatgatgactgctagtgtctgtctccctctcccactgtttctcatggagatgacagagagctttcttatataccaagctgaggtcatacctttctaggacaggagtttatctacatattctgaatgtcagttaccttataaaggaagttggtttcattatggtggtcctaacattctcttgtaaatgactgattactactactgattacaactactcttgtaaatgactgatcatactagattgactcatttaaacagagtccaacgtagttatcctgaattattgaaacccaaaattgctgaaattaaaactaaaacaatatattatgaaactggtgataatacataattctagcctgcttttttgatacactctagcctgcttataaaataataactttttaccgttctgtttatttctagtttctttaataagatggaggagttggaagtatatatatcttttgaataagcattgatcgattggtggagttgactttttgcagaccagagaatgaggcttggtcatcgtttagagtccttaagtcagtcagcagattgagatgttgggggtgggggtggggagacaggtagtgtcaaaaggcaaagaaacgaaagatttactgtctttaaagaagacagcagtagcttgtctgcacctcccacccccccccccccccccccccccccccccgccctcgcctggctttttccagtgaggaaatggcagcacaagtggttgggcagcatgcttggatgacctggcaggttcccagcctcacctcttcgaagggtgtgtgctacatgttcggggtgagttgggggtggggcgagatttggtgaccatttggtacagaggactggtgggcttgatctctgttgttgtttctctttggattcttagaatagagctttctcaaatgtgtttaaagagagatttggggaaaaaaatgagaagattctctggcccctagatggtagaagaatattctgttcataagagggaacataggatagaaggatgtggaaagctgtgttttttgaagcctatggtcactgccttggtgtggcaggggtgcccacatgggctggagctttctgaagaggaatgtggagatcagattcccctggggttgccagtccctggtgcagcctctcagcagcacctttggagtcatagctttcctccgctgtcccaggaaaaagagtagaagtgtatcttgtcacttggagaaagaagatttttttgtcccattccagcaggtgtagttaaaaataaattttaaaattttaaaaaagaagaggaattctttgaatgaggcactgagcaaggcactggggactcacagggggtcaaagaagacatggtccctgccttgctgagcctgcctgtggggactggaggggaagagatgctaatcaaatggccacagcgcatgcagttgtgaggggcagactgaggccagcgtgggaaaggcaggaacagggcaggaggatcaacagggacctggagattggagaaggtggcccggaagaagagggatttgcatgaccttgcctaccgtccttttgtggttttttggtcacttatctgtcttcactgctaggcagtaccccctaatgatatcagtgatgtacagtgccttccacttcggaggtgctcaggaaatgaagtatgtgttgaatgaatgaatttctagtcttaacctatcttcatctttttttctaagtcaataaatatttgttgagtaattgatgatcaaaaatattgattgattatcactaaatttggttcataattggttgcccatcatagagtatacaaatggtagctaataaaaaggtttttttttttgtttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcttcggcctcccaaagtgctgggattacaggcgtgagccaccgcgcccggccataaaaaggtttttaaacagacgtatcttttgccatgtttcaacaaattttaattaaatttaactggatgtagattatacattcattgtcttccaatgggagaaaaagttcttccatcataattttataaatttattgaacaatgttatttctccactaatttcattttcttaatttaagttttttaaattataaggtaatacacatttgtcatagaaaaattatatataagcgaaaggcagaaaatcttaattcagtgtgtattgatgtatttaaatttttatttcatcatatcaagtgaattcaaagaactttatgatgaaaaattccctgaagagttggatataatctgtgcttaaaaataaaagtcttaaaaattgatttttttccctcaagagctgaacatgtgaaccatgttttgattctgatttatggtcatcaaaactaaattttcaattcaagagatactttgcaatttgtcattctgttcaactgtattatatccacttagaagacgggttgatcagccttctagaaactcgctgtcttgcatgctgctgcttatgagcctgcatttgggggtggaaaggggaaacctcaaggtatttagtgtaaatttttctcctgcctgccatcttttccatctttccaatattcagctttcttctttttgtttatcttctcccatttctcctcactctgtttccttctggggatgtccatcttcttactctctctctgctcccattctctctctgattggtgcagtattgctttgaagaggaagggggtctctataggcctataggatgggccgatggagctgtcttttgcacctctgctttctcaatttttacaaagcacatgtatttgctgaggccatggatccacagtgggcctagggaggatgccacaggctgtcctgcccaggaatttgtcagaccagagatctcttggttatgtgagatagggtcacatttctgaaacttgcaaaattgcatccaccctaaaaggccaaatgtgagagtttgtgactgatctcatccttgcagaaggaaggaaaatgaaaccatcacgtgagttaggtgtgtctgttcctggctaattagtccctgactaattaaaagagatagtccctgactatctcttttaatgtatgcttaaggagtgaagcaaaacaagatccagctggattttagtcagaaaaatttaattgcatggcattatggtttttttatcagaacaagctaggtgcaacttctaaattatattttgtcatttctgatactatagtcatcaaacagggcagagtcactgaattcttccataaatatatttgaaattaataattttgcattatggcaggatgtaaattctttaacatacagtatttagaagagtcatttctatgagcaactttcctttttgtatagttaaatgcctcattgaaggtgattaatatgttcaacttgtttttctttaagtaaaaatcagtctgggtagagaagaatattctttagaaaagtaaatatctgattttgggaaatgtttgtgtcttagaggccatttgtgtgttctaatatatttttttcttcagagcattttgattctttaggttaaatatggccttttgagaattgttttaggaaacacctctccatgtatttatggaaatacttttattttaaaaatgcttattgttaaatgtttgaaaaacatgaaaaacaaaaaaaccttaacgcaaatgtattttgttcctgtgcagagctgttaatgtttcaaagctgtttcacgtactagatgtttctgaattagggattcacataataatgaattctgcttattttggttctccacaaaggtttgttgtatgagcttaaaataagcctgcagctgatttgtgtaacacatattaactgtttgtttagtttaagtgcatgtctgtatctctcatttctgatcaccctggaacatttgcatgctgcacagcagccatcttcttttatactttattaaatatctgtcaattataaatatcaaggttttacattaatgtcaagatagtacatcaaaaattcatggaatatgtgactttttccaagggtatttaatacttaatgcatctgtgtcatttttctttccagagatatcgacaggttttattaagtgtttgttagggagatttcatttttatcaagggactataaagagaagctgcatgctaaatcaattttttaaagccggaatattgttcattttttcatcttcaaacacttataatccataggttttatttaaatttcttcttggtttatttttgttttatgtgagtgatagttcaagacggaactttaataaggatcaaatatgctgactgtagtggtttttaatttccttaagcatagctaccagacccatgcaatatggtaaattcttcaaaatgtcatacttacatatttagcaatattgctcttttttattgaagccgaacaaacaattttagatattaatctttcccaaacgtagtgattattttgtactcggtacaatattactgtgtctcaacatggaatgcctccttttgctggaagagggaaggggaagagtgcgtccctgggttgcctggctctgtagtgcttcaggtctgattatgagccacggcaatggttcatttctccatcttcatatatttattgtgctcaagaaagtaaaaatattaatcacttaaaaaatctggagaaaatccgtggctagtttctccgcctgtatttactgggaggtgtgggctgaggggaggtagcgcttcaggagaccccattgccgctgctgctgggccccccatgcctgagaggccctctcactgtcgtctttctgacagtggcaggcagaagcttctcagggaccctcctcacccatcccatgtgtgtctgtgtcttggaatctacagttacaattggtttggaagctaaaaccaattggctgcagagagtacgttttctgttttaattgtatatttttattttaaaagtgcaagctaggaatgtcttctagtgaaaaggctattgtaatcaacaaaacctttataagcaccactttgcttcattaagtgaggaacgctcagttatcttttgtataacgtatgagcttaaagattttcatctaaggatattttaggaactttccagtaacttcagattaataatttttggaagatgtgttttaacttggtcttcaacagggaaaaaaggtttttttttgtttgtttttaatacattgagcttaaatgaaaattgtttggcatagacatttgtcttatccttgttcaattcttcagaataagtaaaaccatttattttcaaaattaaatattttttaattatgaatatttttgatatttgaatgtctcaagattcttataaaactattatataatagtttttagagacagcagagatttttctttttagaaaccaaatcttagttgggtaaagctgaagtagtagctgtttttgataagcccagtttttggtttacagtaagttgctttaaaggccttgccctgggaaatatcaagaaytctgcgactgtaatctactctcccaagttgccagaaggtggcagtagtgtcacagtaatgagagctctgtggagagagttatttcctttctccgttagtgtcacattttgctttagtgtcactgttaagtgcatgtgtcagtggcagaatcttttttttaaccagatttatgtacagtgtgtacaccctatttcttaagaagataagaactatttctaacagattctgcaaatattatgtaaccatgcagccaaaatgatcttcaaaatctgaagaatgcagtgacacatttttttcttgagtgttttttttttccctaaatgatttcatcaggactgtgagcatggacttatatgttgggtaagaaatgtgtatgaatagcaggaagagaaacattttgaagagttaattttccatctcttgatggagatcacccatgtttggatagttgtgtagggtccaaggctacttaaagaaatttgagagttagaagactcttgaagttatttttagatttagcattttgagatttagcattccagttttgaatattgtcatcttttctgccatttaataagtcagacttcttagtgggggctccaaatttttagacttagagatttagcattggaacttactaactttctacagtttaattctacagtttaaatgaattaaaatacgtaaaaataacaaaaacaacactttcccacttcctagagtatgaaaacaggcaggatgtgcaaagttcccagttgatcgggtaatgcgargtttcattttattgcaagtgaaggaactttagcaaaactaacacttaattggcagccttttgtaatacataatttgcctaaaattgcgcactgagcacaagcttttgttttctaattgatttacggttttagctacttttacctcatcccctactgtcctgcgtagggtgccagcgagtacattacagtgagcgatgataaattacagtgcacttgtgatgccaatgcgtcacgagtgaaaactgcaggctacatggagcttcctgcattaaaagtggtgcggagacccggcttcagcaggatttcatttgtatctcagaaataaccatttgttcatttgatcacttactacaatctgtctatcagactgtaattgaaactgaagatccaaattgtactattacagcttttaatttcttaattgagacaaagtttttaagtgcttgaaaggcctaaagtggaggacgtggtgaagagagaatatgaaatctatataattttctcataaaagtgaagttttagtatttttaccaaatgttcttttgtccaggaaagaagtaaaatttaaatatgctgatctgttttgtcgttatcctatgtgtttgtsaagttattttatagtctcatagacctgcacttctcctgattttccgtgcttgatccgcatttgccgtgtatatgattcatgtgcgaacaagttgattcccatgaaatgacttaagtcggagagaaatgaaagagctttcaaccgattagagtgcctttaatttttccttttgttgacatgggatttgaaccctctcagaaggcctgtgcggtacatcatggcatgaggtgcagagcggggccaggatggacctggcttgggcggctctgcgtttctgcttagatccagtgctcatcgcgtaggcgtgcctgccttttgtaaagtcggtccaccttaaattgtgttttgcgcgttgtctgtgggtrctagtatcgaaatatgaagaagcagatttatggcggctgctgggcacaacaaattaagttgacagtgatgtatgagagcataacagcgcgatgatccctctgtagcgcggctggacgccgcctgcttcatttggctcttgttaggatctgttaggcagctaaataatgaaattctgctgactgatttctgttttccctttttctcttttcacctctgctttctaaaacttctaattcccagacccatcctcatgccaacaaactacccttgaaggattctttcacttacgaggactacaggttggtgtgggctgtgagtgygtctgtgtattgagggtggtttctaagtgaagtgggatcctggaagggagggaagggcttcagtgagaagtgacctgctgtgaccgttaaagcatccaaacagagctcatctttcagaagttatcaggagcagcttggataagtatcagcattttcatagccatgtagaaattgccattracctgtcatggcaggggattagctgaggtagccaaatgctacttgagattaacattagtgttgggtggtcctatggatttttcttttcttatttaaaaaagactatgttagtgtaaaatggggactttttttgaacggagagatttaattcactgcacagtgtaataaaaaagtcacattttacatttcttacaattcayagaggatttctgatcagaaaggagttttatggtttgcttttcaatgaggcttaaaataggtgcagagtcagcatttgggcaaaagagggttgggttggggggtgtcggggagtggattttgtgagtcacgaagatccgggaaggggcctgagccctgcgcaaagccgtccttctggctctgcttcttgggaacagtctgccttaaacactcactcctgcatttcccctggctctttcaaaccctgggtttgtttttaaatgatgatgaaggccaaacattacctttgttacttaggaaaagactttgtacgtttgtaagagatcaaacctaaatttttggttatgttatttcttactgcaattggcttttaaatgttccaaccttaagtcaccatttatcttgttataggtgggcagtctcttctgttatgacgaggcaaaaccaaattcccacagaggatggttcccgcgtgaccctggctctgattcctttatgggatatgtgtraccacaccaacggcctggtaacgacctcttcccctgtgttgtgttgaatctgggaggctgttgttgctaagctttgggagggggctgttattccacctacccatcgtactccccccgttgcctccctccaaaaggaacaaacraaaccgaaccggccactcctccccaccgcccacagatagaagctggtatttttcttttactgcattgactaatactgaaaactgggagcktsaatcttataccattttcaaaagccacagtgaactacatgtgtttgctaagccataattccagcctcaacattcattttcttatcttattgtaccacagactaaaccaaagtttctttttacttattctctttaaaatgctcatttattggggaaaaaaaatcatatttctcattttcccttttgtgtcttcttttctttgctgacactctgtttccagttctgtacctttgattctttcttgtccccggtcccttcccctgatgggctgacgaatccctggccatgtttatgaacctgtgtttgttacttgctttccctggtgctgtggggcgggaggagggggctcatgccttgggctcctcgcccttgactgcaggagtcagctggcatcatcatacctgggaagcctggggaggaggaagttgtattattatggtcccccacagctgggaagaggtggaggcaggctctgtttctccacattcttyggattccgggcagcagcataggtgaagcgctctgtgctctgtgagagggttgtctgataaagatttcctgatattagtaggcagaaataagatacatttcagatcattttgaaatatcatactttatactagtatactgtttgattaggttttatgttcatcttttctctgtcagctttccttgttattagcagtattataaatagaataaagaaatgccgtgaatgattatttcacattgaattccctggaatggccagaacacacgtagtgtgcgccagacactgaagacagaatatcctagtgctaatttgggaaggtctagcaacaagtatgttcttgaatcttaaaagtatttaaattgtggcaagaaagaatagttccatttttataattacattttggccttaatttagatatggttaatttaattagtaatgaatactaaaacataatagcatgttttataacttattttcattaatgaatataattttacattttttgttttgtttttcttcagagttattttaaattgacggtaagcttgaaatttaagaaatcttcaaatagcttttaatatctgactgyagtgtttttcttcttctttttttgaatgagatcatttgttcccaaactcaattgattattagagttctttttaataaaattaaagcaataatgcttggctttactctaaacaaacaaaaagaattaacccaggaacctctgtagcaaggtgagcagtgccctacccccagccccacagtccacctgatggtgttgaggccgccaccaggccaccgtggtccctagcgaagcttccatccattggcacctcacacactcatctgcacattggtttttgtttagcttccatgtaaatgggataaaacaattcctttttccctaccaagtgttaaaaaaaaaagaggttagtttatctcaaaataaagaaattgatgacaaccartgctgtgttttccctaatacgactacatactttttaacctaccacagtcctggcagaaacattgctaacctgtagaaggtttattcaggatgctggtactttgtcttacagtggttatgttcctgacattctgcactctgcactcttgttgaactgtttcccattgtaattataagatctcatgggaaatttactggagtagaatttaagaaattctattttttaacactacaaagttgtttatgatatatattacagttaatgtctttttaaaaataaagtcttgaaatcaaggcttggcttttaagacgagattttcttttttgtgtgtgtctatcctgacgatcatcttcttattgtcagtctaccctgactatcactcagggagtaggtagaatttgtaacccagcaacgctgtctgcttctaacaatatcccaaaaacctgattatggtagtagaaacagaagaatcaagtcagtaacagtaattccaaaccagtgacagcaaggaaatgctaaagaaagtaaggggctggatgaacacctaggctagagattctggtgaatataaactaatttcctagccactcagagaaataaatgtaggaagggttataaggtgtggtactaagctggaagaaacaacacatctttatatcttgcatgatttgttcaaacttaatgtaagcagcaggtttcctttgttgaggatttttcggttgatatgacaaggatacttctaagtgactgttagacagyggtattagttcccatacagagagtatgttggaataatcagtgcttgcatttgaatctgcgactctaccaggtgggatgaaagggcagctggaaattcaggcacaacggagggaagttctttttcagggtccttctgtttgtgtattgaaaaaaaaatctaaaacatttatatttagatgagtcttacagtctcaaaagcccatttttacaatagcagacaagtctctccgaacaacctgtccccccacaccctccgtgcacacaggtctgactcacctctggttccctgctattcttcagacaccagaagattccttcgctcttgctgtcgcctctgcctaagacccyccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgacyggtaaataaatgactgtaaaagccccatgcctaggaaaaaagatcagaaagaaataaaccaaaatgttaacgtgattgtgatcttttttctttgttttttaaaaaatattttccaaattttatttgatgagcctgtattactttatcctccccccccccatgaaatcaatataatacatatttgtggaagaaaatttgaaaaacacagagaagaaaatgtaaatggtcctcactctgtttccatcttagggatgtgtgtgtatgtatatcgtgctcttcctcctatgttacttttaatatgtaaacgaaactagaatacagctgtgcaccaagtgtgccattgagttaccaagccagccacagatgtgagtggtgtgcgctgcaggcaggtggtggctttcagggagcagggctccatggagctgctggaggcttccactccctgctgggttcctcctccagcattgccaacaaactccggctgccacccgctcccctccccygggcacacttgagactcctgtggggctattctcagttccacttgcttttatatatacgtatatatataaatttttttctccctgtgtcttttccactagatgtccctatgggtagggactgagacttttcatgccattttccaagtgcctcgcttagggcctggcatagtatggcactcagtattgtagaagggaagttagctggcagtgtgggaggcaggaagcggcacgtggagctgggcgaggaggaggtggaaggaccctgtccttgcttgacatcgggtggctgcccctggaccagccctggccttcccaacccctcctctcctagtctgggcttcaagtcagacctggtcagcgtctgcagatttctgggcgtaggtggtaatttcctggggctcctgccagaaggcccttgctgagcagtggggtccttacagccttggaaggcccctctgcaggcccaccctgggagggctctgctctgagagagtcctctagaaacctggcttcaggcaagggaggggcgaggcctgtgcttccgcctgcacttctttgcactgagacacacttgataccgtcctagaggaagtgtttggcagtgccacacaaagaagttagacactcagcctccaaacattctgacccttgctgagaaagggctgcagaccggggcaggatcccagcctgtttgcctgtccgggttgctgtggacatgttaaactatttcttgagcttgacgtttgctgagagtgggaaatatctgtaaaatacccttaaacacccataatcctttctccacaatctccctaaattttctcttccttcctctaacctccctcctgtttgtgctgctggcaggtccctgtgtacctgtactgccagcaccctgggagtgcctggactccctcctgggagttcatgatatgggcagcttctcattccactttgttgtcaaggtgatgttttggggtcagaaaagtacatccgatgttgggcaggaacttcatggagttgattttcattcaattgaagtgtttaaaatgttctgcgagtgaaatgttctagaatacttggcttcatttatttctcattgctgcatatttatcactggtctttgcagatcagaagcatgaaggaaatttagacatatggttaataaaccatatttattcttgggatattgagtttaaagattagtgttacatggccttccatcccaaaatgccattccctagactcagaagtcatcttttgaatccaagctattgataccttattagcaaggagcacttgtagctgctgtgaatctttgattctccaggataaaatgagtaggtcaaaaagtaatcagtgaccatcgacagacaacctaagagattgggcgctgctctaaaagacaggactctgagaaggaggttttaatagaagctggggaccctttcctttcccctgsgggttcatgcatcacgtgaatattctcaaagaccacttcaggttttaggttctgtgtgctgagcactcgggacacagagatcaacaaggggctccagcttccaagtgtgaccgacggggaggcaggtgcacagataaygtgacttgggctggagcgcataaggactgggctgtgggagtgcacaggagggcagggtaaggaggggcttccctgagaagccaggccacaacaggagtagaaggtagtgtcaggcaggagggaactgggatggcaggtgggtggcagttcctgaagctggagggaagcgtgagccgcctccttattcggccgtgctcaggaacttggggtttattccgaaggcagagcggaatcataggaagattttgaacaggagagtgacatcgtacaattagcaactccagarggacagtattggattttgagactaggttccaagagttggaaggtttttgcaaataacaagctaggtgagaaggaataaggactatagccatgcagaggaatgaggaagaaagtccaaacagtatttacaagatgaaatgctgaccaggtgagacgcgagggtttccttgtaacttgtgtgctgaggccatgacattggctgaccttcactaagacrggggagcttagaaggagacgcaggtttggggtataatgagaggattttctatatttatttgtaatggacttagaaactctcacattgtatttctcagcagaaagagagggcataaaaaacagcagttattttattttgcctttgcrtgcttgaaagttttaatttctttaattcagagcatatatccataattcagaaatagagcttttcttttccctgattctttatccaatggaacacccacttggatttcttaatggccaaacattagataaagataatacttgcaaatgaatgagaatagtgcagatcgtcagtgaacagaaaggaggcttaggtgcacctgtgggaggcgtggcctgtgggctcactgccctcactgccaccagggaggcccagaggcgattatgttttgttgagtccagcaagtgacaatctatatagtctctttatctaactgtgcttcctttatttcaggtatgtaattttccataatcatctctgatataactagagttaacctcagtgctcaagcagttctttgccccattttccaaagcattcagatgccaccttttgagtaccttgggatcccctttttcctctgattgccaraaacaagcttrtagattaagtgagatgtgcgtgtgtttgcctcaccatcatttccttcctcctccccgggctagatcactactggttacaacctggaagatgaccgctgtgagtgtgtggctctgcaggattttcgggctggagagcaggtgggtctygtggcatctmacaaaatgtgagccagccagtgggcactaacgttaacaccgtgttggtaatcttaaaaaggaacttaacttaggggaaaaaatgtggaattcacattgaggattgtttttctggaacacatcttgagaccagaacccgtagtacacatattcacttgtgctttactcacttgtgctttgcattgtgctttgggtccacagagaaaaagatttaaacacagttagttgcacaattggcctaatatttgtaaatatttgtaacactcttaactgaaaataaagtgtgttatgacactaaacaatgtttaacatttcataaactgttgcctttattttttctactgattagaactttataagagtatttaaggggcaaaagcaagggaatctgttgtcttatactttcattttaatctctgattttttaatctagtagtttgggtgggaggaggggtaagcctttgggtgagtttgaaaatacgtgtctataaattcctacattctatcagtctacacccaagcagacagtacagtcatggaactcacatccataattgacattccagttgagacaaaatgaaaaatacttgcctagcaaagtactgatctgttccttcttcagaaaagtttataaacccacctgccaggtgcaggattaattgccagaggatctagaaataagtttctgacagatactgctttacagttccagaagagaccctgctgtattaaaaggacaggaagaacttggtgaattttaaaatacagtcttatagtaatagccttgctgtcctttggaaggagaagaggtttataatagaggcctggtgaccccaggtcacctggggtcctttgagtactagtaaggcctttggtggtactttctcctggcctcccctctcctctccacacggtggtggaagtgggtgcttggtctcagacagtttggaaagttgggaaaattgcacagcttcacccttgcaacctataccaaacaggtgtatcaatactttcagctatttmgtgtctaaatgtaaagtagcactaagcctctgccctgccctgtgttaagaatacatgccaagyttgtctaatgcccttttcttttttctttactgcatctcagatttacattttttatggcactcgatccaacgcagagtttgtgatccacagtggttttttctttgacaataactcacacgacagagtgaaaataaagcttggagtgagtaaragtgacagactctacgccatgaaggccgaggtcttggctcgtgccggcatccccacgtacgtagaaaaacatcggttggccctttcttgcagtacttgaactatttccagttgcatagtgtttaattggtgtgttaataaaacttctctccagtagtttgtcttaatccgtttatccccgtggcacagcaaatttaagccatggcgacgcttggtggcttaccagcgttttcaggtaaacataattgtgtcgttgggcgcattcacagtcagttctgggggatatggcctgaaatcctcattaagttaaataactactttcgtatcattcatgtctttcaccttgaaaaggttaatggcctggatcaatttgtttcatttaattcgttgctaccattagtttctgtaatgaagtcatgatcctcagtgatttcaagaatttctagttaagttctttaagattttcttgcatttgaggcataaaatgataaagaagacaggaattaggattcattagttctccagggaatagaggaaccattcttaatgaaaatrgattatgcagaccttttttttattgaacttgtcaatatttgattaatgattaaagtgtgaactcaacataaattatkaacactttttaaaaaccatgtgtatgtttaatttttgaatgtattatgtgcaacctragattacagctgttaggctctaggaaaagcttgtgaggatggtctccaattctggatgtccgcttgcctccgccccagcctgcggccttttgcaggggctgaaaatcgtgctcacagttgagatgaggagctggaatgacccattccagctcagctctccttgaggacaaccacacgtgctgtagacttaaggaatctcagtttggagcaagtgggtaaccgcagcagggtgactgatcttgctttctgcttttatcagttccagtgtttttgcattgcattttaccgagccgcccatctctgctcagcttttggcttttctccgagtattctgyatgactgaaggtaagtcatttcaggaaaaaagagawgttgacttttttctttttaaatcatgaaagtgtaaagcatagggattcagattaaaggtaaagtggattaaaactacagtacttttgggaagagagaagatrcaatactggagaaagaagaaatagatttgttttaccctagaaatgttttattaaatcctcgatgtgttgtcagtattaatttgtaatacgcaaataattctcaactgcatttgaagaaaacttaaaacatcttggatagggtaaatatatcaaaattctacatttgtagcctgacagagcctcatttcactcacggggcactagtctttttcacttacatagagcagttcaggatcagttgatgctgtgatgttgtgtagtcagctgtggcatacgtggaccgtaggactttatttgttaacctactctgcattctaaatctgaaattgccagcaagcattttaatgccaagcatcctgttagagtaaataacattgcaaacagaatctgtgtagaacacaaaatgttcctggctacagcctcttatttcatgcccagaaagagttaagtatttgtattgagcatctacttttatattagcttaaaacaagtcatttggggtttcttatgctgagatttgacctctcgtggttgtgtttttatttttcatcctaaaatgtatcttacaaatttcctggccctgaggtttcatttttaagagagagaaagagagagagagagagagagagagagwgtgtgwgtgtgtgtgtgtgtgtgtatgttttgctgttgttaactaccttaaatcctgtacagaacagtctgagtaggaatgagtaaatgagtgtttgagtgagtgaacagacgaacaagtgttctggaaggaagctgcccaagcacttccttggtcggaggaagcagtcatggcccatgtgggggaagctgctgtgctcggcggtcactggctttggttttaatgtctggatccagggagcagtgcagcacaagtccagggyttgacgtcatgctggaggcagaaaaaacctagtcccgaaacaggagaggcagttcacacaccaaccgcagaacccaaactgagatacagtcattgttcctcataagcaaccctgtcgctagatttacggttattcaagtgggagcttttggtgctttttgtacttgggtaatggttcatcaattcaatgtaatgaacacgagttaaggggttaactgtgagcttttcttgcatatatatggatacagaattgaatgttgcagttcatgtactcaaggcatttataattaagagaggtgatggtgatgatattccttgaatttgtgaagcattcactgtgcgccaggcatgatgctacatttggtacatgctcagttttaatcccatcagccttgattgggaagtgctcccattttactgatgtagattccacttcaaagagggtaagtattagctgggcgtggtagcacgtgcctctagtcccagctactcgggaggctgaggtaggaggattgtttgagcctgggaggtgaaggctacagtaagccaaccccagcctgggtgacagagtgagacccaggtgggtggggagtgggggaagagtataaagttggctggatgctgtggctcatgcctgtaatcccagcactttgggaagttggaggattgattgagcctgggaggttgaggctgcagtgagccgtgatcttgctactgcaccctagcctggccaacagagcaagaccctgtctaaaacaaacaaacaaacgaacaaactaacaaaaaacccaaagaggataagtaacttggccgaggttgctcagtaagcaagtgatgaccctgacttagaacccacctctgttaactccggagcccacgtgcaggacatcccacattgctcctgctggttcacagataacatagtacatggaaaaaagtcttagtgctctaggggtctggaggaaatggcattcaagttaaactgtggagctcagcgactgtttggacaaggtagagcaggaggggaggggtatgactgaagacctttagcatagggaggagcttgagcaggagctagggagagagggtggagggcactgggctctgtaccctcyggggtgagcacacactgtggtggccagaatgaggtgcagggataatttgcaggccctgtttgctggaggaaagctcaggagggcacctgctgcaggagctcctggcctgcaggcaggccacatgctacattgtcttactcccctttttgtaggctttatttctccagaaatgtgaaatgagtccagtttcacttttaaaaagtagcggagagaaagctctgccgcacacctgcagcttccatcattgcagagtgcaacttgggcagattgaggaaggagatgagggaaggaaacagtaaccttcatactgggggcctttgaaaagaactttcagccactaagaaagcttaaaaaaacagaacgtccatgttgtatgcaaagaatataaaatgactcaaaactaaaaatcctgaattttatcatgatctttactaacaaataaaagttaataaacttttttgaacattagatagcttgttttcttaaaactgcttgaatccttttaggtctgttgattctctttagttcctctctagtcatagacaatttgtcatgtcaagacaattgctgtatctttgaattactctaactaatactaataaaagtttggtttgctggcagccgcagttcttcagtttgaatcgtaaatagtgacagctgtggggcattttgctctgaaagagacactgtctcctaatcacataagaagcatgggtctgtttcttcagcatgaataggatcggcttgttttggttttggagataatgtgccgggagataaaatgctaagagcagttgctgaattctttcctcttcttaaatatatttggagataattgagatgttcacttgtgtgtatttgtaattcctatttaaattcctgacaagtaagagagatgggcatatttttcattaactgagaattttttttttttttttttgagacagggtctcacttggttgcccaggctggagtgcagtggtgcgatcacagctcactgcagtctccacctcctgggttcaagtcatccatgcacctcagcctcttgagtagctgggactacaggcatgtgccaccatacctggctaattttgtattttttgtagagatggggtttcgccacattgcccaggttggtctcaaacgcctgggctcaagtgatccacctgccttggcttcccaaagtgctgggattacaggcgtgagccactgcgcccggcccattaactaagattttgatagtgctccttatggtagcactgtttgatttaggctcttatttctttcagtttgtggcttgttacgaacgtggcttaaatagcttggtcaggtcatctactagaataagtgccaatcagatttacagttatgggcttgcgggattgttgtggctcttgttcctttcaccgtttacatcgttcacctaaatgtcttttttgacttggtgtgatggagctcatggctagcaaaaggggtattgtcaaaataagggggtacatggctgtagattgtctttaaaaagtatcttgtgaaactgtctaaaggctctcagtgtccctcayagaaacagtgaaaamtggagtgctaccaaggcttgatcaggattccacatggagaggcctgacctggtgttgctccccaaaacttagctctgctctactttggagagtctaggagtggcctggcscattgcrtagggacagcttttaccgtgggaaaatggcgttgttggaaacaatattttctaaggtagattgcttgttcaaatgaggagtgctatgttttcctcctaacagattgccatttgtatttcttgtagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggtaattacactaaataaatgaggttttgaacttgttgtgttgttaagatgtttaatgaggcttggtgcggtggctcacgcctgtwatcccagcactttgggaggtcgaggcggggcggatcacgaggtcagaaattcaagaccagcctggccaacatggtgaaaccccgtctctactaaaaatacagaaattagctgggtgtggtctgtaatcccagctactcaggaggctgaggcaggagaatcgcttgaacccaggaggcggaggttgcagtgagctgagatctcgacactgcactccagcctgggtgacagagcaagactccgtctcaaaaaaaaaaaaaaaaaaaaaaattttaatgaaagatttcttgttaattctaaactactgtaatagtttagcaaaatgattgcatttgaaattttccattcatttcccaaaaaatcatatttaggcattgtttattagaagatacatttttaagattattcaatacttttttataatttataattcacgtgatttcacaaacatgttttcatttgtgctttttaagttcactactgagccactaacttcaaatacatctttctcatttattcgttccttcactgatgccattcacccacgtgctgccctggggctatcagtgcccaagatagacaggatgatttttaaatcagtgaagttccctggcagatggggtagcactgtttgatttaggctgttctttcttgttttgtaacatttccattgagrtataatttacatacaatgaaaggcatacttctgargcgtacgttttgatgtgagtgtctggtcatgcgaccacctgcccagtcaagtgttagaacctcccgtcaccccaaaaagttccctcatgtccccatccccagccrttgtgccctctgtctctatagttttgctggtttagacttcttgtaattaattttgctcttgttttccaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacrgacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtgktggtgtgcagtgtgaggcagctccttggctttcctggttttcacaacaagctagagattttcaaagctacacttttgagtaaaaacccttattaaaagaaaaacatgattaatatttttgtctattcctttttttggagtgggacaggccctgtgagtttagcttttacacaatccatcttactgcccaagcattgttggaaccttgacctcctgccctgggctgtgctaacctgggggctactgagacatagccgtggggcccagaggactgtaggagcccccctcatcagcgtgcccatctatgcaggcagcgggaactcaagaaaaggagtccttaggatttaggggaaggaaaaggttgggaccatgtccttggggtgggagagggatctgtctccttctgccaccagttttcaggtttactgataccagtttttctttaccacaaattttcacattgtctctgatgtcctaagtacaccgctgattttgaaaacgtgaattattcccccaagtgtttgataaatgctgctgcaacacaggtcgtcttaaggatgctctgggagtttctcttggggaagacatagctctgcagatcaattgcctaatcccccctgacagttgagataaatttaactctttaaggcgttgcttgcgttgctcagcaggttagtttacctgctgcactgggcgctggaggcaagcttcatgtctgcgtgaggctgggacatttcctggcgttgacgcctgtacctttcctrgcttgttgatgtataccaggaggaagcatgtgattgccacctctcgtatcagctttacacctgarataccttaccaaaaatattaaatagtctgtaaagcttagtgttaatttctaaaaggcaatagcattgtagtrcttgagtttccgactctagaagccccagagccttctagaactttgatgaccaatttgtccatagaattatcttcttataggattaaaagtttccaagcctaataataaaaaatcttttttgaaaacatatatacagttcaaacataaaataacatcatgagacagctgggttttcaaactattccccggcaaagttcgagttcccgtggagctgggatagcgccagactggrgtcgggatcccaagctcctgttccggcgccacctttaatgggtgttgtgatgtcggttcctgggacccagtttcttcatttacttgtgaaaagaatggtactaaattgtccaaagtccctgcttaaaaatttagcagctgttttttctgtcatttctccattgacagacttggtcrttaaggttattggatcaaaaagagatgaagtatgcttccagttgagaacagcctctgcatgacataaaaatggcgcccacaagaacggaactgttttgatgtcagaagacagtatctattgaacagcattactttcctgagttgggtaggattgccctaaaatgactcgcaaaggcaggcgagaccacagcacacattagtcatcctcgttgccccgctgcggttcggcagctctagtgctgcctgcacagacacttggagctacaacttaagcatttgaaaattgagggaaagtgattaaattggcattgaagaaccctcattgccgtctgtcatgaaaatagacctttctctcaaatcattttaaagtttactttcttctgaatgcttttggataagaggctgttcaggctagttactggaaacatgccaggctctgcttctgtttcattagctctgtgtgttatttgtgtaaatagttagcaattagatttcaccggcctagaaaaacctccctgtttttcatgtaaactggcaattgataggtggtttttccccagtagtttctagaagaggctcactaagagatgtctgtaatttttttttttttgagagatggggtaagacattaaaaatagtcccaggttcccaatatacagagttatgctaaattaaacctccacttaaaaatgagggaatcaattttctgtaaatcatcagttatattttcttttttctttttctttaagacagaatctccctctgtctcccaggcagtgtctcccaggcagtgtctcacagtgcagtggcactgtgtcagctcactgcaacctctatctcctgggttcaagcaattctcctgcctcagcctcctgagtagctgggattaaaggtgcccaccaccacacctggccaattttttttattttttagtctcaccatgttggccagactggtcccgatctcctgacctcaggtgacccacctgcctctgcctcccaaagtgctgggaatataggtgtgagccactgcacccagccaccagttatatttccttggtgattaatacgtacattgtaggagcaaaagaataaagccagtccaatgaaagtgcatgtgacttgagctcagaaccgaaatggcactgactgtgaagaaaatagggaatgatagtggtggttggtttggagggtactttgcggagagcccggatatgacagtgttgacggtaaccctagctgaaatgagcagctgcttctgcaccgtgctcgtgttattattgatctggcaaaacaaatgcgtgtaatgcgggagagctgctaacctgacccaggaatttgactcatttttatttaaatgtcaatttgaggtgggtgtaggataggatccagtaatgtcattaagggtcaccctactattttaatcagcagccccttatctaatatattcctaaaattctgtgtataaattgaatttgaataacttgaattgtatttaaatgcactggcaaatttgttatttaaatgaagctgccctgctggtcctgggtgtgcttgggctggagagaggaagtcttagcagggacatgatcttcctgtcttcacagatttgaagagctgttgcctgaaggaggggtgagactcattctgggtctgcaaaaggcacagctagggccaggggttgggtggcggaattcagccaagggagggagcactccctaacgcctgctgtgagagagcacatgcctgctgctctggaggtgagcaggcgcagccatcggggtgtatggaccactcagacctggttccaggcatgggatcctgggccagttgttaggagcttctgtcacccccttcagggagcctcacactctctacctcagcagtgccgggtgcgttgaaaagctgcgtgccgcgcctgtacctgttaaacagccagtgaatgcttgtgatgaccatcttctaagccggagccactcccaggaagcaggagatgttcctgagactggggatagcaaaatcatccatgctctgccagcaagcggcgtgcgtcatctgtccattgatttgggaacctcagccctggacctagcaacagttgtgttcttagtggaacacagattctgtgggtaattcagactcaagaagccctgcccttgaggcaccgaggcagacgtctgaacggtaggcgtggcagagcataccaggctgtgaacgggtggacccacgtggctgggcttagggctctgtttgtgagatatggaggtggggtgagcccttgagggtaaggagggaggcagggaagaaccagccatgaacaggaggggctgagaagttcaggcttcttggggggaatccagcgaagatgctggtcactggttcctgactgcagtgctggtgccccggtgcctgcagggagagcacgcgtgcagttgtgccactctcgtaatggatggacttcaggagggcgcctcccggtgattgctgctcccttcacagatgccacccttagtagatgccttagaaacaaggtgaaaggactgggaagcccctgtgtgtggactcagtagcagtttatggaggtgggaaccttaactcaggtcatgacaccactgtccatcagctcttggtctttatttaacagcctcgtgataccctctcacttctgggcagcttttcttggcccaaatgcaggcgtatctgtgtgtgcacgcacatgtgtgtcacctatttctgtataaacctacttggtatatatgagcacatacatacacacatatgaatacatatatatgtgtgtgtatagaaaactttccccaaactcatattcttcccccttaggcaacagagaagctcctcaacatgggttaggccaaacttgacaggaaaatgaacgtggaaatgctggtgctggtgaggccctgtgtgtccccacctggctgtttgaattcctagagtcttgtacagcacctggtgcagagtgcgggctctggggaggcttccagactgaccgaacaaccataaccaagtgggaggcccgcgtgcctccgaagtcccagggtggcgttaaaatcacactcctttcttctctctccatttcctcgctctcctctctttgcttcctgtttctgccgcttgtacctgactcctcaagagtgttctggtagaaaaggatcaagttgtggcttgaacctcaaccattcttctccattttaatgaggttccggaggagctccttgtaggatcccagagtcagtttaaagtcctaggaaggcacctggaggatgcgtgagggtgagctccccctgccggctgtgcctctttctgcagggtgtgcagagcttcccaccctcacactccacccgtcattcatgcaaaacttactcttcaagaaggaaccaatgagcagattctcccctcagtgtctagtccatgaagagtgtttgcactttagcccatacacaaaattttagcccagagaagcagctcatcccaaacatgggctttgaaatctgcagaacctgaagtataatccggaccccctaccttcccctatcatctgtgacccccgcgcaagtttcttgatgcgcagggtgttggttttctcatctgcaaaatggaataaccccaggaggttgctgcagtaatagatgtaaatctggcacagtgcctgggacacagtagctatccaatggttggttcccactgtgactggctgagcgatgtcagtcagcccaagatctggactaatggcagactggaggcacattctgagttgcgggggtttctgtgggtggtgaaatattcccctcagccgtgtggcttcaacatgtggacctcctgtccatacccaactgtcacattctccgtgcctttcccagacttggcacgtatctcaaacggaaaatatttggtgacttactttatacatacatatatatatttcattatgagctaccatccagcaagcacctgtgaatttcttggctttaagttttcaagcaactctaaacaaaccctcccctaaatgcatctgcaaatgacaacttattgagcagcaagagatggcagttacgattgtgtgccaccccaaccagcctagttttggaaataataaccctagctggcaccaggaaataatacgctagcaccggaagatgttgtcaggtgaatcctgaaatgcgtctagaaaaacagttcttgctttctcatacaaaaattaaaatgtttgttttattttggtcatcgacaattgtcaaaacaactagcattgggctaatgttatctaatataagtgttgacaccattaaggctgcagtataattagtcaggaaatgtagtcataacactccttggattttcaaaggaccagaatgggtgtttttgaaaagttgtatcgggggaaaaaggaaaaaggaattgtatttcctgctctgtgcttgcgtgatgagtatcagcctagatcagactcagggtggttaataacctccttcccttcttacagccctgctcttaaaaagcaggtgctacgacagaaaccccgacacactgcaggctgtcaccaaggtggtgctttacataaaagcgctttacagtgttattttgcaagacttgagccctgagtggatactgagtgtggagcagcctggttttgtacatttttgccacatgttgagatgccatgggagctggtgactcacgcgccactgacgttcacaaaagctcccggctcggagcagagcattgaagggaagggtctggctgcttggcgtatgttaaccaggctgggtactgagcgtcttaaaagccaagccacgtttgcctttcaactttactttgtggtgacgaaagaggaggtctctttcttcaggggcttactcagcgctgctggatctgaagatgcccgggaggagggtgaggggtgaaaagggcatcctaaggcaggatgggacacagcggcctctccagcttaactcagtattctctgaggcacagaatactggagatctgagacccctgaggtgcaagccctcccctcaaggatctaagcaggcggtgggctgccgctggcttctccccacagctggtggggggcagaagccctgttccacaggcgacaagtgtgggtcccagccatcatgtttagccaatggtcttgtccgtgttttctccccaaaaacgctttgagttagtgatgacgtccactgattcacccagcacttacttgagcatctcatgcgctgggcaccacactaggctctggggccaaatgacacagggtgcttgtcggcgaggagcttgtggaggaacaggatggcctcctgggccgagctgtgtccaagctagctcttaatatatgctccactttcctaatcttaatggaaaataggctggatggacttttaatctccactttatacaaaattgtggattacctgtatgttcttagtctgacttatttttttcccctcgtaggggttcatttctgttaccaaacaacagagaagttgagtgtctgattttcccccaacaatgcaagtacttgaaagctcgcctcaggaagctaggatcaccttcatgtttgtagatactacatttccagttttctaacatcctgagatctcccaaatgagtgatgcagttacaagaggggacctaggcatcatagctttggggtgacccataagtgacagtgaagtccctgtttcctttgctgcaactgaagcctgttatgatattggtgtacggaactagtcccgcttcccagtactggtttgcaaacatctatttttaaagtgatgacattttaaaaaccacctcttattcccatttggggttcagttgactgtcagcagtaaccgagaaaaatcacgccagccacacgtacttcagtatcttaaatgggcagttcacaaggcagttggaggatctgtgttcattgatgggccacatctgagtgtagaatcttatgtttctgtttcattcctgtgacaagttttgttgactgccccagctgcctgtggccaaagcagctaggatctttgttcatgaacattttaatgtttagaaatccaaatgaaaaataaacctccctaaaacaaacaaaatgactcccataggcttcaaataatcctccaggctatctctaaggaagccaggatttccagcagcaattaaattgcatgattggatacagggaaaatgttataattgctcacaggtagcaatttattaggatagatgttacttatgacatgtgtcaaaaaggtcaaagtttatacttccttggacattaacctaaccttcgaaac

SEQ ID NO: 12556 - DNA, 29685 bp, Homo sapiens
ttcatgagtctattcccttgtctgtgaaatgggattattaggctgccatgagacttgactacttaggaagtcagtgcttctgtgtggtttgtgtgtgggtgggtggtggtggtgttccgggtatggatggagcccggcagtgcaggtggcatagaggatggggcgggtgggattcacagcagctgccctgctgggtgttcactggcatactggtgcgttgatcatcctggactagtccctacccatctccctgcctccctgtggctctgtatcgcccaaagtgtcacctgaccaataggaaggggcctctcagcaacccctaggcctcagagcagccagagccccacctacccctccacgggtctttctcaggcacagagctctgccttttgctctgctggggactgctgcctccttgcgatggagatcgcaggggagagtgaatcccggtggtcagccactagctgagcccctctgtgtgcagaaccaggatgccagacaagggcacctgctccagtctgaagggagagacctggcttctgctcctggaaaccaccagtctgagggcggacacatagtcctggctcattgggataggagggaaccaggtcatgccttagaggactctatgactattaggggacctagcccatggctgcagagtgctttcaatctaagccagaagcagcccctgccctggggaagcctcccatctagcagggtagatacagttgctgtcctcaggaatttgccaatctgataggagaggcacaactctggccttgggagggtcccagaacatggagctgctgatctgccagcaaagacacagtccttgcctccaggtgtccccactgataagggagacagtccgggtgagaggccacaggtctcattaatgagaggtggaggcccagacatcactactaccgattccagctcacagatgtcagcccaaacccactaagctgacccatgggagggccctcactgagcaaagcagaaggagctagacaacctgggcaagttttttaacctctctgggccccagtttcctctcttgtaaaatgttagctgtcatgaggattggggagtaaaagttgtttttttttttttttttaattattaagatggaatctcgttctgttgcccaggctggagtgcaatggcacgatctcggctcactgcaacttctgcctcacgggctcaagtgattcttctgccttagcctcccaagcagctgggattacaggcatgcaccaccatgcctggctattttgatttgttttgtttttgttttttgagacagagtcttgctctgtcaccaggctggagtgcagtggcgcgatcttggctcactgaaaccaggaggctcattgcctcctgggttcaagcaattcttctgcctcagcctcccgagtagctgggactacaggtgcacaccaccacgcccggctaatttttgcatttttagtacagacagagtttcaccgtgttgattaggatgttctcgatctcttgacctcgtgacctgctcgctttggcctcccaaagtgttttttgttttggtttttttgagacagatttttgctcttgttgcccaggctggagtgcgatggcacaatctcagctaactgcaacctccgcctcccaggttcaagcgattctcctgcctcagccttccgagtaactgggattacaggctcccaccaccatgcccggctaatttttgtatttttagtagagacggggttttaccaccttggccaggctggtctcgaactcctgacctcatgatccgcctgcctctgtctcccaaagtgctgggattacaggcgtgagccaccgcacccggctggggagtaaatgtttataaagtaaatgggacacagaagggtgaaataaacagtagttgttactatgggaaggggagacagagggagtaaggtggcaggcatgggtgtggtgggggccagggagtttcctggaagcatttgtgcatctgtgcctgggtgtgcaaaggggcaggcgcaggtggctgcgtcctctgtcctcagtggggtgatcgatggcagggcaggactgtcctaggccagcctggaggggaccattgtcctggcaaatgaggtttggcttccctgcaggggcagctccatctgcttttattgtttccgacagcagccttgggattttcaacccaccccagacctcacaccttaaaaacctgtacaggggctttgcgggagttcatcagaggccccacccattcaaaggcctccagcttccagcattccccgctcacctgctgaactcgagtcctacctcctgctagattataggtacttgtggcccctcttcctcctctcctaggcaatttgtgggtgggggaagcaaccctcagcctccatattcctcaaacttcattatcttggtacctagaccatttagctctgtgtttgtttgggtatcatctactgttctaggttctaggcccagagctttataggcattatttaacttgaccctttgaagtatatatatatatatatatttttttttttgagacagaatctcactctgttgcccaggctggagtgcagtggtgcaatctcagctcactgcagcctctgctccctgcaacctgtgcctcctgggttcaagtgattctactacctcagcctcccaagtagctgggattataggcgtgcaccacacttcccagctaatttttgtatcttttttttttagtagagatagggttgcaccatgttggccaggctggtctcgaacccctggcctcaagtgagctagctgcctcggcctcccaaagtgctgggattataggcataagccactgcacctggcctgaagtggataatatttttcagatggtaatagcaacaatggctgtgtaggaacattaagacaatgaccaagggacttgcctaagatagcctagtagagcaagtgatagagctgggattcgaacccacagccatctgactcctcagactcatcatccctgctccatcacattcctggccgagactgctcctcatgctgccatccagtaaccaacaccagtgcagctgctgtgagtcccagggaaggtggcatgagctggggcctgacccagagcctggtacacctgaaaaccattaagtcctgcaatgagctccttccagttgctctgggttctagcaggagcctcatccctcataaccaccccttcaaccccatcccatcaagagaagtcttggtgttggggcatgggtgggtcatggtgttggggcatggggcgttgtcaagctggaacctggggtggcagagcctctactggcaaggattcagccatcctcccacaaccttcttcttcttggggaccactggccacagcgactcacccctgagaaggaaggctggagtagggcatgcagagagggccagcggagcaagagggaggcagctccaacccactgggccagaacaggggtgctcctatgacctgccccccaggaacatgctcatgcctctgagggaagttcggggaggctgggatgcaagtccctgctccatcacattcctggccgacacacgtgaaggaactccctctgggtcccacagctgctaagtgatcagctgggcttcaaacccaatctgcacggctggggtgagccacttcgttctctggtctcagtttctacccctataacaggcacagagaccaccctcattttccagagtgatacagggcctcagtatcacaggggtttccgggcagcttgctccccctccaacctccccagccagagggccagctccgccctggccccaccagcaggacccagcagaactcagcaagacactggggcttgcagttttcagttcattcctgtgcctttgaccaggaatcacattcaatataacaggtgtgcacagagcccctactgcgtgccaggcactgggaccacaagcagaaggagacccagcccccacccagggaggagcagacccctcccagatagggattatgccgtgcagttcacaagagctagggaggcaagggagtgccggggtgcttcccacaggagaggacatcagacctccttggtcagcaaagacagagggctgagatcaaacacagggcagggcagaaagagccctagcaaaagctcagaggagggcagactgtggagatggtcagttctccatcgtggctgcaacctgggacgcagaggggacaatgctgggaggcaggcaggacagggctaggctgggctgaggtctctgtagttaactgagtggccacagtgagccactgaggactatggactgggagggcgatgaattgaatagtggggaggaaggcagcggagagagcagagaggacctgagcaaggttcccgagcctctgagctggctttgctgcagaaggcagggggtagagatggtatgaagggccgggttcaccaaagtagggcctgtctgccaggtcggatttcgagcaggagcctggatgggggatgtcgtggggatatccagccgttcttgcctctaaagagaaaggttccagttgccagccctggctgtggctgaaataagaactcagccaggggagcctggaacctgccagctgggaggtttccctcttctgaagttgccctcattaagacactcaggccacgtcactgccagactcctggagtggtgtgtcacatgttatgaccacctagacagtggtcagggggcttgggcaagcacacagcaggtccaggagccagcaagacaatcccctcagaggaaaggaagtggcctgtgagctggtgccgctattaaaggcatcaagccaagactgaggttcagaattgggggtgagtcaccggacgccttctgatgggtgatcagttgttggcaacaccagctcagccacactgatctcattttgaaaaaaagtgacccattggccctgattgttttagctgattttaggacaagcaaagaggaggagagagagaaagagaagagtgcttgcaagggtgtggacgcctgtatgggcacgaggaggtgaaggtgacaggaagtgtgatgggggaagaggctgtggtggtggggttactctgaagtgtctctaagccttgactttgagatccatttctgtggagccccctgtccccaccccatcccaggtctgtagactcccctcccctcccctcccttcctccacagggtgtgtgaaccagcaccaagcggcaccccacaatttccacacacatccctataggtagggactagcaccatccctgttttgtgacaggaacactgaggctcagagaggtgcattcctttgtccgagatcactcccagagccccagtgtacccgactccagatgcatagtactgaaccggttccagacaccagtgtgtcactgggctgggaggtgggcagcgtggagggagcatatagggcaggggagaccaccgggcggagaggatggcccagggagcacccagctgaggaaagcaagaaagacttggcgggaaaccccagccctctctcatctcataccccggccccgaaggcggctgagacccttgacgagcggacggagaaaagccaaaagccggcggtggggagcaggagggacagagcgggagaccacaggcgaaagaccagcgccgtcgggggagccaggctgagtaccttcctgggcacagatgggacggcgcggggccaccggcggtgctggttccgggcgcactcagcgaccccggccacacaccccagcctcctgggcggcctcgaaaggggctggagggcacgcccgccagctctgcccggggctcagggagtcttcgaagacttcttccaacggtggcggactggggccccctgcctgagagaccacccggagactcagagacagagagacaaagggagactgggtcagggagagagaaggctagtgccgaggagagtaggtgcgagccgggaccccagagggcggcgagggcgcgcgcgaggccgagtgtcagagcgtggaaaagtgggcgtccagcggtaggtggacggatggggagcccgggagcagagccagggtccgtgggcagacgcggcgaggagaggaggcggcggaaggactggcggatagacgggtccgagggctgggaaggaggcagcatcctcacttycagcctcgggaccccgcgcaccccgcccctgggcgcgccaggtagcccacctttgtccgggctcgcagccaggtggggcgggaggggcggagccaggggcgggccgaggccgtgccttacctgtccggccggcgggtagggggaggaggggctcggggccgagcgcccgcgggagccgagcgcagccgagggcgagccgcggaacggggccggcgtggagaggtgcgcgggcagccggaggatgtgcccgggctgagcgggactggaaggaagggggagtgggcgggcaggagggaagggggcgggagcgcggggaggggacagaggaggggcggcgggtggcgggctcgactgcccccagccgaggggcagccccggggccgggcccsgcgcgcacccggccagcgcgccctcgccagctgcgctctgagttctgggccagctccccagaggcctaggcgccgccgccgcgagggcgcggggcagacaaaggaggcagacaaaggcgggcgcagcccagcagccgtgcgggcaccgggcgaggcaggcccactcctcccggtgcgtaagagccgcctcggcgcggcccagggcgcgtgggacgggaggggctccggcagttgtggcgcctctggagcggccccgcgcagggcgggcgacaaagggccgcggcgggcggtcctcggtggaccccaacaatggagcgaggctgcgcgctcagctgcggccgcgtctgtcmgggcaggggcccggggccacaaaaggattattccgcctagactgtcaaaagggacggaagaaatgcccagggcgggggaggcgggacggggaacggcggggcctttgtagccgcagaaagtgcgcagagtgggcaggcggggttctccgagaggtcgctcctggatgtaggggtacaaagggtcttcaaagtgctaccagctcacctggggcgctgacggcgcacctgtgccctctttcccggtagggaagggagaaagacaaccgccccaatacacacacacacaaacacacacacacacacactcacacgcggcgcggctctcgccacgccccgtccaaagccggcctgaagcttctcagaccggcccaacccggacaaagccagcgctggggccggctcatccatcaccgcgcggggcgccgtgtcctgacgaccctgggagtctgagaatgctgggttatgggtcccgtgcctcccataactcacgacggggtcggtggggccacggacgctgcaaagatcaaagagygatggggccggactcccatatgtgggaagcagcgctcccacctggcgccctgagctcgccaggtggcttccatttcgactgttttctttctccagcgtgtggcaaattatgactttgaggttttagaacacagttctgccgtcaggctaaatgtctgtgttcctcttctgatgccgtcccctatgacctcgagcaagtcgcctgacctctgagctcatgattatacctaaatttcagtgttctaggcgtgaatgcagtgccctgtgtaaggagataacgtttctaaggtctggcccataggaaatgctcctgtaaaattagctgccattgttaccgtgatattattagcttggtgggcaccaggatggattgatgagaacactgaactgtttattcactgaaaggtttgagtcatccatcccataaatacctattgaayacctactatgtgccggcaccggaggtacagtagtaaacaacatggacaagaatccctgcccccatggagctcagattctagtgaaggagacagaagataagtgaacaaataaatataaatgatgtcaggtggtgattagtgctatgaagaaaagtaaagcacattacagacaaagcatgaagggacgaggtgttgttttacataaagttattaggaaaggcctctttgctggggcagttcttttggcaaagaaaaggaggtaatgagccacgtggttgtggggagaagacttgcaagcagaagagccactgcaaaggtcctggagcgggagtgtgcttggtgtgtttggtggagaagagtcagkctggaacagagtgaggtgacatcagacagggagctgggataggaccatrttgttacaggaaaggggtcctgacccagacctcaggagagggttcttggatctcgcacaagaaataattcagggcgagtccatagagtaaaaagtttattaagacagtagaggaataaaaagaatgactactccatagacrgcacagcaccaagggttgctggttgcccatttttatggttatttcctgatgatgtgctaaacaaagggtggattattcatgcttctcccctccccccgccttttgtttttctttttgagagggagtcttgctctcacccaggctggagtgcagtggcacaatctcagctcactgcaacctccacctcccgggttcaagcaattctcctgcctcagcctcccgagtagctgggattacaggtgcacaccaccatgcccgctaactttgtgttttcagtagagatggggtttcaccatgttggccaggccggtcttgaactcctgacctcaggtgatccacctgtctcagcctcccaaagtgctgggattacaggctcgagctacagcacccagcctttttttttttttttttttttgagacagagtctcactttgttgcccaggcttgtatagtggcacartctcggctcactgcaacttctgcctcccaggttcaagcgattcatgcctcagcctcccagttagctggggttacaggcacacaccgccatgctcagctaattttttgtatttttagtagagacagggtttcgccatgttgcccaggcgggtctcgaactcctgaccccaggcaatctgcctgccttggcctcccaaagtgctagggttacaggggtaagccagtgtgcctggcctttgcttcccctttttagaccatatagggtaacgtcctgatgttgccatggcatttgtaaactgccatggcactggtgggagtggagcagtgaggatgaccagaggttggtctcgtggccatcttgcttttggtgggttttgacaggcttccttactgcaaactgttttatcagcaaggtctttatgacctgtatcttgtgctgatctcctgtctcatactgtgacttagaatgccttagccatctgggaatatggcccagcaagtcccaaccccatttgacccagcccctactcaagatggggttgctctggttcagacacctctaacaatgtgagcctgcaaaggccacagggaggacttgagctttttagagggaccatgagcagagcagagacatgatccgacttaggtttttagcaggtttgctgattgctttttctttttttttttgagatgcagtcttgctctgttgtccaggctggagtgcagtggcgcgatcttggctcactgcaacctctgcctcccaagttcaagcgattcgcctgcctcagcttcctgagtagctgtgactrcaggcacctgccaccatgcctggctaattttttgtatttttagtagagacagagtttccccatgttagccaggatggtctcgatatcctgacctcaggtgattcgccagcctcggcctcccaaagttctgggattacaggcatgagccaccgtgcccggccacgtgtgctgattcctaaggttgggagtagtctgcagtgggacaagggtgaaagcaagagaccagctaagtactgtggcagagaagagatgatggtcacctgggcctgggagagggggcagtgtgcagccagcatgatttgcgtcgccaaggatagagctgtgggccagtattcatgagccaggagaaaaaccttggagtctctggttcaaatgctgctactgtggctgtcccctggctgggtgatcttccgatgtgcttggagctggggtgacacaatatgaaaaggtggatgttaggagaggcctggactcctatcccatccagtttatgatgactttagggcctcagtttccttgtctgtaaaatgaggtacttgaggggccaaagcaggctccaatattcatcaactgatgactggataagcagatgtggtctatccatacacgggagtattttggttctacgaaggaatgaagtatcaatatgtgattcgacctggatgaatcttgaaaacattatgctaagtggaacaagccagacataaaagaccatattttgtacaattacttttatatggaatgttccgtattggcaagtccaggtcaggcgcagtggctcatgcctgtaatcctagcactttgagagggtgaggcaggaggacctcttgaagccaggagttggagaccagcctggcaacatagtgagaccccttctctacagaaaattttaaaaattagtctgggcgtggtggctcatgcctgtcatcccaacactttgggaggccaaggtaggtgggtcacctgaggtcaggagttcgagaccagcctggccaatatggcaaaacctcatgtctactaaaaatttaaaaattagccaagcgtgatggaggtcgcctgtagtcccagctactcgggaggctgaggcaggagaatcgcttgaatcggggaggcagagatttcattgagccgagattgcaccaccgccctccagcctggstggcagagagagactccgtctcaaaaaagaaataaatgaaataaaaattagctgggtgtgatggtgcacacctgtagccccagctattggggaggctgaggtgggaggatcgcttgagcccaggaggttgaggcttcagtgagctgtgattgcgtcactgcactccagcctagatgacagagtgagaccctgtctccaaaaaataaaataaaaaaataaaaaarttggacaatccatagaacagaaagtagattagtagttttggaactgatgtacctggcaacacactttgggcatgaacaacccttctcaagacatcaggagtgatgaaaatgttccgaattagagagtagcgatgtacaacattgtaactatactaaaaatcactgaattgtacccagggaaaatgtgaactttatggtttgtgaattatatctccacagagaagttttttttttttttttttttttttaaagtggcagttgagctggatcaaaagttcttaccttgtggcccaggatggcttctgaatatatctggacactcctgatgttgtgtaaggcatttagtgtctctgggccgggcgcagtggctcaagcctgtaatcccaacactttggcaggtggaggcgggcacatcacttggggtcaggagttcgaggccagcctggccaacatggcgaaaccccgtctgtactaaaagtacaaaaaaattagctaggcgcggtggcttatgccagtaatcccagagctttgggaggctgaagcaggaactctggaggccaaatgttcaagaccagcctgggtaacacagcgagaccctgtctctatgaaaaargagcagatgatcagtaaggtccccctgaccactgaggggtcagcaacactgggaatcagtagaaccccacggagggaatggcaggtgagggctttgctctggctgaagtgtcggaagccatctcaggtcagcagtgaaccctgggatctgggacagctgtccaggtcaggcctcacaccagaaggcagatgagagcggagaggagctgtcagcaggaagtccttgtctttaggcatcttgttccgtgatgatgcgtgtcctccctagggcaccttgggagttgcctgctgccttgggaaatggaaatggagctatggggatgccgctaaggatggtttggatggggttttgaaaagtgtgacagcttgtccagagggtttgttctgggggcttaaatagtgtatatagaccttaatatcattgtcataacagtcattaattgagcatttatgtgccaggcattgtgcactttatttatttgtttattttttgagacagggtctcactttataacccaggttggagtgcagtggtacaaacatggctcactgcagcgttgatttcctgggctcaagtgatcctcccacctcagccccctaagtagctgggaatacaggtgcacgccaccatgctcagctaatttttatattttttgtagagtttttgccatgttgcccaggctggtctcgaagtcctgagctcaagtggtccgtccaccttggcctcccaaaaagctgggattataggcgtgagccaccatgcctggcattgtgcactttatattttttataaacatgaacatggacataaacatttgctctttgctcaatcctatgaaattagaactaccattatgccattttacagatgagcaaactgaggttcagagaaagaagggcctcgcagctggttaaggggcagtgttggggagagaagcagcaggttggacacatgagcaggcccagtgggtgctggggacaccatagggaacatgccacagcccttgcttttgtttttgaaaatagcttttctctgcatagygccacccatagcccgggcactgaagtcgacgtgttttgctcctcatccagactcagttgggattcaagtcaggcaagtggtaatgagccactgtccaccatcacttcattcctctgycattcattctttcattcactcatttgacacacatttgctgagaacctgaattcgggctgggcatggtggctcaagcctgtaatctcagcattttgcgagggtgagaggcaggaggatcacttgagcccaggagttcgagaccagcctaggcaacatggggagaccctgcctctgcaaaaaatttgaaaaatcagccaggtgtggtggtgcacacctgtaatcctagctactcaagaggctgaggtaggaggatcccttgagcccaggagtttcaggctgcagtgagctatgattgccccactgcactctagcctgggtgacaaggagagaccctgtctctgggaaaaaaaaaaaagagagagagagagagaacctgaatttggccaggcactatattgaaataatgaatgagggctgggtccctgccccggagcattgcaactggatgggcccctgagcgtcaggatatcaggagattgtcaccaggctatgtgtgtctcactctgtatgtcccccatacccatgtgattggtgtcctgggaaycttaggcagggtgggagagctgattcattctgccatcagcctggtggggatgggaggggtcttggaatcatttctggggtctggaaacttcattgcccggttcactcactgtgggtttgttccataaaccccagcagtcctcctctgcccgagcaggtcttcctctttgctgggctggtgctcacagctcaccttctcagtttccatttcagtgtctcttgggagtgattttccctccgtccccatcagagatcctcagggacctgctctagttggcaaataaactcttgctccccctaaacacccatccttccttcccagccgccctcctacatattgtcattatggtgaaaaatatgcaaataactttgaacaacagtctcccagcagacggatgttcaaaaatgtaataaattaaccccataatgtaatctggatcccacaaccatccatcatgctgatgcgattaagatatgcaaaaccagatgctgaagagcgcatggatggagtgttggcagagctccccggatgggcccatgctgactcggccccctgcccctgcccccgcccccatggaacctgaggccatcagaggtttagggaacatctatctggcctgttcatttcactaatgagactgaagccttttaggggtttggggtcagatgggtttgaatccctccccatctgcttcctaacccaccttccttctgtttgtgattggatctgaacccaaggccccaaacccagactttttttgtttttttgagatggagttctcgctcttgttgcccaggctggagtgcaatggtgcgatcttggctcaccacaacctccgcctcccgggttcaagtgactgtcctgcctcagcctcctgagtagctgggattacaggcatgcgccaccacacctggctaattttgtatttttagtagagatggggtttctccatgttggtcaggttgatctcaaactcctgacctcaggtgatccaccagcctcagcctcccaaagtgctgggattacaggcgtgagccacccaccgtgcccagctgacgtttttttttaattgcaataatttttggttacatgggtaagttatttagtggtgactgctgagattttggtgcatccatcacctcagcagtgtacactgtacccagtatgtagtcttttgtccctcaccttcccacccttccctcaccttcccacccttccttcccccmgagtccccaaagtccaatatatcattcctatgcctttgcatcctcataggttaactcccacttacaagtgagaacatatgatatttgcaaacccagatatttttatccacaggtttctagttgacagggtgggtactccagtgtcaagagctgttgggacctcagtttccccaaggaaaaatgacagttgagtttatgtcctccaaggtttttctgacgttcttagctctgtgtgtcaggagttctacgggtggctcgtattgtgttttctcagggcagagggctggggctgggagctcatggagggagggcctgacttgagccccaatgcccctcacactgtgtcctgaaggccatcccacaggagtcacttggctctcagtttccccaccccaggccccagtctgaagggctcctttgcaaggagttgccccctatgactgccaytgcctgtcaccaatgcaaaagctgcttaagcagcctccagagagggaaaggaaagacccttgcttttcccaagttctgcaatgagtcagtctcaaggagccacggaactctgtgtataagccagtgagttgcttggccagctctgtgtggaaatggcatgatgtgtgcaggatccccatatcttgagaatggttgctgtgcccagaatgtgctgccaagtgcaccagttcctaaaacaaaatcatccatccctttggatggatgattttacatcacaattttacaaaatgcatcgcatttttacaaaatgaagatattctctgggaacagtccaaacctctgtggtgattcccacactttgctgggcatccgggcccctggggagcttgttaaagggccagtgccctgctgtgcaccccacctcgatcaggttgctctaggcagcagggcagctgtgattaatgggctcctgggggattctgatgcagatttcctaggactgcatttgaagaaatgttttgctgacattcctagcttaatgggttacttacaggttactttttctctccccattagaagtctggaaatgcaggtttgaaggcatcagggggcggggggagggatccaggtcttctataatgagctgtaaacgataaacaagtctggctagatctgtgtccaaacagacggatgggactaacaagctcttacgtccctggaggtcacagacaaagtcctcttggcttctggtcctgacttgttgcccactaactccgtagctgcttctcagatcttagttttctcacttgtaaaataagggggctgtaaataagtggaagccctggtgtcagaagaggcatcagagctgggtttgtattcccactgtgtgattttggcgaattagagaacgtttctgggcctgttwaaccatctgtaaagtggggctataaaatggagacttagctgctagggttaatgagagaattaacggaatcagtgtttgacacataagaagtgctcgatgttagtcattattttttattattttartaatatcatctctgagggcccttacaggacttccagacmgagtccacgcccctgggggacttgggagcagtaaaatgtagtggcaggaggcacctcggccatcgcccaccccaccagctgggagactcgggcaggttattcacccttctgcacctcgcttgacttatctgtataaagagaacagtcacagtaactgcctcatggagttactcccaggactgagataatccacggacacacttagcccagtgcccagcactcggctggagctccaaaawggtcagctattgttatgaagcgtagggcggggagggttcatcctcttgggcggtcaggccaggctgcatttaggtacccggtsggggcggagcaggggcgacgccsgtgcacgccctcttttttttatttttaaaatttcacccgggccttgacaaccggtacaaycctgtcctcccctgttcccgcccccgagccagaggattcrcttttgcgtgggcagctgcagggatggtgactcgggctagctcagatgtggctgccgttagtccccagctgcgcgctcccccgkccctccccagccctcttccggcgcctgctaaagcgagagaaatgccctcgggggaagatatgtagcgatccaatggaacgtggagatcaacgttgtgttttcttcgcgcccacccgaagttgaagggaggtggcgcggcgggtctcagcccctcccggacgccgaggcccggcccccgcccctcggagacccgcccccgcakgcggaaccgccctctgcgaggcycggtttgggccgtgcgggaatgggcgtggcctgggcggggcgggcgctaggacccaccggagcgccgtgaacgtcaccgagcggcgccgaggccccgggttgagcgggaggcgcgatcggtccggtcggtggctccccgcggcggggccgggcccgatctcgggcgggaaccgagcgcagagccggtactgggggaggggagagggggcgggattcccgccgggagggatccggcgtagcagggggcggagtcttattccaaccccgcttcgctttccgcatgtcccgctttgcgctcccggccctgggcatcccgctgtttccctctgcgtccgcggccctgcccttttcgggggcacagctgtggtctttycaccccgcgagacagcggggcgagggggcgcgggcggccagtggatagaggctgatgcccccaagcacggacgccagcgtgggggtggaggttctkccagctgccctgagcctgtgcgaagcgggaggtccttccccagttcccacagactgtggggagggaagagackgtggaagcgagcgggttctgggctcctgggtctctggaactaccctctgcccttgycccaacactcaggtagcgggaaggatgaccacgctcacacgacaagacctcaactttggccaaggtagggaggctggacctgcgggcccgggggcgggggcgtctgggccggcgggcttcctcsagcgcgccaccggcttgtgccccmctgcagtggtggccgatgtgctctgcgagttcctggaggtggctgtgcatctcatcctctacgtgcgcgaggtctaccccgtgggcatcttccagaaacgcaagaagtacaacgtgccggtccaggtgaggcacgtcccagaaccacagagtgggtacagggtggacttttaaaaaytctttggtcgggcgccgtggctcacgcctgtaatcctagcactttgggaggccgaggcgggcggatcacctgaggtcaggagttcgagaccagcctgacaaacatggtgaaaccccgtctctactaaaaatacaaaaattagccgggcgtggtggccaaggcctgtaatcccagctactcaggaggctgaggcaggagaatcccttgaacccaggaggcggaggttgcagtgagccgaaattgtgccactgcattccagcctgggtgacaagagcgaaactccgtctcaaaaaaaaaaaaaaaaaaaaaaaaaaacctcttccacttcgggccaagccacctcattccgcagggccctgcccatgccttccaatgccttccagttccaaagtggtgatgcctacccacccctcagaagagagttccccttgccagaagttagggaccaggcctgataagagttaccccgggggtggccgggcatggtggctcacacctgtaatcccagcactttgggaggctgaggcgggcgaatcacaaggtcaggagttcaagaaaccagcctgaccaacatgatgagatcctgtctctactaaaaatacaaaaattagcctggtgtggtggtacgcgcctgtaatcccagttactagggaggctgaggcaggagactcgcttgaacccgggatgcagaggttgaagtaagcccagatcgtgccactgcactccagcctgggcgacagagcaagactatgtctccaaaaaaaaaagttaccctgggggcatggtggcactttgaaggagctcgtgaagctggtgaaccttggtgtgaggagggtatttccaaaaacctccaaatcttctccctaccatttatcctaaactcaatgggttaaggctaaaaggcagacaaagcagtgtgcatcgcactgtagctccagtccctagaagtgcctgtctctggaaggcactcaggaaacatgagaataagtggtagaagctyaaaggacatccaggtggtcccygcttcaagtccccacaccaccattgttttctcacttccagtatggtattcaagacattacttgaggtagtcagcactttattttttattttatattttattttattttattttttgagactgagtctcgctctgtcgccctggctggagtgcagtggcgtgatcttggctcactgcaacctccgcctcctgggttcaagtgattctcctgcctcagcctcccgagtagctgggattacaggcgtgtgccaccacatctggctaatttttgtatttttagtagagacaaggtttcgccgtgttggccaggctggtctcgatctcctgacctctggtgatccacctgccttggcctccyaaagtgctgggattacaggcgtgagcactttattatgaaacaggttttgtgttagataatgttgcccaactgtgggctaatgtgttttgagtgtgtttaggtaggcctggctaagctatgatgttctgtatgttatgtgtattaactgcattttccgctggcgatatttgattggtttatccaaacataaacccatagtaagttgaaggtcacctttagaggggaaaggaaaaaacaattgacatttactcacttcttctttatgatgaagtgattgaagcccagagaagttaaggaatttgcctgaggccacacagttccttagttcttaacttttgacatctgattacattttcctggatcctttttctggaaaaatgcccaagtgcacaaagatacaactttagggatttttcagactctggaggagtccatggaccccacattaagaacccctaatggtatattaaatgctcatattgggattgagttcttatctttcttttcctttgagatggagtcttgctttgttgcccaagctggagtgcagtggcttgatctcagctcactgcaacctccgcctcccaggttcaagtgattctcctgcctcagcctcccaagtagctgggattacaggtgccacctcacctggcyaatttttgtatttttagtagagatggggttttgccattttggccaggctggtctcaaactcctgacctcaggtgatccacccacctcatcctctcaaagtgctgggattagaggagtgagccactgtgcccagcctgagttcttatcttctaacttctttctctatggataagttcacagttcttagcctctggttttttttttttttttttgagatggagtctcgctctgttgcccatgttgcagtgcagtggcgtgatctcggctcactgcaacctccgcctcccgggttcaagcgattcttttgccttagcctgccaagtagctgggactaaggtgcctgccaccatgcccggctaatttttgtatttttagtagagatggggtttcaccatattggccaggctggtctcgaatacctgaccttgtgatccacctgcctcggcctcccaaagtgctgagattataggcgtgagccaccatgcccggccagttcttagcctcttgagggaaagtggggtctcctgggtagggagccctggagagctgctgggcctcsgaccgaaggcagatggggccttaggctcctggttgtgttgggtggtttccccatctgtgctttgggcctcacgagccgcatggtattgtgtgcagatgtcctgccacccggagctgaatcagtatatccaggacacgctgcactgcgtcaagccactcctggagaaggtgagggtgcactgggctccccagccatctcaccccatgctcacccccrtccctgtgtgctcacagtccaactctgggatggggtgaagctaggactctgtggggtcttcatggctccaatacccagaagcctgttccctgcactctggagaccatcccaacccaggggcaggccccaaggcatgcgggccatgttcagggtgccttgggcctgggagcccgggttggagctggctctaagtaggggctgccccagagggttcggggttcttctcacatccgtcccctgttctccacgctaaacgttctgtctgagctgagcccctcagggtttcttccccatctagtcctgatctcagacttcctgggaccttccctatggggcccgggcattctctcagcctacaccactcatgctggagggtgccggcttctcaaactcgctatctggcctcttggggacccccagcctagcagctgagcagggctgtgagtgggccgtttctcctccttccttgggcaagggggtggaggcagggtggtgtagtsggggtggggtgcctggctctgcagtgggggttcctctctttgcagaatgatgtggagaaagtggtggtggtgattttggataaagagcaccgcccagtggagaaattcgtctttgagatcacccagcctccactgctgtccatcaggtgggctgcccctgcccctcgcccactagctggcatcaggkgtgtctctggcaacacacccacccctttaaggcggcccttgaataccttggtaaaggcctgggaggagaaagggcaagaagcaccagcatgacaaggggacagcctgtgagcagctgagatgggtccagagagatgacatgagctacccagggycacctgggtgggggcagagcccaggacacagaagcagttttctgactccccaggcaagtgtccagtcaactcgaagttgacctctggcacatgcgttagttggtcaactrcatgcttccaatggtgaggtcagggcactggaatctggcaccaacctgtccccacggcctgtgtggccttaggcaagccctttcccctcctggcttggtgtcctggttctgggtcctggctgcacattaaaaccacctagggaggcctcctcaggctgcccctacctcccctgtcccctaccccccgccaaattctgactttatctggggtggggctgggcatttcttttaaactcccttgctggtttaattgtgtggaccggatagggagctgggtcctaggcatgcagcactctcacaggcactggagggggtcttgtaccccaggtctgcatccaggcttgatgcctgtggtggaggggagggcgccagtgtgatgggaagacctcctctcactcccagctcagactcgctgttgtctcatgtggagcagctgctccgggccttcatcctgaagatcagcgtgtgygatgccgtcctggaccacaaccccccaggtgtgtccactccccaccctctcttcccttggcatttccrtggttatctcgggttggtctgtgttcccaggtccatgtttggctgttctgagactcatctcttcctaaccctgagagtccacctcctctgggaagcttccctgattgattctacctggcttccatctccctattgactggggcttttcttagcacttgctttgccatctgctctgggggtgctgcygagccagcaagggargtgggaagaggctgggcccaktggctggcaccagggcggtgggggagcctccaccaacctcttgcctctccaggctgtaccttcacagtcctggtgcacacgagagaagccgccactcgcaacatggagaagatccaggtcatcaaggtgagatgagatgggtctgggtctgggcgcaggctctagaaacgtgatgtcgcagttccaggygggcaggggcactgcctgtggccagccacccattacattggtgtggcagcgcctggcacccagcaggtcctcaggcctgtccactgctccatctgggcacttggggcagtgaggagcccaggtggagccacctactggggcccccagctcatcctggctcttctgaagtgggggctctccagggaggggtcctagcccaccaggttcagcgttggtgcctggagyctgttcgtcacttgggttctatggacttggcctctgtgggggatgggggsggtcctggggtctgcatcaccaacagcttcctagtgattctgaggctcaggttggaggcccctggtctggagtgggagggacagcaaagtgagggcaggccagggccyagccccrtcacccccctgacctkkgtctcctccctaggatttcccctggatcctggcggatgagcaggatgtccacatgcatgacccccggctgataccactaaaaaccatgacgtcggacattttaaaggtgagcttcgtggggacccgggaagctttatttaggggctgcttaacgaagtgaggccyggtgctgaggccttactagagggcttgcgggagagaacgggggagtgcctggtggagggctcctcccatctctactcttctccaccatggctatggccacgaggccccacctgtggtggaggtctgcccaccaggggcttctgtgtcctccagcagggatgccctggctgtcttgctgactgtggctgtttgcttgtgtccgtcagatgcagctttacgtggaagagcgcgctcataaaggcagctgagggggcacctgccaccccactgatgcccaaactgtcagactttgggggatccccgcctagggcagtgctgcatggctgccctgattccaagtgctcttatcgcctctgtgtgtggatcgcccgccccagcccggggccgctcaggtytgcttggaggatgcctcccccaggagggcagtgagggatgccgcaacctcgacttytcagcctcctggggttccgccggccaacactgtctgtctcaaatactgtgctgtgagttgtttcaataaaggggccccaagggctgggctgagctgagccatcattaactggagtgggagggacaggtatggccagggtaacctgggagaggggctgcttctccaccaaaatgccagggaccccctctccccactcctaaaaccaaccccaggctggttttactgaaaacatttattttttatttatttattattattattattttatgagccagagtctcgctctgtcacccaggctggagtgcagtggcgtgatctcggctcactgcaagctctgccttccgggttcacgccattcttctgcatcagcctcccgagtagctgggactacaggcgcccgccaccacgcccggctaattttttgtatttttagtagagacagggtttcaccgtgttggccaggatggtctctatctcctgacctcgtgatccacctgcctcggtctcccaaagtgctgggattacaggcgtgagccacagtgcccggcctgaaaacatttattacaacaaaacgtcagagctatgtgacagtaagttaccacaagctggtagggttgaaccggggcaggagtcgctggtacagggacctcactgcccaccccatgctcagctcctgcctggaggaacctctggctgacccagacacaggatggacagctgtcagaaaatctggacaacagctcggtagggcgattgggcagcctcctcctgtccatgcttctgcccaggctgagcctcggaggaggcctggttcctggtcatcttggggctgacgacaatgctgctgttggtgactcggggcccataccagcctgcccagtactgggtgtccctgcccccatgctggaagaggatgtagcggacaccccgggggtagtctgagaaggtgtaggagacctgttgggaggaagggagaggaagtgaccaccgggacgggggaggggaaggcaggagccaggtcctctaagagagctgcccaggctggaaggcaacagctccaggccagcaggggcaccctgggccctgaggctgccctttgcttcctgccatcctggccctgggaggagtgggtagagagagcaagtgggtgaggcctcacctctgtccatgtggcattgttccactgttggatggtcacaggtgggggctcgaaggaggccaacacgaagtagtcagccgaggccagctgcactttgagttggtaggtgcagccacagtcggctctggcagcaaacctggtggaggggttgagagccctgtgtccaagccaccgagggctggccccaggggtgggggcaggtgggacctatacattggagctcggagcttcatctcccatcagctgacactgctctgcctgcaaggcccagctggcttcagcgctccctatgccccactgtggcccggggataagctgtctgtccatgctggcctctgttaccccatctgagaagagggacccttttgggcatcctactaaagatatgacctcaaaaatcaaaagacccctccagagaggcctggtctgtccaagccatgtcacctgtacttacaatggaccaggctgtggattcagtgggagagtcaagggggtggcctgtgtaatggggctggcacaaagctcaccctctgctcagcccagccacctctcccccctgcagctctgcatacccctccatcctcaccgctttatcctcagagtggcagccctggggcctgcctagaactggggtcctgcttctgccaccggccaagccagagcctggcacagttctgtgcacagagtaggagctccaaaaagagtcatgggatgaatagggaaaggggcaggggaggcaggtaggtcaggggacctgggggttcccacccagtccagagagggctgaggtcctctgttgcccaagtgcctgtcagtgcacagtggctgggcacagtggctcacacctgtaatcccagcactttgggaggccgaggtgggtggatcacttgaggtcaggagtttgaaaccagcctgaccagcatggtaagacgctgtctgtattaaaaatataaaaaaaaatagccgggtgtagtggtgggcacctgtaatcccagctactcaggatgctgaggcaggagaatcgcttgaacatgggaggcggaggttgcagtgagccaagatcacgccactgcactccagcctgggtgacagagcgagactccgtctcaaaaaaaaaaaaagtgcctgtccatgacagtgcacctgggggcctcagcctcctcacctgcacactggggctactgtgtcctgttgactacgtcacagggtggtggggaggccaggaggtgccgcagggtgtgggtgcagagcaggggcggaggccggggctacctggctccagggcactgctgtgcagagtgggcacttgctatgggttgtctcacgtacatgcagcgcagtaagaggagcatgtagagtgtggggacacaggccatggaccctactcaccagtccttaaccacgatgtccggccggaatgtgtctagtagctcctcccagtagccctcggctacaaggtccaccagctgggacttgaggcacattctggggagcagagttgggggcttgcatacctgggtgtgctctgcatggccccccccctcacccaggccttggcagcccctgtgagcccagggaggtggtttggggacctagggtaccccttggccgctgcgggacaggcactggctggggctgactctggcttttcctccagtgcaggagggagtttgacccacttgtgcctgggcggcatttgatcccagtccaaaggcccattgttccagggcacttttgtaaactcaagttcctagcttacggacagatgcctgtagatagccctggcttatcttaactgcccaatggactcctggcctgcttcagtgatccccacccccactgtccattaacacagcactgagtgatttcaggaagcagtgactctgggcaagttttggggccacctccctcgagcttcgcagagaggacttcccttaggaagactttgcctgagacttggcaaaggtgtcctgaccctctgtcccctccacgcaagcctggtaggttcagtttgccttactcgtaggatgtgacaaaatacttcttgactttggggtcaggaaaatctgtcccgtgggctccagggaggctctccaccttccagcggtccccaccattgaaatcaatttgccatgcaaacatatcctctaggaagaacagaagccaaggtgagaccccctgtgtaaatccaaagtccagccctccccacttagtcccaggagggcgggagggagggtggttggcgttagtgaccttcttgggaggcaggacttgctcatgctcaggtctctgcggctgtggacaccaaagggttaaccagcttgttccttctcaagggcattgtgtggccaaggtaccccaccagcccaagtgtaccccaactgcaccttggagcacccctacaaagcacccctccaacacattcccaactgtcctcaccatatcagctctgatctgactctgtccctcccactcagtcccaaactggcctcactcctaacacgcagctggagaaaagaatgcgtgttaccagaaattctaaaccaaccccttcctcacttccatgttgcggtggaactctgggaaatacccaagtatcagttctcaaaaaattacgagaggcctgtgagagtactgtcctcaaagactaatgtgaagccgggcacggtggcttgcgcctgtaatcccagcactttgggaggccaaggcaggtggattgcttgaacccaggagttcaagaccagcctggggaacatagcgacaccccccccccttttttttttaataagtaaaataattttttaaaaaaggctaacgtgttcatcccaacacagactgcttacttgacccagatggcatcccagatgtccaggagggagaggcccttggttaactacataacccaggttggaggccctagaggatgggtttgtgggtttgtcggtgggtcatgggaaccaagattcccatagggctcagatggcctctgcccagggcaagagtgccaagtggaagaacaggtaccctttgggctgggcgctgtggtaacattcatgggtgggcctccattaggtgggcctggtgggtgcaggggagcaatcaccctcttcacactgaacttagaggaccttagaagacaatggcgcttctctactggcgctgcccaggcaatcaccagggcacttttttttttttttttgagacggagtcttgctctgttgcccaggctggagtgcagtggcgcaatcttggctcactgcaagctccgcctcccaggttcacgctattctcctgcctcagcctcccaagtagctgggactacaggtgcctgccaccacgcccagctaatttttttacatttttagtagagatggggtttcaccttgttggccaggatggtctcgatctcctgacctcgtcatccgcccgcctcagcctcccaaagtgttgggattacaggcgtgagccaccgcccccggcggtgtggtggctcacgcctgtaatcccagcactttgggaggccgaggcaggcagatcacctgaggtcaggaattcgagaccagcctggccaacatggcaaaacctcatctctactaaaagtacaaaaattagctgggcatggtggtgggcgcctgtaatcccaactacttgtgtgtgtgtgtgtgtgtgtgtgtgtatgtatatgtatatatgtatacacatatatgtatacatatgtatatatacgtatatatgtgtacatatatacatatatacatgtgtatatgtatacacgtgtatatatgtatacatgtgtatatacgtatatgtatacatatgtgtgtgtgtgtatatgtgaaggtgtcactgtggatgctatagtgtggcaaacaaggtccatttggcccctggagcttgaagtttgtagcagaaaaaaataaggaaattctgaaaaaaaaattttttttttttttttgagactaaaagtttcactcttgtcacccaggctggagtgcaatggagccatctcggctcaccgcaacctctgcctcccaggttcaagtgattctcctgcctcagcctcccaagtagctgggaattgtaggcgtgggccagcatgcccaactttgtgtgtttttagtagagacagggctttgccattttgaccaggctggtctctaactcctgagctcaggtgatccgcccatctcggcctcccaaagtgccgggattacaggcgtgagccaccgcgccttgtgaaaagtgttacagggcatgaaatgggggtgctatgctagaggtggagagggctgtttttagattgggagcacagggcaggtctctgaactgagacctgaagaatgagaaggaaccaaggaagtgaggtgggtgtttagggttagagaatattccaggtagtgtgggaattgcaagtgccaaggcccaaggatgagaaggaacgagcctggtggcagcctccaccctgcccccatgccaccttcagcacacgggttgcgcaggaggttcctatgcaggctccgtaggaagtagaagattttccagtcggccacgggctggtcccagtccttggtgatgaagccctctcgcaggcacttgcgtttccagagggtcatgaggtcgatgaggtcccgccagaggctgcagaccaggcggcagttcagcagcagctggcgggcgggcacgtgcgtgaacagctccagcaggatgttctcgggcagctcgttaatgctgtccagggctgctttggagtggggagcatccatggcctgtgggggcaacagcagttatgagcctgaccagggaggtgggccctcaggtccccagggaaccaggccagggactcctctccaaccctgcattagccaggtgtggtggcacatgcctggagtcccaggtacttgggaggctgaggcagaggatcccttgagcctgggaatt

SEQ ID NO: 12557 - DNA, 25768 bp, Homo sapiens
aaatattccttcaaatggaagatgccttatggtttcaaagatgtcccaagttggactatccaaaaatgtaatgcaagtcaacccaaaggttaacactctcagagagtagcttcatgagacagcacaggaagaagggataaaagcctgtggtggctcatgcgtgtaatctcagctactcaagatgctgaggctgtagatctccaggccaggagctccagatcagactgggcaacagagtgaggccatgtccttagaaaattattattgatttaatttgctttttaaatttactgctattaggccaggcacggtggttcacgcctgtaatcccagcactttgggaggccaaggcaggcggatcatgaggtcaagagtttcagaccatcctggccaacatggtgaaaccccatctctactataaatacaaaaattagctgggcatggtggcatgcacctgtagtcccagctactcgggaggctgaggcaggagaattacttgaacctgggaggccgaggttgcagtgagccaagatcgtgccactgcactccagcctggctgcagagcgagactcagtttaaaaataaaataaaataaaataaaaaaatatatatatagctattattatttaaagacaggacctcactctgttgcccaggctggtctccaactttgattggcctcaagcaatccttctgccgaagcctcccaaagcactgggattacagggattagccacactgtgcctgaccatagtttccctccactgactccacccacaagcaatcattcccaacctaaaaacattattttaaaaattagcggagccagggttagtggttcacgcctgtaatcctagcactttgagaggccaaggccagcagagagcttgagcccaggacttcgagaccagcctgggcaacatggcaaaacctcatctctaccaaaaaaaaacaaaaaaacaaaaattagtcgggcatggtggtgcatgcctgtagtcccagctactctgagggctgaggtgggaggatctctagagcccaggagttccgggctgcagtgagctatgattgcaccactgcactccagcctgggtgacagagtgagatccctgtcttaagagatgaaaaataaagaatatttttgtacagaattttgaagacagatcatatacccagagcccaattcctttttctctgagctaccagtatctcttttatacattccttatattcaataattttattatgcattggtagataagtgtgtacatctacacatttatatagtcacaccaaacaacatgcttaaatgattatttgttgaaagcttttttttttttttgagatggagtcttgctttgtcgcccaggctggaatgtggcgtgatcttggctcattgcaacctccacctcccgggttcaagtgagtctcctgcctcagcctcccaagtagctgggactacaggcatgcagccaccgtgcctggctaatttttgtatttttagtagagacggagtttcactatgttggccaagctggtctcaaactcctgacctcaggttatccacccgccttggcctcccagagtgctataattataggcgtgagccactgtgcccagctggccaggcccacaaatctgtattttaatagattctccaggtggtgcttacaaacgctaaagttaatgcaaaggtgctatttcgtgttttgttttgttttgtgttgttttgttttgttttttgagatggagtctctctctgtcttccccagctggagtgcagtggcactatcaggttcaagcgattctcctgtctcagctgccagagtagctgggactacaggagtgtgccaccacacccagctaatttttttgtatttttagtagaggcggagtttcaccatgttgaccaggctggtcttgaactcctgacctcagatgatctatttgtctcggcctcccaaagtgctgggattacaggcgtgagccaccgcccccagcccaaaggtactattttggagcaatgattttaagacttggctttattatcttaatttgaacatcataaagaacaaatacatagtcaaaaatacataactgttttctttttttttctcttttcttttcttttctttttttttttttttgagatagagtcttgctctgttgcccgggctggaatgcagtggtccaatctgggctcactgcaacctccgcctcctgggttcaagcgattctcttgcctcagcctctggagtagcagggattacaggtatgtgccaccacgcccagctaatttttgtatttttagtagagacagggtttcaccatgttggccaggctggtctcaaactcctgaccttaaatgattcatctgtgtctgcctcccaaagtgctgggattacagacgtgagtcactgtacggcccgtaactgttttctgagtaagattcagtttccaatctcggcaaatgaagactttcctggggttaaaaggactctttctggttcactccttgatatcgacctgtgctggggattgagcagctgttcaagtccaacccacccagttttggttctatgccaggcttaaatccacgatatttcacaattcgtgtatgccacctgatgaagtgtttttaggtgatgactgccttgtaacctaacattttgccaaatgtttattgtaaatttttctaccatcatcattactgtggtattgtaactaaaactctccaggaagttattcagcttaaaactaaaatcgagtatatctcaagtaactctactgtttgatttgaaatgcctctgttatatgctgtctgcaatcagcatcgtctcgtaaataaagttgaaaggaaagatgatgaaactggcagtgttactgaatgggaaataaaggtgagaatacacactgcgaatgaagacatggaagttacttctatgacataatcatgtaggaatctgaatgccgtgttcccttgtttaccaaatgaagcacctttattgcaagagaagaaactgggctgttcccgccaatattcagaggccatttggaatctgctatgattgcttagatctgaggacttggtgctctattattttgtgggatctgagaggcaggaatgggatttaatgatatctcaattctcatccatctaaaataacctaatttgcaattataaataaaatggcatgttgcatttatatattccctttttaaaacaggaactggtcctgcttttaactttatggagtcttatttatgaataaagctcaaattattaaaatatatattcagattaaaattcatttgaacagtctatggctattatgaattttatttacttctcttccccgaattttaatttctttgaaggcttccaggtaaacagtgattactaattatttcaatgttgtatgagtccaagatccttaagtcagttcattttggataacataatcaaattatcattaaagaatgatgcaatcactgttaatcttaagaatctgacagtgaaatatgaccccttaaaactattcaggtgggcggggcccagtggctcaggcctataatcccattactttgagaggcagagaccggtacatagcttgaggccaagaatattaggtgacatagcaagaccatgtctctaaaaactaaacaaataaaaatgttccccagttagtgcagatggaatagctgcacagattcacataagtttcagttttgtctcagatttacaagaacagaatttataaaaacattggttatttaaattaggattcaacttaattgtatatccatgtttacatttaggattctttaaaatagtgtaaatagtaataaactataagactcataagcaattctaaataatttaggtgattaatttggcctttttatttaaacaaaatccagtcttggatctgttaaaatgatatattgcatgtttatttctcacagtggtaaaatcatggactcataccatggaccattttttaaactcctcactctccaggggacgttggtgaaaaattttcttatagaaccctgggccaggaggggtggccttgggcgggactgtttgttctaaaaattggtaaagcccagggcttgttggtgatggatgagccagaagtgatgaggacccaacagagacttagagtggagtcggaatgaagtcagaagtcacttgcgtgactccaagtgtgtgtcgggtcctgctagggtagaatagtctctggacctggggacagggaggaaatggacatcaaaaaataccattatcatggctggcccaatggtagtgggttatcagaacttatcaacattagtgttgctaaagttggtatacaaccccccactgcgaaatttggctggcttttaaaaaaatgccattatgggtagacactttgatctttattggcagggtcagtatggcccctgggtccatgtggtgtaaaagtaggagtatctccactcataggtgggaattgaacaatgagaacacttggacacaggatggggaacatcacacaccgaggcctgtggtggggtggggagtggggagggatagcattaggagatatacccaatgtaaatgacgaattaatgggtgcagcacaccaacacggcacatgtatacatatgccatatgtatacaacatggcacatgtatacatgtatacatatgtaacaaacctgcacgttgtgcacatgcaccctagaacttcttaaagtataattttaaaaaagaatcaaaaaataattaattaattttttaaaaaaagtaggagtatctctaaaatctattgctactagtggaattgcccaatagggctgcttccttgtgcaaacttggaaactgtgtcatcttcatcctggagaaggcagggtggccccagggctcatcttgagctctaggatggtacttcagccctagcattaacattggagtgctgtgtcatttccccaatagtaggttatatgatcccctactgaagcaagaagacaaactggatggtggagcaagaagtcaaaaagaaatctatccagaagcctgaaaacatgattagcagatggagaggcaacaagacttaggaggcaggctgggcatggtggctcatgcctgtaatcccaacactttagaaggcggaaacaagaggagcgcataagcccaggaggtcaaaactagccttggcaacatagtgagacctccagctctacaaaaaaatttaaaaattagccagatgtggtggagtgtgccagtagccccagctactctggggactgaagtgagacgattgcttgagcccctgaggtccaggctgcagtgagccaagatcaagccgctgcactccaccacagagcaagaccctgtctcaaaaaaaataaaaacaaaaaaaagaaaagtggaaagctccctcctctgatctcagaccttatttcttttaaggaaatatacttttgaagttttgagtttgaaacacagtttggacttaatcacgagggatgttgtgtaggaaagaatcattcatttaattaatttggaacccctccaccacagtttactccttatgatattaacctcctttaagcatacatcagtgtgaaaatgtcttcagtttaaaaaggcattttacttctgatggggtaaaaaagtttgtaccctatctgagaccagagcattcataatgaagagaaactatgaagttaccaaatgtggggaaacttactcacatgccatctcatggaatatagaagtcacactgaagagaaaccctgtgcctctaaggaatactgaaaagcctttagctagattaccaatctcataaagcagcagaaaattcatgctggagagaagccagtgaaagcagcaaaaacgtcattgaattaatattcaatttatactgcagaggaagctttgaatgtactacatatgagaacattttctctcacaccttattccttactctgcatttgaaaggtcttacacagataaaccttataaatgtaagaaatgtggaaatatcttcagccaaaagtaaatccttgctcaaaaaaaaaaawatatacactggagagaaacctcgtgaatgcaggaaagcttttgtttagatatycctctcagtcagcagagggtttatgtggggaaagcccctctgcctgcatggtatgtgagaaagtcttcagccgcgtgtcagtttcaccgagcatgagcattttcacactagagagaaaccctttgaatgtaatgaatgtggaaaagcctttactraaagcagtatgtcattaaccatctgaacgctcataaccacagagaagctttgtgaatataacaaatgtggaaaatccttttgccagaaggaaagtctccctaccagtcagaaaattcgcactgaagagagaccttttgagagtaaagactgtgggaaagttctcattcagaagtcaaacttcatccagtaccagagaatgcacacagaagagaaaccctttgtgtataaggagtgtggaaaaacctttagtggaaaatcaaaccttactgagcaagagaaatttcatattggagagaaaccctttaaatgtagtgaatgtggaacagctattggccagaagaagaagtacctcataagaaaccatactggagagaaatcctatgagtgtaaggaatgtggaaacatcttctgtcagcaaataccacttattgtagatgtgagatttcagatgatcaacccyatgaactcactgtggaaaagccttgtctcagttcattgcttactgtgtgtgtgagcagccccgcaggtgagcagccctatggtttccatggctgtggggaagctttctcccaattctcaactcttgctctgtatgtaagaatacacacaggtaggaagctttatcagtatggtgaatgtgggaagctttcagccagaagtcacaccacatcagactccagaaaagtcatactcgtttaaaaactccagcaggacatgacggctcacgcctgtaatcccaacaccgttaaaggctgaggcaggaggatcacttgagcccaggagttcgagacaagcctgggtaacacagggagactccgcctctacaaaaaaaattaataaaaaccttgaaaatgggagtgcttttatcaggaatgtacacctcataatgcatcagaaataatcattttgcagcaaagcaccacaaataaggtaaattttaacagatactttatgtatgtaacttgtgggacatcagaaaattcaatgtccttctgaagagaagggtattcatatgataaaaagcctgagtctggccaggtgcagtgactcatgcctataatcccagcactttgggaggctgaggcaggcagatcacctgaggtcaggagtacaagatcagcctggccaaaatggcgagccctgtctctaccaaaaatacaaaaattagctgggtgtggtagcgggtgcctgtaatcccagctgcttgggaggctgaggcaggagaatcacaagaacccgtgagacagaggttgcagtgagccaagatggcaccactgcactctagcctaggcgacagagactccatctcaaaaacaaaataaaacaaaacaaaaaaagcctgggtccaacaaagaaacccacagcaaaggcaatgctgaaactttagacacatttccactaaaattgggaacagaaaacagatgcctgttagcattgctgtcagcattgatctggagatcttcaccagtgcagtaagttgtaagcattggaaaggaagacacaaaattagatatgatcatctataaatacataagactcttgtggtgttgactgaacagagcagaacagatttcagaaagagacctatgcattatttgaatttggaatacgatagaagtgaatcaggataggaggaaatatgggackatttttaaaaatggtttggaggtaatctgttctccaagtagggaaaaatagaccatgaaccatacacaaaagtaaaatccacagagatgaaaagcaggcattgaaaaagctatgtattaaaattatatgactttgggagtagggaaacattccttgtaacaacttcagaaatacttagcaattctacttttgaatgtgtatgctcaggaaatatgtactaggatatttactatggtttgatttgtagtagccaaaaattggaaacatcaaaaagaagaaatccttatgatggaataatayatgtctgtaagtgcaacacctgagattcacatgtattaacaggaagatctcagaatcatgttgaggggggtaatatcaagttgcagaatgatgcatatagtacaatgactttctgtaaatgtgttgctgttttgtgttatttatttgtttaattaattaattatttttgagacaggatttcactttgtcgcccaggctggagtgctgtggcgtgatctcggctcgctgcaacctccacctcccaggttcaagcgattctcccacctcagcctcctgagtagctgggactacaggtgcgtgccaccacgcccagctaattttttgtgtattttttggtacagacagtgtttcatcatgttggccaggctggtctccaactcctggcctcaagtgattcacccgcctcggcctcccaaagggctgggattacaggcgtgagccactgcactcgacctaatttttaatttatttttaaatagagacggggtcttgctacattacccaggctggtctggaactcctggactcaagcaattctcccatctcagcctctcaaagggtgaggtaataggcatgagccaccatgttcagccactttttgtaartttgaattaaaatttccctcacaaaattcagtactatacacatactatacatgtatgtacgtaaatgtttctgaaatggtttggaagaatatagcccaatacttgctagtggtcacctgtaaagagtgaagaagggaagagagtgagtgtgagacttcagctttgtatctaaacatcttttctttaaaaagactgcaagtagtgagccgagatcatgccactgcactccagcctgggcgacagagcgagactccgtgtcaaaaaaaaaaaaaagactacaagtaaatagaggaagatactgattaattctgtactgtggtatatggatctctagtcttattttttatacttttccatgtttttaaaatttctcagaattggtaggaatgagggtgaggatgggaactctgtacctgtagaaatcatgctgtaatattcattcccggccaggcgcagtggctcacacatgtaattccagcactttgagaggccaaggctggtggattgcctgagctcaggagttcgagaccagcttgggcaacacagtgaaaccctgtctctactaaaatataaaaagttagccgggcgtggcagcgtaagcctgtaatcccagctactcggcaggctgaggcaggagaatcacttaagcctgggaagctgaggttgcagtgagctgagatcgtaccactgcactccagcctgggcgacagagcgagactccatctcaaaacaaaacaaaacaaaacaaaacaaaaattcattcccaatcaaatactaaatttgtatagcaaatatttctaaaattttatcaacaatgagtggatgaacgtgctatgtatgtaaaatgaaattatctggtttttttttttttacattcaaaatgaaggccgggcatggtggctcatgcctgtaatctttgcactttaggaggctgaggtgggaggaccgctcgagtccaggagtttgaaagcagcctgggcaacatgatgagactccgtctctacaaagaatttaaaaattagccacagtgagccatgattgcaccactacactccagcttgaggaacagagtaagacgctgtctcaaaaataaataggtggcaaaaaaattaaaaatagtaagtaaaaaccacagccaaaaagaaagagagagagaaagaaaaagaaagaaagaggaaggaaggaaggaaggaaaaaaggaaagaaggaagaaagaaagagaaaaaagtaccacgatcatttctagggtaacctgatggaattatcaagataattatgcaagataaaataaataaataaataataaataagtaaataagtcaaaaccacagraaaaaaaagccattaagtttccagggtaaactgatggaattatcaggatttcacagtagaagtaatttgattaagtttacagctgccaaagaggtggagtctgcataagtgaacagctgattgaatctgatgcctctagtgtgtttaaggactcagatcataagagcaaaaccgtttgagttcaaatctactatcagtgtttgattctgtgacctgcaaatacttaatatctctgagtctcagttttcgctttacatgataacaatgataaaatccacctcctaatactggtgagggtaaaattcgctaattaatgccaattgcttccytgcacaatgagaacaggggaagtgattgcattaatgtccagaggcctctggtaggtaactcaatcactctgcctatacaggcggtaggtaggtcgctggggctccgccccgaggggtgtggccgaccaaagacgcaaagcagtgacctgggtgcatccgrgccaggctgtataaaagcccaggccccagaaggcgcccagaagtttcagagtgtgttcctctccgtctgcaagtagcaaagtgcccggcctgccatatggatcaatttctggtaagtctatctccaaatgaaagggcgaaggtcggtgtcatggagtggtaggtcagaaattcaaagatgtaggcgtccagaatcctagcaagggagcccgctaataggggaggacagagaagtgtctgaaacggttcatttattgaggaccatttttacttccacgagcctgccctccgcagggcatgcctttcatcagacagaccctttcatcagacagacgcggggcctgcagagaaggctgtggttgtgatcctgggggtctctcgatggcacccgaaggtctttctatcatgttggcaggagcccaggacgagatcgtggtctggtcgaagtctcatggaagtatacaaggaacgctaggcccatgagtcagaggggcctgggtgggttgggttgaattattagagatcaagagaaggaggcatagcccgtggttggaactatcagggtttattgtttgttttggtttggtttggattttttgtttgtttgtttgtttgtttttttgacagagtcttgctctgtcgcccaggctggagtgcattggcacgatctccacacactgcaacctccgcctcccaggttcaggcaattctcatgcctcagcctcccaagtagctgggactacagatgtgcactaccattcctgactattttttttttcttttttggaattttagtagaggcagagtttcactattttggccaggctggtctcaaactcctgacctcaagtgatctgcctgccttggcctcccaaagtgctaggattacagacctgagccattgcacccagccgggactatcgttttaataattccttaaactggggttgaaatccttctgtttttccaagggccagaaactttagggaccagaagcagacctagagcaggtggagtgggaatcagtccctcactgggttcctgttttctaaggttcccagtgggatccatcaggccttgctcagaacgaaatagagttctgtctgctcagaggagcttctagtccagtggtggggagagggggtagacaggagttaagcttttacatgagtagaaatggtgggaaactaagtgtaagagtaagatgctattagagattgatttttaaagtttaattttatgtatttattttttagagaggagggggttcttgctatgttgcccaagctggcttcaaactgctgggctcaagggaacctcgtcccacagcctctgagtacctagagctagaggtgctgtgatagctagagattgattttaatctcagaggacatcatttcaaagatttcctgtttggaattttttttttgaatttttctcagttatttgtatgatcttcaaatatatgtaatataaaattaccatcttagtcatttttaagtttacagatcagtggtggtatttagatacagtcatagtattatgcaaccatcaccaccatccatctccagaactctttcatcttataaaagtgaaactgtaccagttaaacagttaactcctcattccccctcccccttttccccccaaccatctgtctgtctctgattttgattactcttaggtacttcatataagtggaatcacatgaytttttatgtgagtcacttttttgtggctggattatttcacttagcataatgtcctcaaagttcatccatgttgtagcatgtgtcagactatccttccattttaaggctggatattcagttatatattccattgtttgtatatacatttgacccttgaacaacacaggtttgaactgcataggtccacttataactatattttcttcaataaatatattgaaaatagattttcatatgttgaaccatccttgcattctgggagtaaatcccatttggtcttgttgtataatccttgtaatatgctgatgaattgggtttacyagtacttttttgggatttttgcatcaatgttcttaagggatatgagtccgtagttttcttttcttgtagcatcacatctggctttgacattgggtatatgctgggctcgtagagtaagttaggaagtattctctcctcttcaatattttgtagaagtttgaaggattgatattagttctttaaaatttggtagaattgaccagtgaaactatcaggtccacagcttttttttcgttaggagataatgattactgattcagtctcattagttataggtctcttcagattttctttcttcctgattcagtcttgataggttttgtgtttctatgaatttcttcattttatctaggttatccaatttgttggtgtacaaactgtccatagtcctgtcttaaaatcctttctattggtgtagaagtagtagtaatgtccccacttttctttctgaktttagtaatttgagtctctttttcttagtccatctagcttaaaggtttgtcaattttgctgatcttttcaaagatcgattttttgtttcattaatttttctgtattttttaaaatttccatttcatttatctctgctctattcttttttgttttgtttttttacaggtggggtcttgctttgtcacccaggctggagtgcagtggcacaataacagctcactgtagcctccgactcctgggctcacgtgatcctcctgcctcatcattccaagtagctgggactacaggtatgtgccaccacactcagctaattaaaaaaaaaaaaaatttgtaggagctggatctcactatattgcccaggttagtctagaactcctgggtgaagggatcctcccaccttggccttccaacatgctgggatgacaggcctgacccactgtgcctggcctgktctaatctttatcattttcttccttctgcaaactttaagtttagttctttttctagttccgtaaattgtaaagttaggttactgatttgagmtatttcttgtttttttaaatgtaagtgtttatarcttctattctagcattgcttttactacatcccataaattttggtctattgtgtttttgtgttcattataacttctcttgtgatttcttctttgatccattgtttgcttaagagtatattctttcatttccacaaatttgtgaactttccagttttacttcttttttttttttttgagatggcatctcactcggtcgcccaggctggagtccacctcccaggttcaagcgattctcctgcctcagcctcccgagtagctgggattacaggtgctcaccaccaagcccagctaatttttgtaattttagtagggacagggtttcccatcttggccaggctggtcttgaactcctggcctcatgatccacccacctcggcctcccaaagtgctgggattacaggtgtgagtcaccatgcscagccttccagttttacttctattatggatttctattatggatttagaggtggatgtggtggcaagcacctgtagtcccacgtactagggagtctgagacaggaagatcgcttgagcccagtagttcaaatccagccggggtaacttggagagaatccatctctgaaaataaaaataaaaagaattcctaggttttgagagctcctcttggtagggtgtcaccacaagaagtggcatcagcccagacctccaagtgaaagtggcttctgcttccactgtggcttcaattatctcccttcttttaagggtacctccttctagttcttgggaaattccacttatttccaatcataaatagatatatgttatatatgtatattctttgggttttaaaatttttctttaaatatatgtaatatatgtacatatattatatatatatatatwtttctatatatttaaagccatctatcatttctatgatttggtatagaagggaaggacttcagggtctcctcagtccaccatattcaatgrcagtcctgtcacacattttgaatacagcctgggggaattatggtatttctctattctgagagtcaggacaaggcaggagggaccagactttgatggcagagatrggaaaggagaacgtattagataagataatttggctggataaggcagactgagcaatggattggataggaacatggcaaaactgagtagactgatctggctagagtaggacaaaagcagggaagaggcacaggggatgaaaaagatgtgaggctacccagatggtggctttggggagctcattataaacttgacacttttcttgcagatcatatggggcagagaaaaaagagaaaataataaataaataaataaataagtacatacatacatacatacatacacttgataccagagacaaaggaagcctagaagcatatggatggccactttgaacagaaatataaaccttgtccatatgcacagttacgcctctgtctccaaagaaactgcttcttggaatgtatcttagtctgttctgtccaggagctggtagattcggtgtctggtaagggcatactttctgattcatagatggcaccttttagctgtgtcctcacttggtagaagtaaagaactctgaccctcagccccttagaagaacactcatctcattcttgaaggttctgtctccatgacctaatcatctcccaaaggcgctaccttctaatacaatcacactggaaattcagttttagcataygaaatttggagaaacacaaacattcagtccatagtagaatggttcctagaagctggtggtttccaggatggttctcaggaggctagaatcagtgggtgcccccagtgagatctctgggagaaatatcccatttatctaggggactgtaaggacccacagccagataggtccagtacaaattaagagtcttccacctgggccaagtcaatttacctccctggacttctattttccttaaaatgggattaattatgacccttattttctggggtcatggtggaaatgaaatgagataatttatttgaaaatttaatcagctgaatctccggtaagatgtctggagaggagactttggaaaagcctctggggtgagatctcttcagargatgataggagattcacaacatccatctagactctcatctccattggtagataggagtagcttagtaaaagtttgcacttgagaaatgtttgcacttttaaaatgttactctgtgtgtggaggggacactggatgaagttaactccagagtcagttgaaaggcaactacaggcttctaggcaagagatgatggtgggctggattaggatagggtcaacagggayggagaaggagggtatgtggggattggaatttgagctgggatgaacccctgacctatcaatttttttgcaggatcccataactaaagatctagttcagtcatcagrcaacatcaaagagatggattccagtcttctccaggcaattgaggaaattgagaaatttttccagcatctctctgagcggcatacagaacaggcagaaaccccagatgcaccagaaccacagaactgtatgcctctgactgcccatgctgaggagagccaacatgagtcaacccagagcaagacgatgcmtcccttggggtccacaatgatgacttctgcatgcactaacatccctgggacagttctcacccaggacttaacaatgcaccctcttaaagcccttgaagacctaagtgagacttattccatgggccagaaagtgacttcctttgatcaggtaaaacacacagcaggctcccagatgacagatgttactgtcaccccaaagtcatcacccactgattgccagaagacaaccatcactgcaagcaacatgacaatctccaatgaaagtagccagctgaacaccccaagcagtgaccagaccctcaatgagagtcagataccagccctgcttggagatcagatgaagaccctcagtgataaccagactctctgtggggaccaggtgaccttcagtagtgaccagaccctcactgatggtcatacagtgacttccggtagcgatgagaccctctctgggggccaaatgacaaccagtctagacctctatggagggcaaatgatgacttccattgataaccagaccctctgtggggagcagatgaygacctccagtgrtaaccaggccytctacgggagacagatgacgacctccactggtaaccagaccctctgtggagagcagatgacaacctccactggtaaccaggccctctatggggggcagatgacgacctccgctagtaaccagaccctctgtggagagcagatgacaacctccactagtaaccagaccctctgtggggagcaagtgatgacctccactggtaaccaagccctctgtggagggcagatgacgacctccactggtaaccagaacctctatggggggcagatgatgacctccactggtaaccagaccctctactgggggcagatratgacctccactggtaaccagaacctctgtggagagcaagtgatgacctccactrgtaaccaagccctctgtggagggcagatgacgacctccactggtaaccagaacctctatggggggcagatgatgacctccactggtaaccagaccctctastgggggcagacgacgacctccactagtaaccagaccctctgtggggagcaggtgacgacctccactggtaaccaggccctctacggggggcagatgatgacctccactggtaaccagaccctctactgggggcagatgatgacctccactggtaaccagaacctctgtggagagcagatgacaacctccactggtaaccaggccctctacggggggcagatgacaacctctactagtaaccagaccctctgtggagagcagatgacgacccccactagtaaccagaccctctgtggggagcaggtgacgacctccactggtaaccaggccctctacrgggggcagatcacgacctccactagtaaccagaccctctgtggagagcagatgacgacctccactagtaaccagaccctttgtggggagcaggtgacgacctccactggtaaccaggccctctatggggggcagatgatgacctccactggtaaccaggccctctacggggggcagatgacaacctctgctagtaaccagaccctctgtggagagcagatgacaacctccactagtaaccagaccctctgtgaggagcaggtgatgacctccactggtaaccaggccctctgtggagagcagatgacaacctccactggtaaccaggccctctacggggggcagatgacgacctccactagtaaccagaccctctgtggagagcagacgacgacctccactagtaaccagaccctctgtggggagcaggtgacgacctccactggtaaccaggccctctatggggggcagatgatgacctccactggtaaccagaccctctactgggggcagatgatgacctccactggtaaccagaacctctgtggagagcasatgacaacctccactggtaaccaggccctctayggggggcagatgacgacctctactagtaaccagaccctctgtggagagcagatgacgacccccactagtaaccagaccctctgtggggagcaggtgacgacctccactggtaaccaggccctctacagggggcagatcacgacctccactagtaaccagaccctctgtggagagcagatgacgacctccactagtaaccagaccctytgtggggagcaggtgacgacctccactggtaaccaggccctctatggggggcagatgatgacctccactggtaaccagaacctctacggggggcagaatatgacctccactgataaccaggccctctatggaggccagatggcaacatatagtggcaaccagaccctctatggggaccagatgctgactcttcaggtgggcaatatgacaacgctcactgatgaccacagcctttatgggggatatatgatgtcccatcagttctcatcattgccatacccaggattcctatgcttttcaagttcccatttgattcaaggacaactcccaaaacagaagacacagagctgccagttctggaagaatcctgaggtttcaaggccctatgtctgcacttacgaggactgcaagatgtcttattcaaaggcttgccacctccgaacccacatgcgcaagcacaccggtgagtgagggcccagaaacaggggtgaggggcaagtggctacagatttgtgcccggaagcatttgagattgctgccacttcctttaagccagggattcaaaaaattctataatagaaaaggttggcaccttcagaagggtagataaagcagtcctagggacaggctctagtcctggaccagggacaggctctagtcctggaccagagccaggctggctatagcctttagtggtgttgactgctggtttgatgggaataagtggagggatttctttggcctcttgcaggtagatgttcttgatgctatttctactgggaccgtcacttcgtagtgacagggcccccaggccccacttccctcatcctccttattccccccactaacttgcctgccaataactgtctctcctcctgtttgttttttttcttcttcctttcctcttcttcccttcttcacagttttcctcttgtctctccagcttttgcggccctcattcccctcctccttcactcacctccaccactcccgtctcytctggctctccctctcccactccaacttgttcaaaaacgttttcttgttcactttmaatgtccctgccctacctcaccctgatgtatgacaggtctctctctctctgtctggtccaggggagaagccctatgtatgcgatgtagagggatgtacgtggaaatttgcccgctcagatgagctcaacagacacaagaaaaggcacactggggaaaggccctacctgtgttcaatatgcagcaagaattttgcaagatctgatcacctaaagcagcatgcaaaggtccacaacattcgcccaggattatgaacccttcagcccatgtggaaatgtgtacagctaaaagattctccctattgaggttgtttcccttgaacaagctcccctatttccctatgccagtagctagtaggtgcttaatattattcataagttttctaaaatatacaaaaaaagtaggtatgcattttcatgtaaaaactggatgactttcaacttgaaaccagaagccctcttcattcattcccctctctcagggtaacggcttttatcagcatgctgtgaatccttctagatcttactctgtatttacctgtatgtgtacttttaaaacgtatctatgtaggtgattgagattgatatgtgtatagctcagagggtaaagaatgaaacattttttgtctgtagctgagtccatgtttctttggagcttcattcctatgaggtgaaaaggaggggacgctcagtcacgtccagtgtaaagtggtctcaggttaaatggactttgcttagaagagtacttagcctattcaaaggttcaacctcaggcaggtgtggtggctcacgcctgtaatcctagcactttgggaggccaaggtgggcagattgcttgagcctgggagttctagactagcctgggcaacgtggcgaaactctgtctctacaaaaaaaaaatacaaaaattagccgggtgtggtggtgcatgcctgtagtcccagctacttgggaggctgagctgggaggatcacttgagctcagtagttggagttgcagtgagctatattcacaccacttcactccagtctgggcgacatagcgagatcctgtctcaaaaaaaaaaaaaagatattgtgtaatattatatatgaaatatattgaataagatatttaagttataagtagaaaaaatgagcacctgtaagagctcatcacccagtgtcatgcaatcaggggttgatatggccaatcggaacaatgagccagatggaaaggaatgatcaagccttatttactgactgctgcagagcagatgggggagatagccttagccaagaccccaaataaggaggcctctgcatggaagcaccatcgtccttcaaccatccacataaacccagggtataaaactgtgcactggctgctttctggggtccttcagctgtggtacaagtgggatacatgcagttaagactccatccccgctgggcagctttcctgagccttgggggactcactcccagtgaatcctagattgttgtcccttgctgcctgtaataaacctattttatttaacttgttgtgtgtatgggtgtcattggatctcactggactcagacaagctgataaccagtgcacagtgaacctgctttacagtggggatgccaagtccttgactatagctcctttcagaaaactgcaatgccccggctatgtgccaagtctggtgagctcccctacccatccttctgtctatcttctagaattgatgactaccctgcattttgtatatataaatcccttgatacatttatcaaaaatgcatgtattcaaagataatttgcagggtttttttgttttgagcttcataaatattatactaagctatataacttatactaagtttcttctgaaactcccttgttttcaacacattatctctaagatttcatccatgttattactaaggccaataaaaagaatccataacaaccccaaacaaaacttctctacattgtcaacacagcagggtgggcgtgggggagtgagagaccaaagaaatctgagagtgcgctagagtcttacgtgaagtacaacaactataaaaagaaaagatcatacagctgttcattatccagatctaatctgctagatcataaatttttagactaaagtttttatttcattaacctaaatatgaaaaatagtaacatattcccaacccatccaaaaaccccaaacatttcttcagatttcactacaacccttatatattctaacaatccaccaaggatttcacattatataaaacccccaggtgtggtggctcacacctatagtcccagcactttgggaggccaaggcaggcagatcacctgaggttgggagtttgagaccagcctgaccaacatggagaaacagtctctactaaaaatacaaaattagctgggtgtggtggcacacagctgtaatcccagctactcgggaggctgaggcacgagaatcacttgaacccaggagacggaggatgtggtgagccgagactgtgccattgcactccagcctgggcgacagagcaagactcagtctcaaaaaaaaaaaaaaaaaaagaaaaaaaagaaccgaaaaaaatgaacagggtgtcagtaacctgagggacaatatcaagtgctccatcatataggcagactgtgtcagaaatagaaggtggaggagaaccccaaaatttgacaaaacaatgcccaaaatttttccaaattttattaagaccactaaacatttagattgaaaaagtttgatgaatcctaaacagaataaaggtaagttcaaaaccatacaaaatcaatcactatatttaagaacagatacattatgtggtaaaaacaataaatagctaaggcaagattaatcaaaattcagtatagtggttacctctgcaaagaaggatggggaattcaaagctttaaatgtactagtagatcactttcccttctttttcttttaattttattttttacagagacaaggtcacactggtctcaaactcctggcctcaagttatcctaaggatttttattattttttattatttttcttttttccttttttttgaccttcctaacatgagtgcatttattattaaattggatatatacaaaatattttttgcaggtatgatagatatcacaatcaatggaaaacgaatcaagttcatccattcttcttctgtgttacttataacacaagtcaggaacctggaagtcacccttggcctcaccctcacctaacaaatccagttaactatcactttcctacttctccctacctccactctcacaccctagccaaagccaccttgactctcacctgaaatactgctatgtcccttcctctcccttacatccttgctctaatctaatctccatgttgcagccaaagaaaacacttaaccttatctctccatcttgaatctatcgcaccatcccctttactatcagaagcaagagtgacaagtaaatttctcaagacacctcatagccaggaaatggcagaggcaggattcaaaatctactagagtccacaggtcttttttgttttgattgttttgagatagagtctcgctcagtcgcccaggctggagtgcaatggtgagatctgagctcactgcaacctccgcctcctgggttcaagcgattctcccgtcagtctcccgagtagctaggattacggtacccgccatatgccaggctaatttttgtattttttgtagagatggggtttcaccatgttggcccggctggtctcgaatctctaacctcaaatgatccgcctgcctcggcctccaaaagtgctgggattacaggcgtgagccatcgcgccgggcccaatttgtgtacttctagtaacatcctttctccgctagattgtgacctccacaagagcaggagcctgttttgcccaccattgtagtgcacatcatacacccttgatcactctggtcctctccacgtccacttcttggtgaaaatgctaggtcaccaagcaggcctctcatcctacattccaacaacaagccatctggtttgctgaccctacccatgaggctgtgtgtgagccaggtgggctggggaacagagaccatccctggcccagtgaacccgagatgacctgctccatggaagggatctggtgccctggtagaaagacactttgagtacccaagacttcaatccctggggctagtgaatgggtcataaatgagccacttctgcccctgttcttttaataatgtccattcccctcacataggagcttggatgaagggcacctggatgtccatcccaggtatactggggccactagtaacacagacaaaggcagtgaagtaggacaaggtcagggtaggggtgagagggcaggggcaggcacagccaaggctgtggggcttccccagaggcccagataggcttgagcctgcagaggaccggcttctcttcttggcagcactgggcacattcataaatgttgtctatgatctttctgctctgcagaggcagggtgccttcatgcacttctgaatccttactgtccatgccatagtttccagaagatagacatgtccaacggtatatgtccaagaaatgtgaggtgcagctagcccccatgagtcctttgggtctgatggaggcacctccttgagaagtctttcttccctgacacatcctttagttaactccatgctcctcaccatgggtctccacagccttgttgcgctcagtattgtaggctcaaaaaacatttttctgaatgaatgtagaacttgaagactgcctctcctctgaacagttgccacgtccagtgctctcagcctggaatcctcttccttcttcattcacctgttcagtttatttcaaaatttgagggattactaggtgttacactcttactgggcccagggattacctcctccagagagcctttctgacccttccattaggggctcctcttccccatggctactgtaccgaggtggacctctgagcccccagatcaagacggtcccttgagcacagaaaccagctctgattcatctctctgtgcttggcaccagcctcgttcaggaaacacccatagaaggcaccatcttcttacggaagagaccacctctggggcagacagatcctggttgggattctagatctgcacttgatagcttggccaagttcctttctctctatcaatttcctggagtaaaacagcctgccgagtctaaatatgaggttctaaactacctggctggtttgccaagatagtcattatccccttaaccccaagggagagcaaggaaagataggccacttaatatctggtgctttgtagtccagggacctaaggaaggtgggaggagaagaagttacagtgagattcatctttatctgccccaggcttaggtcctcctctccctcctagtcctcagtcacctagaatacagagcctgaaaacaagaactaagtactggtgttttatttggagaggtgcaaacccaaggcattggaagtgagaaaatggaagaaaggcgggaaagaatgggaagtaacgtaaggtgatgtatttaataggctggggtgggcactgcttcatgacaagccttgcagaggtcacagtagttctgtccaccggctacttgggaggcctccccattgatggtactgttttggagagttggtgccatgcagcaatttatgaaaggcaggggaaaagggggaattgatttgcctgagtctcacctatctcccattttccactagtcaaaaaaaaaattttttttttgagatggagtcttgctgtcacccaggctggagtgcaatggcacaatcttggctcaccgcaacctccacctcccgggttcaagccattctcctgcctcagcctctcgaataactgggactacaggcgcacgccaccatgcctagctaatttttgtattttttgtagagacagggtttcaccatattagccaggctagtctcaagactcctgaccttgtgatccacccgcctcagcctcccaaagtattgggattacaggcgtgagccactgcgcccggcctcaaattttatcccataaatattaactcccagccagacaccatggcttatgcttgtaatcccagcattttgggaagctgaggtgggcagactacttgaagccaggagtttgagattagtctggccaacatggtgaaaccccgtctctacaaaaaatacaaaaattagctgggtgtggtggtgcgtgc

SEQ ID NO: 12558 - DNA, 42793 bp, Homo sapiens
ttctttccatctttcattcactcactccctcccttttcccttcctttcttccctccctctttccttcctttccttctttcccttcccatttcctcccttcctcccctattccctttcttccttacctttttcactccttccttcactccttcccttctccctccttccttcctctgtctttcctgcctgccattgccaggcctacaggagatgttagaggtgggactctcctgcttagggaatgttcagcctacatgttcattgtagaaaaacctgaaaatccagatcagccacaagaaaaaatgtgaatacttgtcttttctgagtgcatcatcagaaaaccaatgacaacactttttcctccacacacatacacatgtaactatagacagctttcatacaacagattcacaaaacctatactttttccaacctcattttttcatgtagcaaaatagcaaaatatctttccatactaaatatgaataatgacatgcttcaatagctgtatagtatttaactgtatcactgtaacattatttattgaaacctatccactgttatttgtcttttatatatttttctctctttttttgctattgaaaaccatgttgtgacaaacatctttgtattaacatctttgctcatgtatctggttatttctttagaaagtaaaatctagctcatgccatctataattctgtaagtgatctttcttgaatacctaattgataagataatacttaattgtgaaacagttaatgcagtttaaatacctccatgcactctctgtgatggatctgaaataaaggtaagggtcagtgcacaaaaaacaatttaattatatcttgaataacacagataactatttattaataatttattgttaaagcatacacttttttttttaagttttatttttcttttttcttttattattattattatactttaagttttaggatacatgtgtacaatgtgcaggtttgttacatatgtatacatgttaaagcgtacattttaaagaaatggtattcagacatatgagccaagaggtcctacaagtgttcaagaataaataaaatatcaagttgttcaaaacacagaaaataatctacgattttcataatgccactaatatgatagacacttttcagaaaaataaaattaatgtagaaactgccttgtacaaaattattaaattacaaattgaccaaatggaatgacagtagaaataagatgaaatgagacaagcctggccaacgtggcaaaaccccatctctactgaaaacacaaaaattagccgggttggtggtgcacatttgtaatccaagctactcaggaggctgaggtgtgagaattgcttgaacctgggaggtggaggttgcagtgagccaagattgagccactgtactccagcctggatgacagagagagctagactctgcctcaataaataaataaataataagtaaaatgaaactatgactgtgtatactgtcaatattatatgaaaacattatcaaacaggcctcaccaacaataagttctctctggacctatccctttgcttgacttactaattaggtctcagactctgtgaaattagccatgaactaagagaacattgataaattacacattattcctgtctgatagaaaagataactccaaagggtgcagttttattgcctcacaagtcataaagctgtctttaaaaacgtaacttagccaacctatttcagcctttatttcttgactgacggtataagcctccattccctgaattatcttttgataatcagctttataatcttgctgattccctcacttatgaaaaatagtaaatctttgacacatgctcactatatgtgtgtatgagagtcaagttttgaacttctgaaaaataaactttggcactacctaaagacaatgctgccaattcgcaaaccatgtgtggctgttttaaaatatgtccataaattcttggaaacttcatctttaagaaggtgatatggtttggctctgttcccacccaaatttcatcttgaattgtagcttctataattcccacgtgtcatggaaggaacccagtgggaggtaattgaatcatgggggcaggtctttcttgtgctggtctcatgatagtgaataagtctcacaagatctgatggttttatacaggggaatttccccacacaagctctcctgcctgccactatgtaagacatgactttgctcttctttcatcatcttccaccatgattgtgaggcctccccagccatgtggaactctaagtcaattcaacctctttcctttataaattacacagtcttggttatgttgttattagcagcatgagaacagactgatatagtaaattgatactgggagtggggcgctatgttacatgatgaacatggcagcatcataaaaggcattgcaatttcctcctagctcttagatcactcacctggacaaagccagccactatgtgataaggacactcaagcagccctatggagaggcccacgtggtgagaaactattttttcctgccaacagtctgtgaatgcacaatcttagaagcagatcctctagccccagtcaagccttcagatgactgcaaccctggctgacatctttcctgtaacctaatgagacaccctgagccaaaccctccagccaagccagttttctcattcctgactctcagcctttgttaaataataattttttcttgttttaagctgctaactttgctgatactttgttacacaacaattggtaactaacacaccttgacatcactattggcatttcagcactttaacactttgcctgttacccagcaatttggaactgggtaaaaggcagaggttggaacagtttggagggctcagaagaagataggaggatgtgggaaagtttggaacttcctggagactcactgaatagctttgaccaaaatgctgatagtgatatggacaataaggtccaggctgaggtggtctcagatggagatgaggaacttgttgggaactgaagcaaaggtgactcttgttatgctttagcaaagagactggcagcattttgcccctgacctagaaatctgtggaactttgaacttgaaagagatgatttagggcatctggcaaaagaaatttctaagcagcaaagtattcaagaggtgatttgggtgctgataacattcagttttatgtattcacaaatatatggtttggaattggaacctacatttaaaagggaagcagagcataaaagtttggaaaacatgcagcatgaagatgagataagaaaaacctattttctgaagagaaattcgagctggctgcagaaatttgcataaggaaagaggagccaaatgtttttcaccaagaaaatggggaaagtgtctccagggcatatcagaggtcttcacagaagcccctcccatcacagacctggaggtccaggaggaaaaaatggtttcatgggccagacccagggcctggcagctttgtgtagtctcaggacttgggatgacttgcatcccagccactccagctttggctaaagagggcaaaggtacagcttgggtcatggctttagagggtgtaaatcccaacccttggcagcttccatgtggtgttgagcctgtgggtgcacaaaagtgaagaactgaggtttgggagcctccgcctagatttcataggatgtttggaaatgtctaaatgtccaagcagaggtgtgctgcatgggcatagccctcatggagaacctctgctagggcagtgcagaagggaaatgtggggtgggagcccccacacaatgtccccactggggcattgtctagtggaactgtgagaagagggccactgtcctccagatcccagaatggtagatccaccaacagcttatgctgtgtgcctggaaaagccacagacagtgtcagcccatgaaagcagccaggaggagggttgtaccctgcaaagtcacaggagtggagctgccaaagactatgggaacccacctcttgcataagcatgacctggatgtgagacagagactcaaaggaggtaattttgaagcgttaagatttgactgccccgctggattttgaacttgcatggggcctgtagcccctttgttttggccaatttctcccatttggaatagctgtacttaccaaatgcctgtactcctattgtatttaggaagtaactaacttgcttttgattttacagctcataggcagaagagacttgccttgtctcagatgagactttggactgtggaattttgagttaatgctgaaatgcgttaagaccctgggggactgttgggaaggcatgattggttttgaaatgtgaggacatgtgatttgcgaggagccaggggtggaatgatatagtttggctgtgtccccacccaaagctcatcttgagctgttgctcccataattcccatatgtcatggaagggacccagtgggaggtaactgaatcatcagggcaggtctttcctgtgctattctcattctagtgaataagtctcatgagacctgatggttttataaaggggcattcccctacacaagctctcttccctcctgccatgtaagatgtgactttgctcttccttcatcttccatcatgattgtgatgccacctcagccatgtggaactgtgagtcaattcaatctctttcctttacacattactcagtctcaggtatgtctttattagcagtgtgagaacagactgatacagagaggaagtttaactgcccttctcttgagtatggactggacttagtgacttttttctaatgagtatgttacatggtgaacatggcagcatgtcacttctgagaccaggtcataaaaggcattgcagtttcctccttgctcttagaacactcacctggatgaagccagctgccatctaataaggatattcaagcacccctatatagaagcccacatggtgagaaactgtggtttcctgccaatggtctgagtgagcaatcttacaaacagatccttcagtcccagtcaagccttcagatgactgaaaccttggctgacatctttcctacaacctaatcagacaccctgagccgaaccctccagccaagccagttttcttattcccgactctgtctttgttaaataatttttttgtttgttttaggtcgctaggtttgctgttacacagcaattagtaactaatacagtttgacatcactattgggaagtttctactcctgttgttttttcattttccactgtcttcggtgggtatgctctcttctcagcaaacatctcagttcttcatgggctttatatgccctggaaagtgtcacagcctgcagagaagcaatgttccccgtggtgacttatcctcacctttgtgagaatggcaataaccctggaggtagatgtggcctctgctcttgctgtagagatgacttagggcaggtgtattcacctatatgagtatgtaagcagagtttattatggtaagatagtaaattcctgttagggagataaatttagtaataattaaagtaactgatattcacttggtgcccactatgtccctagaattctatagcacttcccacaatgtgttccatgagactccaatagagagataatgagcagcaagtattcccggcggcttagggtggtgtgaaatcacgctgagaatcctgcttctcctcaggtcctggtagtttcagggcccctccctaggccttacttaaaaggctgaggcatccttggaagagcaggcagactccacggatcccaccaggagaaaggagcattctgaggtatgctctagggcactggtgggactggagctctctcctcatttcagacccagaatctcctgctctgtggaagctgttctcatgctgggggactcagtgtggctgcttgactggatgagacagaggatgtgaagagccaggttggcatctagcacaaacccacagacacgggttcctccccactctgtctttctcacytctccttcacttttcctaggtatgtaaagaagacattaagaacacggcaaaggccaaatttacattgacttaaatctaagactggttcatgaccaaaaatgcatgtagctagcatggctttcccaaygcagagagaaaaaggcatggactcagctccaacagactggcgtaatgagtgcagaatatgctgtgaggttttaaatttgctgacaagaaaggttaacgtttgttacacattcactctgtcaggtacagtgataaaagcaatatagctattatgttgcctcattcccacatcagtcctctaaggtaagtgctatgcttattcccatttaactgataagacaaaacgaaaattagagaggctaagtcacctaaggtcacaaaactagtaagagatggacctggtattggtactcttgcagcttgacttcatactaattcacacccattccccaatatgaaaaataagctgtgtaatgcttataaattcacacatttggaatagaaggcagagctcgaggctgggggaatgaaggagtctgcacaaaggaccaacaggctttctaagaagataatagaaaccagccaggtgcagtggctcgcacctgtaatcccagtaccttgggaggtagaggcgggcagaacacttgaggccaggagttcaagaccagcctggcaaacatgaagaaaccccrtctctactaaaaatacaaaaactagttgggcatagtggtgcacacctgtaatcccagctacttgggaggctgaggcacgagaatcacttgaatcccaggaggtgaaagttgcagtgacctgagatcatgtcactgcacttcatcctgggcaacagagcaagactctgtctcaaaaaaaaaaaaaaggagagagggagagaagataatagaaaccaacagagttggtgcagagacaaaggagtgccccatagcagagtgtggcacactttgggttggacggaatttatcactccctggagtgacttttggtagctgaggacatccgtgaaagtccttcctggagtaggagtgatggtgtgcatgcacagacacagcctccagggagccgtgagcagaaggggacctccagctgcatccaggactcyctctccaacccagccacatcagargggaagggtaccacttggctcatagcgctttcgagaaaccctggatgccagtgaagtcatggggaggctgtgggccaggatccacagggctgcagctgggtgctgagccagaggccagtggctttgttgcctgccctcagccccgtggcaccctctgcctgggaggctggggaagggccaggtgcacaggccgggatctgagagagcgcgtgggcagtccacagggcaggtgaggctctgagagagagtgtgggcagtccacagggcaggtgaggctcyggtgtgtgtcacacccacagtttctgctgactgagtcccatgaacagggccagagccaccggcaacttctgtaccccagatccacattcaggcgctttcctcgtctgtgcctcagaggcttccagagcctgcggactcgcctccgccggactgtgtagtttgaccattgctctccagcaggaaactggaaataaacccagggctaggcactggcygagctccattctccccggtcctgcgctggcccctccggcggggcctgccgctctcagtgtgccgggccaggatctaccggcagggggcgctctccaccaggctaggtcgggaggccacgatgagaggcacggcctccgattcaaggatcgggaggccacgctgagaggcacggcctccgattcaaggatcaggaggccaggctgagaggcacggcctccgattcaaggatcgggaggccacgctgagaggcacggcctccrattcaagctctcttcctctttttctgtctctttccacaaggatctgcagccctcacccgagtagcgagcatctaaagcaggactagacgaggcaagggagctgcaccagggctacccctgagaaagccccagctctcctyggctttctcagtgatgtgtggctttcgtgggctcctcaaaaacagaaactatctttttttattattattatctgtccctttttgctgtttttgataacttatttattcgatagatgtctgcacatttgcctcttttgatatatctttaaattgttattattaaatgtggtaagatatacataatataaaaattaccattttaaccatttttaagtgtacagttcagtggcattaaggacattcacattgttgggcaaccatcaccaccatccatctccagaactcttctcgttttgcagaacagaaattttgtacctacaaaacaataactcctcactcccctctccccagcggcccctggcaaccaccattttactttccatctctatgaatttgactgctttaggcgcctcatatacgtggaattacacggtatttttttttttttgttattagtttatttcacttaactgagtttactttcaagattcatccatgttgtagcatgtatcagaacttcattccttttaaggctgtrtsgtgtgtgtaccacattttctttattcgttcatctgtcgatggacacttgggttgccatcaccttttgggtattgtgaataatgctgctatgaacatgggtgttcaaatagcttttcaagtctctgctttcaattctttgtgaatatacccagaggtggaactcctggatcatatggataattctatgtttaagtttttgaggaacaaccataccgttttccacagtggttgcaccattttacattcccaccaacagtgcacaagggttccagtttctccacattcttttttttttttttagacggagtttcactcttgtcgcccaggctggagtgaagtggcgtgatctcagctcacttcaacctctgcctctcaggttcaagtgattctcctgcctcagcttcctgagtagctgggattacaggtgcacgccaccatgcctggctaacttttgtatttttagtagagacagggtttcaccatggtgaccaagctggtctcaaactcctgacctcaggtggtccgcccacctcggcctccgaaagtgctgggattacaggcataagccatcacgccccacccaattcctccacattctcatcaacacttgttattttctatttttttctaatagcaaccatcttaatgggtgtgaaatagcagtatatcattgtggttttgatttacgctttcctaattattagggatgttgagcaccctttcatgtgcttattggctattagtatatattatttggagaaatgtctactcaagtcatttgaccattttttaactgggctatttgcttttttgttgttgagttacaggagttctatatatattctagatgtcaaccccttatatgactttcacctatttcctcccattccctgagttaccttaacatactattaatagtgtcatttgaggtacagaagttttaaattttgatgtagtccaatgtatccattttttcttttgttgcttttgttgcctattttttggtgctatatgcaagaaatcattgccaaatccaatgtgataaagctttcccctatgttttcttctaagggctttaactttcatttaggtctttgattcattttgagttgatgtttttatgtggtataagataagggtctaatttcattcttttgcatgtgcaccatcaccacttgctccaccatcaccatcatcacccaccaacacaactgccatcatcagtatcattattgtgtgatgcttcctcttcatcatcattaagaagaacaatagctagcatattttaaattattaaacatttttaaaataaattcaattgctttcatagaaatgggattactcaggttacttacttcttctgtgggttttagtagtttggctttccaaatgttggtccattttatctaagatgttaaatttatgggcataaatttgtttgtagtatcctcttattacccttctaaagtatgtgtaatcagtagtgatgtccctcttctattcatgaaactggtaattagtctcctctcatttttcttgattttttaataatcagattttagcttcattaatattctctactgctttctgcaatcaattctattgatttttgctccgatcttataaatttctttcccactccttgctttgagcttgttttactcctttttctagtaccttcaggtggaatctcaaattattaatttgacgtctttcttcttttctaaacatttatgctatttttccaagcatgatttagttgtatcccacaaatttagctataattttgggggtgttttttgttttttgtttgaggcagagtctcactctgtcactcaggctggagagcagtggcgagatctcagtccactgcaatcttcgcctcccgggttcaagcaattctcctgcctcagccacctgagtagctgggattacaggtgcatgccaccatgcctggctaactgttgtattttttacaatttaatacaattacaattgtattttagtagagacagggtttcaccmtgttggccaggctgaactcttgatctcaagtgattcaagtgattagtatttgcatgatacatctttctccaccttcttacctttaaactgtctacagttttatatttcaagagggtttcttacagacgctatatatttagatcttgcatttttatccaatctgacgatctcagtcttttacctggcgtgtttttatcacttacatttaatttgagtattaatatggttggattaatatctaccatcttgctgttttctatgtgttccatctgttttatatttatttttcttcttctgtcttctcctgagttaacattttttattattccattttatctcttttattgacttattaattataccattatatatttatattggttagtccagggcttccaatacatattcttaattaaagtctacctttaatttttttataccactttaagtctaccacaaggaccttacaacaatatatttccaattctttctttctacactttgcattatcattgtcattatccacaaggctggggataaaaacatttcaaaggtcacaatacctgttcccactgtctggcctggaaaaccttatcattcccaaggcattggttacagtattcagaaggatcttgcttaagtaatggaaaataactagacctaaactaaatgcttctcaggttcaacctatcaaatcctaaaatcaagtcccaaatggatcaaattcttgccaagagccttaattacactacggaattaagctcaagaatattcatagtacaagttgagcctccctagtctcaaaattcaaaatctgaaatctttcaaaatccaaaactttttgagcaccaacatgacactcaaaagtcatgctcgtaagaaatgctaattgaagcatttctaattttgaatttttggatcagggatactcaacctgtaatacaaaagtacccaacacccttggcaaaatggctgaatttgggacgggcacagaaaatacacaagagcagcctaagcatgttgttgtaacaaaaagtaaggaaatacttaaaaaaatccacagtgattggtatgtcaaaggaacacaggagctaaataaaagtgcttccaatggccaaagctggaacaacttaagtagcaaaataaataaagtagcactggattataatttaaaacataaaacaaatatcagtgagcaccagctgactaaataaataaataagacagactaatctcccatgcaaaataattccaaattatttatttagctatccaactctcaagaaattacaacataaccttcaggctctaagtgtgggctacacatagtaacttctctgtaatgaatatagtatggaaatgggggtgaaagagtaactttacagtggagaaacctaatgaacactatctcagccaggtaatcaagattaacatcagcagtaataagttatgttgacagtatgtaccttagatatgatatataataaaaatagcattttatctctgtgatctccctcccccaaacccataaccctagtctaatcataagaaaaacatcagacaaatccgaatctatttactgtactcctcaaaaccgtcattaacaacaaacaaagcctatgaaatttttatagcaaagaggagtctaaggagacatggtgactaaaagtcttatctttgatggaatggtggaacaaaaaaaggatattagataaaaactgaagagggcaggcgcggtggctcacgcctgtaatcccaacactttgggggccgaggtgggcggatcacgaggtcaggagatcgagaccatactggctaacatggtgaaacaccgtctctactaaaaatacaaaaaattagctgagcgtggtggcgggagtctgtagtcccagctactcaggaggttgaagcaggagaatggcatgaacccgggaggtggagcttgcagtaagccgagatggtgccactgcactccagcctgggtgacagagccagactccgtctcaaaaaaaaaaaaaaaaaagaaaaaacctgaagaaaccagaatataaactttatataataataatgtatcaatattggtgtattcattgtaacatgtatgcaaaacaaatgtaaaatgttaatacacaatctttgcactttttctgtaaatttgaaagctttccaaagtaagaatgcattattatgtattaaaaaagtacttagcagctaacacagtaaaattacagtgtctgacatccaaygcttacaagaaaggcaaagaaacaggaaattcagacacagtatgaggagaaaaattaatcaaagccaacccagaactgatacagatgttaaaatgaacaaatacacattaaaatgttatgtctaaattctgtatatttaataatttaagtagagacatgaaagagcttaaaacagactcaagtcaaactccaagatgtaaaaactgccatgtctggaatgaaatatacactacatgaaattagcatacagaagaaattattagtgaatttgaggacatcgaaatagaaatgttccaaaataaattatgaagtgaaaaataaaaataaaaggacatacgacacatacaagaacagagaatcagtgatatatgggactaattcaaggggcctaatatatggaatttttaaaggaaaagaggatggtgggaacaaagatttttttcaaatgttagccaaatattttctaaatttcatgaaaaccataaacacaggttcaagaagattgatgaccccgtgcacatgaaatatgaagaaaactacagcagcaaaatcataaacaaattgctcaaaaccagtgatactgagaaaatcttaaaagtagctggaggaaaaaggacacaatgcatacaaatacataaaaagaaggatgacggcagattttttgtcagaatcaatacaagtgagaaagcagtagagcaacatatttgaactactgaaaaaaacattgtcaattatgcttttgcggttataaccagcaaaaaatctttcaaaattaagatgaaataaatgtcttttcagacacacacagaaagaaaataatactgtatggaaataagaattttaatacagaaaataagctccagaaatgataactatatttatacatatgtgagatttttaacttaatatttaaatccctttaaaagataattatttaaaaaacaataacaaggtatcattaggattataacatatatataagtaaaacgaatgacaaaaataggatatggtttaggaggggagaaatgaaagtatattattttactatgggagactgtgacaaattaaagatggatactgtaattctaaatcaactactcaaacaacaaaataattagtaatcactagtaagttaacagaggagataaaattgaatcagaaaatgttcaagtaatccaaaaggactcaggaaaaaatggaacaaagaactgatgacaaatatagaaaacaaataacacgatggtagacttgaacctaaccacagcaatagcaacattaaatataaatagcctaaacactccaattaaaagattgtcagattgaattaaaaagcaaaactttactagatgctaccaacaagaagtgcactttaaaggtaaagacacaattatgctaaaaggaacatgatggaaaatgatataccatgttaacaccaataaaaagcaagttggagtggctatattaatattagacaaagtgagcctgggcaacatagtgagaccttgtctttacaaaaaataaaaaaaatagctgaacatggtggcacatgcctgtagtcccagctactccagaagctgaggtggtaggatcacttgagctcaggagttcacagctacagtgaactaatgatcatgccactgtactccagcctgggcaacagagcartgtttctaaattcacacacacacacacacacacacacacacacacacacacacacacatatagatatagatatatcaaagtaaattgcagaataaagaatattgccaaggataagaagtttatttcacaatgattaacagtacactgacacactgaaaattttaaaatattgctaaaagaaagtttttgaaaggccyaaaaagccagaacgatatgccttcctcaagggtcagaggattcaatattattaaaaagtgaattttccccaacttgacctgtagatccaatacaatcccagtcaaaatcctagcaggcttttattaaagaaattgacatgctgattattacatgtggcattggcaaaaagatagacaaataggtcaatgaaaaaggatagagtccagaaatagacttacacatatatgaacaactgattttcaacaaacatacaaatacaaccagtgtggctgggtgcagtggctcacacctgtaattccagcactttgggagacctaggtgggcrgatcacctgaggtcaggagtccaagacaagcctggccaacatggtgaaaccccttctctactaaaaatacaaaagttagctgggtgtggtggtgcatgcctgtaatcccagctacttggaagatagagaattgcttgaacctggggagcggaggttgcagagagctgagatcgtgccatgcactccagcctgggcgacagagcaagactctgtcttaaaaacwacaacaacaaatacaatcagtggagaaaaaaataccatgttcaacaaatggtgacaaatcaatgagatattcatataatgacaacaaaaaggtgaattatgatccatttcttgcagcatatggaaaaataattcaaaattgatcataaatcaaaatggaaaacataatctacaatgcttcataattaaacatagaagaaacctttttcattctattaagcaaagatttcttagatacagtgagaaattatggtacgtatgattttttaaattgctaaatttgactttattaaaaacaaaaatttctttttgaaagattctattcagagaatgaaaagagaagtcactgactgggaaaaatacttgtaatgtatatatctgagaaaggacttgtatccacagtatataaagaactctcaaaacttaataaaaaggaaacaaaaaagacaatttttaaaatgggcaaaaacttagaacagatatttgtatcaaataatatatacagatgaccaaaacaaaaagcctacaaaaagatgttcaatataattagtcattgggaaactgcaaataaaatagcaatgagctattagtattgcttacctattactattgctaaaattaaaaagactagctataccaagtcttggtgagaatattagagaaccagatctctcacataatagtgatgaaaatgtaaaatgaaaaaaaaaggtagtttctgttaaagttaacatataccaaccctatgatccagccattccacttctaggtattaatttaagagaaaagaaagcatatgtccatactaagacttgtacatcaatgttcatagtagctctatttgtaatagccaaaaagtggaagaaaccaaatttctattaaaaactgaatggaggacaattaaaaggaatgactattggaacaacttgaatggatctcaaggaaagtacactgagtgaaggaagccagacaaaatcaattatatactgggggatcccctttatataaaattacaaaacaaatgaaaacaaacctatagtgacagaaagcagatctgtagattcctggtgaataggacgggggatgggagggaaggacagaytccaggagacatgaagactctttgggggatggtgaatatgttcatgattttaattttgatgatggtttcacaaacatagacatatgtcaaaacttatcaaattgtatattttaaatatgcgccgtttattgtgtgctaattattcctcaataaagttaaatttttttcaaaccctgagtgcaggattaagggatatagctagcttaggcattctaggaatgacctattatgtgtccctgaatagtgagaagctcggaaaggcaagacgactcctgccctaatagaggttccattctggatacgacaacatagggtgacaggtgaatgaacaggtgcctcagatacagcccttaaaacacttcaggtgctgaaasccatggctggtgtcagaggcacctcctagtggttgtccttatgaggtgaagtcctgctctctttcccctgatgttccatatcagatgtcctttgtcactactgtcagctccctggaaaaagcctcccagcatccttgagggtaatgccaccccctttccaggcactgagacctcgtcaccatcatcccagaaagccagcccattttaaaaattagattgttaactcgggaggctgaggcaggaggatctcttgagcccaggagttcaaggctgccttgcactgtgattgcacctgtgaatagccactgcactccagcctaggcaacataggtgagaccctgtctctaaaaaaattagattgcttaactttttatttgtcaattataccagttctttatatatgttgaatatcagttgttgatcagatatatgtctgtgacttgctacttgtttccttaacagtgtcatttgatgagcctaataagtaagtttttattttaacaatgtctagtttaatctttatttctttcatggttatttctttctgagatctgcctaagaaacctttgctcaccctcaagtttaagaaatattagccttttttctctaaaagcgctaaggttttagctttcatgtttaggtctgtaattcacctcgattaaattttcagtattatgtgtgaggtagggtttgagattcatattttctcatggatatctaattgttctggcactgtttgtttaaaaggtatctctttctcccactggatcactttggcatataggctttctattcgatttgattgttttatttatcactcctcatgctgctagtaagacattgtcttgatttttgtcattttgtggtacagatagtgatttcttggatcatctttctccaagcttgtttggcattttctttcctttcttcttcctttttttttktktttgtggcaaagtcttgctctgtcacccagggctggagtgcagtggctcaatctcggctgactgcagtctcaacctcygcagactgaagtcatccttctgcctcagcctcccaagtagctgggaccacaggcgcaagccaccatgccccactaatctttgtgtttttttagagacagggtgttgctaagttgcccaagctggtcacaaactcctgagctcaagccatcctcccaccttggccttccaaagtgctggaattacaggcgtgagccactatgactggccagcttggcaatttcaaccaaaaaaaaagcctagtgctattatggtagagatgtcatggaatccatagactgacatcttaaaaatattcagtcttttaattcataaacatggtatataccttcaattatttaggtattctttaatctctctcagtaacactttgtagtttttggtgcacaggtcttttatatactttgttaaatttattcctaagtatttgaagtttttgatgctatgtaaatggatttgatttttgctttcattttctgatagcctgctgccagtatataaaaatacagttaacttttctataaaaaatagtgtatcctccagccttgcacttattagttctagtagttgttatgtggatttcttaggattttctatataaacaatcatattatttgaggagagttttacttattttctgatttctatttcttgtgtatttttagcagacttctcaaaatgactaggacttcaaatacgatgttgaacaaaagtggaaaaagcaaacattcttgacytgttatgaatcttagggaaaaaaatcaattctttcaccattaagtatgwgctgtagacttttttttcttgggcactattttaacatgttgaagttttcttctattcctagtttgctgggagtttatatcctaagtagatgttacctttggcctaatactttrtctattaaaagatttaggtggcatttctcctttattccattaatgtagttctgctttacaattcttgtctggacaatttcagcaktggtcttcattgatgatctttattcttgatgyggagtcacatctgttcccttattcttcaagaaagactattggattttctacactgtgcaacttcagcctgcccaccttaygaaactttcaaaaatgggaaattgacccatgcagatgattttccccgagtgactactccctccaggatctgcctgcatgccttgtcttatgcttattcaccgatgtcagcagtttcccaccccttygctatctgacccaggtcttatagctgtttttgtaaaagtcctgatccaatacaagccaactcagtgacacaaaaataaactcgtgcctttctgttttaagaaggtctcttttaatggagaattaaattcatttaaatggactgtggtttctgaaatatgtggatttattcctaccatgctttmattttttctttgctttttttcctgatacctctttttctgttcctgtttctccttccctttatggcttcaactggattgagtaaggtggttttgtttgtttttcctttgttcatcctcccctctagtttggaagttatatactctccattaatttaatacataatggctagtatatttatttctaggcctcttcagatgagaaatcagtgtgagcctaagactgtaatattgtaaactctattttatcagttctccttgacttaactaaacacaaagttaatcagtactttaagccagggaactgtgccacggtgagggtggttgcaggggtgggatagtggccacttcctggagtatttggtttttccctctttgggtgttccctgagttttgtgactgggacaccctggggatctttttgtcttataattgtcttagtgaggggtcaagcaagagcaggttccagtgctctgtgcctgtctcatccctcacagcagacaccgactatatccttgaactcccaagatgaccagagtgagtctcatatccaggggccaacctggactatgctgatatcccaatctagagagaggargctggatgcagaaatccaaggccaacctacttttccttccttctcatcccttaaacttaaaggacagaacccacgacgacttgccttcactctggtgagaaagggacatgggaaaacatggttaatccagtctgaaactgacagtctcccactgagtcactcactgtagaacccatcacctraaacaagcatagatggagatcaggcattgagaggacagcctctctccaggatgtctctgaattaatgattggctctgcagctcaatcttttatcctcatctctgtctctttgtctccctctcctaccactagtccttgaagccatgaagtttacatcttctctcagctctctgggattataccttccaaaagtaactaaccccacagcctgccatctgagcttcaggcttgaagtcattactattctgtatctgcccctacattaaccaacctcctcagtgtgtggccaaattggactgagacttggggatgtcacccagaaccgcacatctcactctgcacaaactaccacagtggagcaaccagcagtcacagctgcgcttgagatctcccaccaggaaatacttacttttcgaaactggaccttctaaagaggaagcatgaaggagagatttgctgaaagcaaatgggaaaaacctagaaccatttcagacttcctagtatgaaggctcatctatcttcacagaaatagaagtggcacaggatgaagtctggtccagaatgaccatactagacactgggcagatgtctgagcccrgtcagcagtgaggagcactctggaactgggagtgaggatctggtccaggggtcctgttctcagaaggcctctctttcaacaacttgtagcaagaagaaaagcatcatccctgtctggaaagtgaaaagcccagatcccaaactacctcctggcccaaattatcagtacaatctgttctctggaaatatctcagtcccacttaaggttttgtaaattccagggaaggaccttgaagctataatttaacctaaggaggagcagtactaccagacttcaaatgtcagcgtcaaatgctcgtcaaaaactcctgttattcagatctgccctaattgtgaagcataaattaaactaaagaaagacacacaaattatctatgcaaatttagtagtatcagccacccacttctttaattaatctgacctaatttcaaatcaacacgtaaaatgtagtatataatttgatgagaatttacctctacagcatagaatctgatggttattaaggccaattgcctaaaaagtacttacatgtgtacaaaatgacagaaaatattaaaggacaatcataaggatatagaaaactcctctatcattcatattatggtataaagactgtacaaaatcagaaagtatagaccatttggatttttttttttttttgagatagagttttgctcttgttgcccaggttggagtgcagtggcgtgatytcagctcaccgcaacctccgcctcctgggttcaagcaatactcctgcttcagcctcccgagtagctgggactacaagcatgtgccaccacgcctggctaattttgtatttttaatagagatggggtttctccatgttggtcaggctggtctcaaactcccaacctcaggtgatccgcctgtcttggcctcccaaagttctgggattacaggtgtgagccaccacacccagcctcaattggattttctaaatgagctggctcttctaaaaaagccacaaagttgtactctctattctgttccagagaatccacaaaggagtatcattgaactccaagtaacaggaaagtgactttatgctgggaacatccctggggcctgtgacacggaaggacatggataggtggacacacagcctcgtggacgttgagagccataggtacctccaactgtggtcgctgatccacacagatgctcacgctcatcatgggaaggtacagagggagcggccacctggttcttaagcacttctgagcgcacctaagagtcaaaggagaaattcagagccaaggttccctcaactccatagtttcgactggatcttagcacttgtgctaccacagttactgtgactctattacattccccagactggagaatcggagcagcgcaaattccctgcaggcaggatgcaggcaagataggcaggctacacagggcagtgccgtcctagattttgtctggcccagatgcagtcccttctgactggctgaatcaccaaggctgggcctccgacatcatccacctaccttcacaccaggaaaggaatatctgggctctcagcttaaagaatcaggataaggcgctctgggcaggatcaaatgcttatttattctatgcctcacaggcttctgaaggcctgagtttggcctatccaggaattaagctattttagcacccacagaaatgtgttcttcctgggggcaggaagaggaaattcctgctcattactgactttgtcaccagaaggacagagactgaggcagaatctccaacctgggaatgaaaactgagcttcatatcaagggttggatgccctcagctgcattcatcagatatttggtttttctctctgagcaaaaagagaaaagatgccatgrggtgtgtctgaataagccctcctaagtttcctatatttatctccttaaaggagactcagcacccacttcatgaaaaaaaaaaaaaaagcaaggtgttttcagataaataaaatgagggcatggaacgtgactaattagttttaatctttttttttataacaacacatgtatattgctttaaaaataatatagaatcaggcctggtacgctggctcacgcctgaattccagcactttgggaggcagaggcaggcagatcatttgaggtcaggaattcaagaccaggctggccaacatggcaaaactcatctctacaaaaaaaatacaaaaattagccaggtgtggtggtgcatgcctgtaactccagctacttgggaggctgaggcaggagaatttcttgaacccgggtggggcggaggtttcagtgagccaagatcgcgccactgcattccagcctgggcgacagagcaaaagaaaagaaaaaaacaaaagaatcgaaaagtgcaaaattaccaacaacagagccctgaccatttcttccccaccaaatcctactctcctgaggcaaccacttcccttcttttatctcaatcctctgatcagtcaggaaaggcattgtctatgtcagagacacagcttcatcctgggaatcttcacacctcctccctgggtgaagccattattccatgactcttgggattgccttcttcttaatctatttctgtttctaactcatttatttatctcacccatttatttaccatcaagtcatctaggtataaacatcaaaatatttttgttttttccttttcttcttctttaatttctactttcgatgttgctatattcacttgctttttttctcactggatatcaggtcctctaacaacatccctgccaaacttcacaactttcttgttgctattattattttttttttcagaagagcttctcaagatggtgggcataggcgaatggatcatgtacccctaccagtgctgagatgttaggggccaagaaaaagcacaggaaaggcagagttcttgcagcactggctttgggtttgcagagggaggggttcccacagtttctggtacagtctgatttcattttatttcagtacaccgtgtgtgtagtttcttggacagggtgactgaccatcagtgtcaccctgtctgtcttcatcattaagcactctcaggacctgaatagatcccagattcaaattcttttcatggttggacatcctatcacttgacccattgatcccttggggaaaatctcatggttccaacccttctgccaaccactggcttctttgcatggagtcatgagagccttcagtcttccacactttaaatgtctaaaagttctgagttggggtgggagtttctgccaagttcttccaaggaatgtgaccccatagtttctttaggctctgctggtgctgggaaggttagagccttgtctgtatctctagagtacaccacacttcagtaaaatcacatcagggtctccctgaactccctcaccacacactgccctggccaaggagccaaggtsagcctgtgggtctctaggtgtgccagtcatccagatgrgggcaaagctgccagtcccactgactgtttgagtgattctcttgggaggctccatcctggcgataggagagcatcccctggcccttctccatgaggaggtcaagaactcacctctcaccacaagtgatgcctttcctacaaagcatcccactccccttttctcttccctgtcttcctcttattcatgagatactacatacatttatttgtttatcaaaaaatatttgttagttcccataagaggtccrcaccattcctgccactgagcacatagttctctggcctcaagacaaaacaggttccctggccccacagaactggcattttggtagtggagataataaataaataaatwgatggataaatacrttttccaaaaccatggaagcatacattttatgaagaaaatagttgagcaaaataaggggctaggacatgggtgagggactcttggagataggctggctggggaataccttattgagaagttggcttttttgcatatgcatggaagaagcgagggagtggaccacttgttgacctggggaaggctgttccttcagaggaacaggaaaaactccctgcaggcgaagataagcttgcagggcaagaaaatcagcagaatccagtacatccagagcagggaagtcagatgggcagggatagaaggcagcagaaagataaagaggacccagatcatgtgggcttggtgagggctttggttatttggggcataaagcaaagctattagagggttctgtgcaagagagtcatacgactttatttacatctttgattctggtcactgctaggtggacatctgactctagggaggtaagaacagaagcaaggagactattgcaatgctccagaagatagagtcaatggtggatttccaagagcagaaccacaaagagtgattgggagtaggactgascaataatattcggtttcaagagtaatgattttctttcatagccaacattgaagccgcgtctgactcctaattcagagttagaaagccacaagacctccaagttctctcctctcctctcctggacacattatagatttttcagtatcctcaactgaatgcaagactgtgttccggctagtgcagtatgcaggagactatgacccaggggaggcatgtcacataatcattaagaatagagagacttggcttctaacttggctagatttcttagtagctgtatgactttggrtacattctgtcatccctcagagccgctgttttcttacatgagaaataaaattaatggcccctaaagagttgtgtgtgggacgggcgcagtggctcacgcctgtaatcctagtactttgggaggccgaggcgggtggactgcctgagctcaggagtttgagaccagcctgggcaacacagtgaaaccccttctctactgaaatataaaatacaaaaaactagcccagtgtggcagtgggtgcctgtagttccagctactcgggaggctgaggcaggagaatcacttgaacctgagaggcggaagttkccatgagccgagatcgtgccactgcactccagcttggcgacagagcgagagcgagactccatctccaaaaaaaaagtaaatgtagcgtgaagattaaaaggttactcaggtaaagctcttacaactttagcagaaacagaataagctctcaatatttgtaccatataaatgtgacatggtgggtgtgtaaaactcctgcaaggagtactgtgattggcctaacatcagatgcaaacacagcaatggcttcatgcagtttagtgggtcaagagagccacacctctgcctccaagggagacacacctctgcctccaaggaagaccagtaaaggcaytctcctcaactcagcatctggcctaatccgcatttcctcattgctgttttctgatgttgcctctgctcttgttaatcaggaagcacagaccagtcatgcttgtgttgctccactgtcagtcctccagagcctcaagagatctttgggccatatcagctttctttccaaaatgaacacacccaggggcaggaaagaatgctctttccttggtcattaaggggcctgggagtcctggaccagcttttcatgcagctagaccacttacatgcaactagagccttgactttgaaacsarggacaaaagcatctcttgctaaaggtaacttctgctgcttagaacccaggtatggggaacttctttcatgtctctgtgtttagcctcgaagtgcctctgggagtcttgtcaaaggtacagagtactgaaggatccagggctgcttacaagggtgcaggttggtgatctgcttatccactgtgtagggacaactattgaatcacacatcaaggatcctgagagaaggagggttgtgaacaactggttctcattgtggagtgtctgtgatattcttggggactgttctggtgccctaactagaaaaccagaggcagatgatccctaatagtcaaagcaccttgtggggccctcagtggccatgtgcatgatccttacagatgtctctttggatgaggaatggaagaagatgggctcagtgaggcaggttagctacaaattacttaggagtgttcagcttcaagtcaggaaaagtggtgattaacctgctgtgtggagggctaaaatggagatacacacacacacacacacacacacacacacacacacagacacacacacgcactctgtctctccctccttcctctcaacccagagactcagagtactagaaggtgccygtggtgatgtgttggaacctcctaacaatcccagatgtgattaatggaaagcataccaagaccatcacagcctagagaagcaggactgtgccagccacagcagagatgggagcttccttttagggttttctggccttgaaatgtcctgtacccatccttattctcaaatatgcatctaggagaggctctcagggcagctctctctaaagaatttttacagtaaaattttagggggagaggagaaaaaagcataacatgtttcttctctccttctctcacatggccaactgttaacagcctcctcaccaccatctgatctatcttrttctcttcacaaaaggctctgaagacatcatgaacccacaacgtaagtggtgaattgcaaatcagcttggaaatatctccatctgacctcatcaaagacaataggatggaaggacccctatcatttgctaagctataaatgtatttkctcttgctaaaacactcagttcctaaaacggcctttgaaaatctcggggcacctagctcttttattattatctgtatttagaattgcttgtttattttgatgagaggattttaaaaaacaacatatrgataactaatttaaatattatggrkttttttttaccacctagacattttatcattcggaaaaagacaagtcactaatagccctagaaaaaggtgaatcttgggactgtgactgcacgtagatcctttcaaatgctttgattcacaaactagtccctgccctatttcccctccatttatcgttatagccactacttctcagagcaatgagwctctctccagaaactcaaaagccattaataccaggatgcaactggagtcctgaagttgataacctcacgtgtattttgtgcatttttgtcatctggcaggggaggcagcacccaaatcctatgctattcgtgattctcgacagatggtgtgggtcctgagtggaaattctttaatagcagctcctcttagccgcagcattaagcctggtgagtgacaatcaaacccactgttgcttcttgasgtgatgccatcttcaccaggaatgaggctgagcttgcataagcctggccctggacctcacccacttctaggcaccagcccaacagccacaggaaggtcaagtgagaaaggacactatgattcccttccacaaaggaaatcccatatctagaaatgagggtgtgaagggttgacagctcctcttaccaaaagaaaatatcttcagattagaagggcttatccattcaaacaacagctaaccttctccttggagtttctctccttcaggttccaaccattgctacctgtgtcctcagattcaaactccgtcatctttccaccaccaaacctacacagctttctaagttggcatcctcttttctaataatggggaaatattcctttctcccatcaaaagtcagtccatctcagcttctttccctgtatccagaacttcaatgtttaattcctcgcttccctgcaaattccacctttgtttactggaccctttctatcattgtcagacatgctgcaaccttctcttgattcccacattttcctcctactaacacattttcttgtgccaatcatagcaaaacttcacgagagctggctgcataatttgcagtctaacatctggattactcttcctactcccccccaaccttctatttcacccatgaccttcaaatactcaaacccaaaggacacttcttggtccccatgctatttggcccttagctcactagtgtaatggaccatttccttcttgaatactctacatcttctcccttttttttttttaaacggagtctcactctgtcacccaggctggagtgcaatggcacgatctcagctctctgtaacctccacctcccaggtttcaagcaattctcctgcctcagactcctgagtagctgggattacaggtgcccaccactgtgcctagctaatttttgtatttttaatagagatggggtttcaccacattggtcaggctggtctcgaacccctgacctcgtgatccgcccacctcagcctcccaaagtgctgggattacaggcgtgagccaccgcacctggcccatcttctccttctattagaatattacttctcatgaggtttgctggctcctcttttgcattttcttttatgactctcctttgtctctgaaatctccaaatgatggcgttcctcagggctcagccagtcatcatttacaagccctgtgaatgggtaatgagctgatcttttgsattgatgaatcacccctacactcattcactctgccgtttacacttccaacacagatctcctctctcaatagtttacccgtgtcctcttgaggtcctctcagatacctctaacttcatgtatcccaagtgggactattgatctgtcttctcaaaaccgctaacattctctgttggtggcacttctgtccactccatttcctcgagccggaaatacaggagacatccttgattcctcctttccctcactctccatccaatctattagcaaagattggtaggtctacgtgcaaaacatgcctgatttctaagataacatcatctcttgcctggaccactgccatcacattctcactacccacctctcactttatttgggtagcccccatcccatctcatattgtggcccatgagatagaagctccccacttttatctcatgggccacatcttaagcatatgaccacattttgctgcaagtgtggtaggaaattttacttctttttgggaagcaacatgtcctggtsacaactggggttctgttattaaggacgaaaaacaaaataggtttgaggagggtgatggagggtctctgccacatggctaatgggaggagcctgtcactattccctacctggggggagtaactgagtgtcagaccagaaagactgaaacatcttctccattttcctttgtgtttccagtcactcttcatttaatagcctgtagagacacagaattcagtgacaaggaaaagggtaatatggtttacctgggaatcaagggaaaagatctctgtctcttctgtgcagaaattcagggcaagcctactttgcagcttaaggtgagtgattgygcagctaacgagagaagtactgtcatatggactttctatttcatttactatgttactgaataaaaataatatgcttgcaaccctggactattcaatgtaaggaaataattctgacctggctgatccctgaatctataaatgctgcctttggaatggatataacacttcttttaatgtcagagcatagatcctctgaaagatagaaaatacacttacaggaatgtttcagaaaagccaaagaacagtattttctccattctcggtcctgtttaactgcattctggaaatcctctaagacaacgggatgctctcactacaccaaaggtgactgcacagcagaggagacaaaaagattttgaatgtggttatggtctgtgtaccataaacacataactcttaccaaggcaacattgtagttatgaagctaattcttctgctattgttggaaattgtaatgcataagcccacttggaggttgagaatgcagcaagactggcctgaacctgcagacaaatgcatatcaaaagcaccaagaaagagatttcaacctccctctgttccagggaagacagtgatgcttcaaagagtcagagcaccttgtgtcagaggatcctggggtggagccaggctatgggaacccagtgagttcccgtttttaacastctaatgccctgcttcatctgcctttgtccctagcctctgtcccttcctttgggggcagcagtccctctcctgttacacactcagagctgagttactttagcttcctcctcctaycctcctctctaacaagcctcttttccacccccaggaaaaaaatatcatggacctgtatgtggagaagaaagcacagaagccctttctctttttccacaataaagaaggctccacttctgtctttcagtcagtctcttaccctggctggttcatagccacctccaccacatcaggacagcccatctttctcaccaaggagagaggcataactaataacactaacttctacttagattctgtggaataaatccagcctaggctgtgggtggctggttccaggatagagaatcaagctgtcagagtcatcttaacagatcattatgcgactgagttcactagcagttcagcccatccatagcttacctcattcttactatccaaaagccacctcctcctccaaacatccatttctgtaccaagaccctcactcgaatgtcactatcccaagatgaaacctaaaaatyactttccattctttcttgatcttaccccaccatccactcagctgccatgcccagtttagtyaaccccccaaatgctgcttcatgcaaccttccattcctattccttttgccaacccatgatgtagagatgtggattcatgacattttgttcatacaacttcttcaataaaacattataatatgtgccccaaagataaagctgaagaatgagatgaatgtgaaattaaaggtttgcatgtcttyctaatcctaatgaattcttaatgtcattcgttaataatttgacacacagtgtatacacttaacccttgaacaacacgattttgaactgcacaggtccacttaaacactgatttttttcaataaaagttacaccaaatgtccctgcttctcctgcctccccctctaactcctccacctcttctgcctctccacccctgagacagcaaaaacaatccctcctctttcttctcctcagtcaatgtgaagataatgaggatagattgttatgatgatccactcccacttaatgaataataaatatgttttctcttccttacgagtttcttaatagtattttctttcctctagcctacttcattgtaagaatacattatataatacatataacatacaaaatgtgttaaatgactgtttatgttattggcaaggcttctggtcaacagcaggttattagttaagtttttctgaagtcaacagttatacatgaatttttgactgtactgctacccccatgctgttcaagggtcaactgtactttggttaagatcaattgctaaccatggtgaatgtaaaccaatccatattttaaaaaatcatttatattggctttaatttctttcagacaacttctagaactgaatgtttttttgtttttactttataaagttgctggaagaagaagcatcagctatgatacttccttgttattattcatattttctggaattttgttagtgtacattcaatctaccactcctctatagggatacttttaagccagttgtccattttgtgagagttattttaattaaagtttgtaatataatctgcaaatccactaaccaagtacatgtatactgcaataaatataccataatatcctgagcatgaacatgagcataacaggctgtcttctctcaagagaacttgtccttctttgcacatgacaagcaggcatattgggtcttgcaatgggtacccactgctaagttccaatttctcagccaggcataatttgtccccaaaactatgcttctggcattatctcttattgcttcagtgccccgcattctctttgggatactcctgaaccccaccttacatgctgtawgcaggccttttactccagtcattgccgtgcaaccaactttgagacagtgtaacctggcagtgtattatctcagcaacattgaacatttctctcttccagcttcagggctcccaagataacatagggaaggacacttgctggaaactagttggaattcacacatgcataaacctggatgtgagagagagctgcttcatgggaacccttgaccaatggggaataggagtgggtgaggagsaaattctcttatccatcccacaggtggacaattctgagatgcgttcattcttcatggttcctcagaggatcccagcagtattgagacataatcacccatgrcaggtctaagttcaagaatacatcctgaattgacttctctcacttccctgtttcaatttccccagtcccttctcatgttccctagggtcacttgtcatcatcttgcatgcaaacccttgtctcagtctctgctttctggtataaacctagctaagacagattctatcaaaaccaacttcttttctcaactagccacctccaacacgttggatttcttccctctatgttcctgctcatgcctttgcacacatctcaaacacttccattgctgcctatgtcttactaacatcctaaatcccttccagctgttttacgggactctcctcatcttcccaaccgwaggcaacatcttatcttctgcgaggtccatagcatttttgccttctcatggaacatttattttcttaggctttgtgctatagcttcttctccttgtcttggcccatttgctctcttctcgtcaaccaaattctaggtacatagaggcagaaatttgtctctttcatttatgcactccctttagataccaaatcttccctccctcttagcagtttctcagaatgcactgttgaagcaaattaattttcatttcatgtattagcatcttcccattaataccaaagtgtgtcagggagaatcttgcattatatcagggcagtcctcaacttcaagaagggtccaaggaactggaaagcttctcacagaatatggagaggaaaaacatagaaaggctgctcagaaatttccctgtctcaattcttcctcctcttccccttatgccaatatggctccaggggaatgtgatgatacaagggcatccactcgggaggagatggctgcagaaatgaaacataaccaagggtatccccaggagcttttagccagtatcctctgcctccctcttggagggctcggtgcacagtctgagggtttgcattttgtccaagcctttccccacatgtatttatgcatatgcacaacagcataggggcacaagagaaggagcccagggaaattcaccattgcaaatattttctctgacaaggtcatgactaagcacaaatggcctcaaggatggccatgagagacttgcaacaatgtacttggatacgtagtacataggttttctgagaagggctgcaaagaatgtgagttctgtaaatagctaaatgtgcagraagaatctataggaagatggtgatgaaaaatgcaatgtaatcctggacagtgcttataaatatcagcttcccagctattccaagggcactgaacatgagcaagagatagacagccagcccatcttacatcacaccacctgtgccctctgccagaggagtgaggacattgtgatggtgaaggaggaagaagaggaggagaaaccacagaaagactcaagaggtgtcctcaaatattttatttgctctcctggatcgagagctgtgatgttctttgcttaaatctaagaaccacaggagaaggcacgggatgacagatttctgttcaatcagtatcagaaggcacttcccaaacaatgtgggtttcctaagccttgcaaggaggtaggctaattccttgtctatctgtagtatggaaaaaataaggccaacataaacacacacacacgaaatagaatatcgataaatggagaaagagcacagtgttattccccctgttccagtctctgaagcactagttcctatgaccttttttttccagcctatgagatactctaatattcacggaggtgttgatgcttttgttgctttcttaagcaagagtcacggtcctcaggcccaggactattgaatggtgggtttttcacagggtggtagagagggagtttacccgtgtgacactcaaagatagtttgtcccctgaatctcttctattcagaaacctaaatgaatgcacgtccatttcagagatccctacatgcttccacccatctttctcttcaatttccatcagcatgcatatctgccctgtccttccctccacttcagtttcctttattcttcagaagagaaaatgtaaaaagctctataagcttgcaactgagaatctttgtctctcacttaggtcaataagtttattttaacgttgttgatgatctaatgtgaattaggggcaagaaaacaacacgggttatcaacaagaaaggaggggagataaatatgcagttaaagaactgatcagttaactaccttactagtttgagtcacttacaagtagaasatttctgattataaaaagaatacttcaaagtcaactctaggccgtatggttgggaagtaacaccagaaataagtgaataaactacatggaaacccataatgtcattcccttaatggttgtctccttaactaaggatgcaattaaaaatgagacagagactagcaaagactgtgcagctgacagagtgccacctcccaatatctaatagcaaccatcaaaagatcaaaaaccatacactgatgttctctattgctcgtacagtttagcaggttaaattttgcagattacagctctagttcactaaaatcagttttatctatgcctataatagcagtgtggccataataaaagccacatctaactgaccaaggccaaagccactagcaatgtcttctccaaactcaycatgtagtttgaaccccaaacaacaaagcttgtttttatctcaaaggaagtgtcaggatcaataatctgaattattcaacaaatatgttttgagcacctatgctgttctaagtgctggggacatagtagtaaacaaaaaggggaaaatatggccatccttatggaactgacattaaatgttgaaggttggtaggtaacagtccctccttccaatcgccatccacgttcaaacatttagaaactatgttgatgccaaaatcaaaatcatagcagtgcctttattattgttacagctggattagggaagtgaggggtgcctcttagtcttctggggcctcaatctagacttttggggcaaaaaccatgcccaccaactctaatttcattttctccagtcactgtaataatccatcactcttcagcagaatcaagtgagtaaggctgagaggaaggcaaactccaatctcctccaggagcctccgtgtagaatctgcccttttagcccctattcaattggtggtttagcaaatgtccacatcttgctaagcctaggagatacttctcctttcctgcaggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtyggagtctttttaggagtagatttggactacataacctgtaaatgtgttttgtccagtccttagagtgttttttaaaaaattgtaaagtcraggttttcatgaaaaatgggaagatcagacaacattgctcctgaattcccacagagcagcaagctactagagctcaatctgttatttcttttcctgatgtayaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgtaatcaagtctatatgatattatttttatagtatattatttttcttcatccatttgcctttaactcccatgtgggctgctctttatctaccataggcagaaccatatatttccattcctatgtaataggatcccaatgagtctttttctcccaaaagatgcagcaacaaaaagttagggattatagccatggaaaagacagtcagttgtttcttacaatggaatagtaatagtctaggcctcctactgtaggcaccgagtagccaccctgggtatccactctttcatccactgatttgctcagaacaacacctagctattgtatcagaaaattttcaagcatacagaacataacggggaccacagcatttgagaaacacagcctctgctaaagctactttcttcacatgctgtttacacttttcacttttaaaaacgttaatttttcagttattaatacatcgacacattcatcttgaaataaagttaaaatataccagataaatccaaattctttccccccagatcctagttcctctttctccaccccaatggtaaccactgttatgaattggtgtcactctggctatttcttatgcatttacgtactcataggctctattggaagcatacaatgttgtcttatgtgtacccctgtgcatctgtatgtatgtgtccatgtgcgtgcatgtttctctaactggaataataaaatacatatttttctccaactcacttttctttttttttcgagacagagtctcactctgtcacccaggctggagcgcagtggtgcaatctcagcttacttcaacctccgcctcccaggttcaagcgattctcctgcctcagcctcccaagtagctgggattacaggcgtagggcgccaccatgcccagctaatttttatatttctactagagacagggtttcaccatgttggccgggctggtcttgaactcctgacctcaagtgatccacctgcctcagcttcccaaagtgctgggattacaggtgtgagctactacgcccagcccaactcattttttcactgaaaaatgtgttcaaatatctgtctacactggcatggatggctgtctcattcctttacaactgctgcagagcacccaacagaatggttttaccatcctttgtttagccattccttcatggatggagagttaggctgtttccacattttgctactttttttttttttttttacaaacaatgtggcaatgaacattctagtgtatgccttctgtgcagacatgcaagactttctttggaatagataagtgatcttagacaagatagctgaaaaaaatagataaatgaattgcttgaccatggagtaagtccattctttatttcaatagataatatctgcccttggatgtggcttttctaatttacacttccaatggtgttttcattcttccctgccctacatttttactttttaaaaatttaaaaagtattgttgtcctagcatataaagcaggggtttccaacccctaggccatggtccgaaatttttttaaaatttacacttccaatggtgttttcattcttccctgccctacatttttactttttaaaaatttaaaaagttttattattctagcacataaagcaggggtttccaacccctaggccatggtccatggaccgttaccagtccttacctgttaggaaccgggctgcacagcagaaggtgagtggcaggcgagcgagcagtactgcctgagttctgcctcctttcggatcagtgggaggtattagatgctcataggtgcgtgaaccctattgtgaagtgcgtgtgcaagggatttatgtgtgcgctccttatgagaatctaatgcatgatgatcttctaagaacacccacatccccagtccatggaaaaaatgtcctccatgaaaccagtccctggcgccacaaaacttagggaccactgatataatctctcactgttattttcatttgcacatgcctgattactgattagtccttcagtactctgcactctccagtctgacctctgacatctgacttctccaccaaaacctttcttctgagcaccatcaatgacacccctgcctgtttcctgatgccaatgggcactctgctgtcctaatctcaatcagcgctaggcacactccactgctcccacacatctttacatgcacatactagggattctgcaacaagtctctctgggctttcctcagactcactgaaattttctttttactttcatttactggctccccctcatgtgacttcttgtagttgaaattcctcagaactcatccttgaatcctcttctcctttatactatttcactgggtgacactatttgtttcatgaacgggtgtatgtggacgtattagttggttctcatgctgctaataaagacatacccaaggctgggtaatttataaaggaaagaggtttaatggactcacagttcagcatggctggggaggcctcacaatcatggcagaaggcaaaggaagagcaaaggcacaccttacatggcaacaggcaagagagcttgtgcaggggaactcccatttataaaaccatcggctctcgtgagacttattcatactgtaagaacacatgggggaaattgtccccatgattcaattatctccaccaggtcctgcccttgacatttgggtattattacaattcaaggtgagatttggatggaaacacagccaagccgtatcagttgacaattttatccctggcccagaagtctcctctaaactccagatatgcatttgtagctaccaatgtagactgtctctgaacttggaaattgaatatgtcctaagtagaacgcttgatccttccacaacctgcacattccaacactcagttatctccgtctcagttacaacagaaacctaggagtgatccttgatttttcctttcgctgaagtcctacatccaacctattaaaaaggctgtctctaaagcagattttctccaaaatatgtcttgaatctacccgtctctcttcaacttccttgtcacccaccactgaatgccagacaaccaccaaggctcatctgaatgtggatccacctcctgcccattgcccttcgtctactcctgcacccattaaattcattctccatgagacagccaggattatctctaccaatggaaatcttaaccgtgccagtccaatctctagaccccttcaacgtttccatttgcacttggaagaaaatgcaaagtccttaccatcatttacaggcttgcttgaatcatctggcctgcctccaacccctcttccagataactctttctttccatcagtatcttcagttattccaatctttcagctctttgaacatgccaagttcttcacagccccaggacctttgcatatgctaagttcatgtacagccttttacctgtattagtttattctcatattttccttttttagctccttcaagtcaccttcctatatgtgactttttggccaccatgtctaaagtaatctccttcctctacctcttacgtcagcttttgactgtttccttcacagggtttgtaatcactttattgatttgcctctatctttctttccttcccccattaccttataaactctttgattgcagggaagtgatatttttctagtttaccattgtatttccagcccctaacactgtgtctgtgtttaataatttttgttgaattattaataaatcaataactgaataaatggataaatgaggaactgacttccttcccaggcagtccaccttttttaacaagactagtctcactcagaataaaatctgtcttcctgttcctcagccttgatgtcgcagagaatgaagggactcccaggtccacccaagtccttcagtttgtgagtgcagctgtcacggcccgctttagcctcccctttccctttgacataactctccaaaggaagaacagttctttcctcctcatgattccttctattaaacacttggctttcttcctgccttcattcacctcagccaagtgaaaagaaacccatacatcctgctgcacacctattatcctgctgtcattactgataccaccccttcccctcttaaaaatgacaccttatatataaattatgtggtcatactacatatgagaaactaagagtgtgtggactaactgctgtctatctactttccattgaaaaccaatagaattgaagaaagctttcattttgctctgttccatcatgattcactcttcttctcctccttctccctccttctccctcctcctcctcctccagctcctttttcttcttcttctcctccttctccttcttcttcttttcttctcttttctttctttctctctttctttctttctttctttttctccttcttcttcttcttcttcttcttcttcttcttcttcttcttcttcttcttcttcttcttcctctccttcttcttcttcatgtgtggtccaactgctgtctacctactttccactgaaagcaaatagaattgaagaaagctttcatttttctctgttcgattatgattcacccttctccttctccttctccttcttcttctccaagagacagagtcctgctgtgttacccaggctggtctcaaactcctgaactcaagcaatcttcccacctcagcctcccaagtgctgagagtccaggtgcaacccaccgtgcccagccatgatttgtacttttatgagagccatcttccctgtggttctgactgtgacatgtgtgactgcaattctcattgtctcattctgtgctttactcatttgcagaaataatccacaatcaatatcagctttatcaataataaatgtatcaataaacaaaaaaaagtctttgtcttacttctcaattggttcataactcaagtgggaaagagggattacctctattacccctcccctcaagcactaacaattaacgtggcaaaaaccaattcttcatccatggccaaggtcattggtatcaatgggtgcttcctaatccagacaggactaatagtggagttcagtctgaaatgatggctaagcccaagcactaagcagtgctggtgaaggaagatggctcattaataggggtagcaatgcatactttagtcactcatctaaaatattatgtgcactgggtctgccattaggacccatctgggcaggtcctgtgcctgactatcacattgtccccgccccatcagcctaaaatcaacaggaacaactctgtagtccaacaaagtcagatttattgacttactgcagtaagagagactgtccatcaggaacctgagccatagcaaggaagaaagacaatgtataggatttgggggaaaagtaatatttaggcaaaatttaaatgaagcaaagtttagatggactcaaagcaaaaagtgctgtatggagaggggtctacattaggtcagtagtgtaaagaggatctagggtctgtgtcctgtgaaactacaaagttaagatacatgtagaatgttgtgaccagaaaccttttatctgaagctttgttcacaggctggagactgaggctgcttctctgtgtcagcatgatttatattattcaggcaaaactggaatgcttcattcttgttcatacaacttgaaaagtcaaatgtccaattgtccatggttgtaaagaacaaagtctcttagtgattaaaaaaatagtagccactcaaagaagaggaatgttatgatactacagctgcagcatattattgggagaaatattattgcttgttaatttgcagtgggctttatctgtgccttgttattccagcctcatgtttttactttctaaacacagtgtgtccagtggggagcacagagcacggtcccaccaactcactgtccaacaagaaacagctgtccctttgattccagcacaagcaaagaccctcatcgatggccagtgccaggccaaaggcccagcagtgagcttggg

SEQ ID NO: 12559 - DNA, 26869 bp, Homo sapiens
cactttataggccttttgagattataccttgcaggggcacccttacaaacatttctgcctcccccatctgactggaagctccttcaaggcaaggactttgcttctgaagcaacaggagttgacattttctgagaacttccttgtgcccagctcagagagcctaagtaacctttatgggaaccagaatgtatcccagatgagccacattcaaagagtcaaaaacaacaacaacaacaacaaaacccagaatcgaacacatcatttccctcatttcctcattcaggaagcttcgggtggaccctgaactttttcttttctttttttgagacagggtctcactctatcacttaggctggagtgcagtggcacgatcttgccttacttcacccttgacctcctgggctcgccaccacccttggctggtgttgaactcctgggctcaagtgatctgcctgccttggcctcccaaagtgttgggactacaggcgtgagccaccgcgcccggccgcatctgagcttgtagcaggtgcccaggtgcttctgaggcattctgaggcttctgagcaggccaggatttgggaaccactgatgtctgccatggttacaacctctaaccaacagtgaactcttaagaggcacacactcttggcatgagagatgctagccacagactaataaaccctggtcctttcctggtggagctcagcctggtgagagagacagatatttaaacaaatgggccctttgtatcgtaacacgtgcagcaatggaggttaggtcacagctgagaactagaacagagcagggagctcactgggtctagtacatagttggggttccagaatatctgtgattctgaataaaactttccagcttattatcccagaaatttaaggcttgtccacactctagctccagttctcaggcataagagtagtttttactgagcccataagtttaaacacctgttgtctgctgagtcttatatcaggtcctgcctagattgggcatcgaagcaaagaaatggttctgcgctccaggagaggcattacgtgttagatgttaagagagcaagctgtgcccatgtgaacctgcatgagagggctcaaagtgggttggtgtgggacaaagtcttcaggaaacaggccaggtggaggagaagggcagaaggaaggctattatggctcagaggagtaaggtagagatgactcacactgcaccctgcatttgctcatccagcaaatgcctgtctgctgggcactgtgctaggtgctggggatactgtggtgaacaaaacctgaagctgccctcaagaaccatatacagcattggaggggaggctgaccccaatcaagaaatcatgacaagtgctaccaaggagaaggacaagatgttctaatttttaataagggagattgacccaggcagggagctcaggtgaggcttccttgatgaagtgactttcagctgaggtctgcagggggagggaagagcatacacaaaggcccaggggcagagggcacacggtgagccaagggtgacaggccggtgtgggctgaggcaggcagagccctaggtgtgcagggctggagcgcggagatgagatgctgtgcttcggtggaggggactgggacccataccccaccagcactaactgattccagctgtaatgcaagaggccccagcggattgtaggaattaagggtgggggatggattccggcctggaggaccagggctattctcactgaggacgggtgctttagataggctttgaaggaaaagacgcttgcttggttgtgtgagagcatggtgggcgtgggggcctcaggagataaggacgtgtcaggcagaaggcacagcacacacacgaagtggagtctagccaaggggtaggggaaggagcagggagttgaggcagaaagaaagagtgcgaggcattctgggacctctgtcggttctcccttggggcctcttgccctttctccacagaggtgtcattttttgtgtgtgccccatctcatctcccccatggaaatgacttggctgagactctggacagcagcttctagatcctgctcttacctgccctgagagtggacagggtcaccagggaggtctggggagagagaagcaaaggggaaggatggggaggaggctcacgtagcctttgtgcgattaaaggcgcttagcaaccatagctacaagtccctggggttaatttattttgagacagggtctcttttgctcaggctggagtgcagtgggatgatctccactcgctgcagccttgaactcccaggcccaagcgagcctcccacttcagcctccagagtagctggcattacaggtgtgtgtgaccactcctgggtaatgtttgtgttttttgtagagacgggcctcgctgttgctcaggctggtcttgaactcctgggctcaagggatcctgctgcctgggcctcccaaagtgctgggattacaggtgtgagtcaccacgcaggcccctggcatttattatgtgccaagtgttgtgctttatttcatcaggatagctctcagtgaaatgacgcccttgccccatttcacagatgagaaaactgaggcccagaaagtttgagttgcttgccctaagtctcagcactcggggactgcaccgggaactcttgagccccgcggttgtcgggctgtgacctcattccctgtcctccgcagcgcgggcgccatggacaagatcttggaggcggtggtgacgtcgtcatacccggtcagcgtgaagcaggggctggttcggcgcgtgctggaggcggcgcggcagccgctggagcgtgagcagtgcctggcgctgctggcgctgggcgcgcgcctctacgtgggcggcgcggaggagctgccgcgccgcgtgggctgccagctgctgcacgtggccggccgccaccaccccgacgtcttcgccgagttcttcagcgcgcgtcgcgtgctgcgcctgctgcagggtggcgccggccccccgggcccccgcgcgctcgcctgcgtgcagctgggtctgcagctgctgcccgaggggcctgcggccgacgaggtgttcgcgctgctgcggcgcgaggtgctgcgcaccgtgtgcgagcgcccgggccccgcggcctgcgcgcaggtggcacggctgctggctcgccacccgcgctgtgtgcccgacggaccccaccgcctgctcttctgccagcagctggtgcgttgcctcggccgcttccgctgcccagccgaaggcgaggagggcgccgtggagttcctagagcaggcccagcaggtgagcgggctcctggcgcagctgtggcgcgcacagcccgccgccatcctgccctgcctcaaagagctgttcgcagtcatctcctgcgcaggtgcgtgtgcggccggggcaggagcgcgggcatgcggaggtcctgggtgggcgcttgggtaggtggctgtacgtgtggatttgtgcatgcgggcgcccgtgtggcacgagtgtgccaggcggcgaatgctcaggtggagggctgcagcctgccttcatgtaggtgacacaactgtctagagcacctgctgtgggtcctctcctgcagtgggtgttggaaacgcagggaggagcacactggtgtgaaaaggatacgggtcagcctggccggagggaggaacgggaagttgagcaagccacaggatttggggcgggggaggtgggggggggggtcattatggtcttcgggtcaggtgagtttgatagaagctatcactttagagccaggagttgacagattggtggcacctggcagcaggggcaaggttccctgggtaggcagaggtgagggtctggagaggtgatggagtctgctatgcagactcagaaacgtaaaatcttgatcctccattgacaacagtggaacttagactacagtgcaagtgagtgaaagcagatgtgtgccttccctggtgatgaggctctccaggggaaaggaagggaatgcacctggcagggtgaagaactgaggacaacagacttcgagaaggaaatggtctttctcatctaggcctctgtgtggctccacttggagtatctccttcctccagtccacgcagccctcccaccttctctagcgccagcgtttcccctcctaaaggccttgccctgaaacccactcttgatcagtgcttcgtctgtggccagcacaggagtagccccaaggctgtgctagtgaaggtttgttgagtgagtttaggtggaaccagagactttgcttgctataggagaggaggtggcctctgctgtgctcttcctagaggcccagcccggttcgttggctcctgcagggcatggtgtgctgggggaagggaggggcctgcctccctgctaagctcagccctgtcccctgttccagaggaggagccaccatctagcgccctggccagcgtggtccagcacctcccattggagctcatggatggtgttgtccggaacctcagcaatgatgacagtgtgacagactcgcagatgctgactgccattagcaggtgggacgctgaggctgagccatgatcagggctggggcccctccctctcttcctctcagaagccccttctcctgggtgggccgctgggctagatttggagtcagagggcccaggccctcatgtgtgttccatcatctatcctttcttgagccctgctctgtgccttgcctggggctggatgtgggggacacagagagcctgccctagtgatgctgtcaggccaggtaccagcagtgtgaccctggacatgccagtgagctctcagcctcagtttccccctctgtaaaagcagaggtgggtggtgtcaggcgtccttggggttgggtaagagggtgagagtgcttcacgaggtgctttctgagtggggcaaacatgggaagcagagtttgggtgcttttcagctcacagagtccttgcatatcccccacctcatctgaacgtcctcctccctgtgatctagacgcacctgcctgtccagttgtcccagaatatgccgctcccctcctccctgcaggcctttgcctatgcagaccccgtccacctggcatgcctccctctgccattctttccatcccgtgtgcagatccaccgtcttcgtagggccttcctggattccttgcctttagtgggtaagagtgtgggctctcgaggtaagttgctagaggtcaaatcccgcctctaccacttcttgcctgtgcgaccttggacaagttactcaacctctctgtttgagtttcctcaactgtaaaatggagtataaccaaacccatcatctagggttgttgtgaggattaaattgggtaaaacaagataatacacgaaacatgtctagaactgtgctgtgggagacgccgttatcattgttatgactttgctgtcatggttttgtctttttctagcacagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttggtgcccctgtcctagcccagagttacagccttttgtactaggctcttgccaggggcggtgcaggtctgggaggtcagagcattgggcctacccaccaagctcgctgtgtgacctgggcgaattcactgcccctctctgggcctcagattctccccattagtttccctgactactcatccaagtatgtgtgtctgacttttggtgtgtccatccattcctcagatatctrtgttgctgtccatctcaccatctgtctgtccatctgggtctgtgagcacctcagtgttgatccctctgcatgggtttgaactctagggtgtctctgagtcccctctcaggcttgtgattctacttsgcctcagcagctcaagcctggggactcctgaccagggactctcttgtaggttttctctaagctgctgtaccccatcgtccggggagctgccttgtctgtgctcaagtacatgctcctgaccttccagcactcccacgaagccttccacctggtaaggtcccctgcctgctgcccctggtgaggcccctgcctgctgcccctggtaagggccctgcctactgcccctggtaagggccctgcctrctgmccctgggctcttggggcaggtcacttggctgaggccaagcagctggatcgtgggctctggcctccctttgactgtgaggagaggagtagtcatcctattttgcagatgaagaaactgaggcaggrtgtcttagatcatattgttgggaaaaggagtcacctgcctgcagagctcagagccccatctgggtcaggggacagtggtcaggtgggcaagcctccctacctcagagagtgttgcgtgctgtcagcagggaccacagccccgtgtctcaggtgggcgggttggtgctgagcctgacgcagctctgctcccacagctcctccctcacatcccccscatggtggcctctctggtcaaggaggactcgaactcggggaccagctgcctggagcagctggcggagctggtccactgcatggtgttccggttcccgggcttcccggatctgtatgagcctgtcatggaggccatcaaggtgagcgacagtcccctacttgggccttgccccactctgacaaaggtaccagtgtgggccttccagcgggccataccacagcttggtggcagtccccgtcatttggtgcctggctgtctcccatcacctccccaggtccatcatgtgcctcaagcacactgagccactcacgttccccaagtaggctgggctgcctcatggctgctctgggcttttgcacacactgtgctttctaaccataaacgcttctctgtcagtgtagtatggaaattaaaacacgttctctttctctgctctgcctggacagctcctgcttaccttgtaagtctctgttctagtgttacttccctcaggatgcctttcctgatcactctcagtactcccatgccctccaccaggctgggctagggcctcgctgggctcccacagtcttggtacatccctctgtcacatgttatcactgtctgtctgcctcccttgccagactgtgagcactccagaccagggataatttacagtcgttcacatgactttactgacgtcctgctctgcaccaagcccaggctgggaactgggggcatgggcatgaagcaaacggagtctcctccattgagaggatcgcagcctggtgagggtgacagacttggatacgagaaactctggtcggagcagcttttgaaaatgtctacaaggtttggcttgagagcagtgagaaaccagaggaaggaaagatcttctccagttagagaggacagatgaggcctctaagaagaaagagtttcttagaggcctcatcaagctgggcttgacgggttgctaggatctgacagtgactaacatctgtggctactgctacacttgagattattttcctgtatgttttgtcttctgatgctcacaagaaacctacaaagatgatacggttcatttcaatctcatagatgaggaaaaggagacttggagaagtttggtgacttgtgcaaagtcacagaggtagtgagacatgtagctggagtctggatggcagagccttccccattgcctgatagagaaggcaggttgggtggggtgaaggggtctaggtaggtggcccttgcagaacctttgatctgacttttacatctgcagcacagcagacgagataacctgaaaagtgtcctgctacaaaacagctagaaatgcttgttaaaatataacaaacatcactttaagtacatagctaagcttgcaagaaagtaagggggagtccccaggggccaaaaaggaagagataactgaattccagagtggtaggtgagaaacaatgttctttttcctctggagtgaggcaagtgcgtggctgagatggccaatctcagtcacaaagggacttgagttggtagggacaggaggtcagactttgggcctatccccagcagggagttagcactaagaagccgactaaaagccaggacccaagaaaggttgtaccattagcaaaagaatggtctaggaaaaaatatgcacatggttttaaatagacatcagggaaacttttctggcttcgtctgggctctggattggggaaaaaaatgtaatcagtggcctgctctcatgtggatttaggggttcaaattcatatcattttgggggttgtggcccttccccacattaaaaatagtcataaacttgtagtacccaagggtaacctggtagaaagacataaatcaggccataaaggtaaagttctactgaaaatgagtttatagtcccaaaattataaaacacacaaaggaacaatcctgcatgaatgacagttggtagatacaacaaacaaaacttccgttatttacttggatcttctcagtttttcaaacttaacacgagaaagaactttttgataatcaaagctgccttacaatggaaggggctgccatgataggtcatgagcccccgacagtggaggtggatgaggaggacttccctgtgtcaggtgtgttgcccaagggtttctacatcgaaagggaggtaggaggaaagcttggagattctgtggctgggtctgtctgtttcctgctagacaggaaacagtgagcttctgtgggcaggaaccctgtccttttgatctttgtgcctagtagatgtctgtgagcaaatgagtgggttattgtttgagcaggactgtaggagaatgctgtaatgaaggtgcaggcagagaggagggaccctgccccgggcactgaggaaaacccatgatgagtgagatgcaggctttgcacagtaggggcccatggattgtctgatcaggggatgaggggagtctgcacatacctgtaccagtaggggcagggagttaggctttataagatgatacagatacagtccttctcaaggaccccgccttctcaaccccgcgccttgagaagatcctggaaagcttcatagagaagggatacaggagtttgatcttactgtacggggactgaaaaaggacactctggatgcatcggaggggaggcatggaagtgggaacatgtgaggttagtttggtggtaatgtgtgagggggaagggagatcagaaaaatcagcagagcagtgccttgaaaactaggttgcaccactcggctagatctgggcttctcgaacgtttccacccaagtacttgacgtcagagaggggaactcacccaaagtagcctgacatgagctctgagtttgtctacaacctcactttatctcaaagactcaagtatgtatgtcgtaattataaacatgtttacatgttttaatattacatttttttttttttgagacagagtcttgctctgttgcccaggctggagtgcagtggcgtgatctyggctcattgcaagctctgcctcccaggttcacgccattctcttgcctcagcctcctgagtagctgggactacaggcgcctgccaccacgcctggctaatttttcgtatttttagtagagatggggtttcactgtgttagccaggatggtctcgatcttctgatcttgtgatccagccatctcgacttcccaaagtattgggattacaggtgtgagccactgtacccagcccatatttttcttttcttttttttttttttttgagacggagtctcgctctgtcgtccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttctttgaatgttagaaaagatggcttcacatttgttctgtggcttcgaacactcctggtacaagccagtttgagaggcaaggcagcaaattataggattttactgcttataaaattatttcgcatgggttctatgagtacatccttttgtacataygcctttgtaaataagttctggaaagttctctgacttaggcagatgtatcaggttgtggcggtttctttgggacctgtgatacttgccaagggagccatcacacatcagtttctagtaacattattaggttcttaagttattttgaagtttttattttcctgagaacaaagttaccttctttgggaataatggcatttgattttgttcctagcatggatatttttgcatcttctctgcgtgtgcacggatatgtggggttgtgtctgcctttttgcctctattcattcatgttgtggggtggagggacaggcgaggagggcattagatagggtatcatgaacagaaaaaagaagggacgaagaagatactgagcctgtatcttatctgtcttcccgctggcatctccttggttatgtgtgtgtgtttttaaatcatctgtgagaagtgactgactgctctgataaattatccgataaatgatcctgggaggtgaatgagcaaaagtgttaaaccccactgggtgagcaagaccttctgtgggagccacaggatgtgcactggggagacgagggctttggatgctgagctgttttgaagctctgtggagccctggacaaatctaaggcattgtgaccaggatctggaaacaagaacagggctagargaactgttaggaatgttgctgaactctaagtagcgggatgtggtgcttagatgttgttctttggaagatacctctagcatcattagaactagtgcttggtggtattcttaggtgctgctgtttgatgtgacacagataatgagtgggaagcatgccaaggaccaagacccatacctcagaccccagggattcacccactgtcctgactgtagggtcargttttggggaggtgactctctcttcttgaaagctgattctgcaaatctaaaagtaaaaggtggacatgggcacatcattgtgtgcccacaccatgaaaacgtaggatgccaaactgacacaaggtaggagtatcatcacttgacagatgaggaaactgaatcagagagcctcgccaccgccagacagctagtatggaccagagttggggctggcactgacatcctgacattactggatttggcctgtgggccagggttgtcattgcctgagctcttttatagcacatgcatattcttcagttactgacagcgaccctggacaattattttctctgtctgaatcttcattttttttttaatctataaaatgggaattatgccaccttaaggcagtcctgacctgaaagaccatggaggcagcccatatgtcaactgaaggggtttggaagcagggggctgttcacacacaccccagaacatctgtgggggggtgtgcctgggaggccttggggttggctgtatctgagaaggcctcccagaagaggtggtagttttttgagctgaccctggtgcccaccatcctgcctgcctgcttattccctcctcaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgagtaggtgctgctttggaattccctgtctgcccttgcttctctcctctgggctccctgatgacaggtggaaaggtgtccggggtgggggttggagagggtgggccttgctttgcattgccagcatgattccctgaggtctgtggggacagagagcctcaggccattgccaaggcaggtcaggactggatgggaactcaagaaggggcttaaggggctgggcagcmctgggaagtggggtctgctctgggttggctgacatcactgacttttcttctagagtctgtgggggtggattttgtcttccagagtagaactgccacccatcctggtattagacatctctctcttttaaaatgaaacaaacacaatctttatagtctatggccacctatctaccttatggcttacttaaaagatcaaagtttcagctttgattcagtgaaaataagctttgattctggcttatcgtatgtcctcaagtcagtttcttttctctgagcgtcaggttcagtgggaggagattggagctgatctccaagtctttctaaggtgctgctggtgcacgttcttctcaaaacgcctagtgaaggactagttttgtttttcttttctaattccagtctgctgcagaatattacttttgtaaaatataacaaaacgacttactagaaaaacggtcacgtgcttgtatggtggttgtgatgttaaaatgctgtgtatgtttctaagtgctcgctcagcttctgaacttaccttgttctgagacccagagctgcttgtgagaacaggagataagctggggcctgggaattggcttgctccagagaatgttcgtgtagggaggggagctatctcctataggatcagacccttcccactaggagccagtctacccatccctaaagggtcctcttcgtttagcgtattcctcacattgacctctgcctccctcattggaaggcaggggaacagcttgagattgctctaggggcaggggccagggccctgacaggggctgtaggagtcgattggagggcccaggtcagagcagagtctgctgctctggaggtggatgaatgcctttccccagggaagcagctaataagggtgtgcgaggggctgctgcggctgggatgatattggcatggatcctgtggcatgtcctaaccctagaatcctgggaccacaggaccttaggacgtttgaatctttaagtcctgaacgtaggtctcagagctggaaggggctacaagggtcacctttgtacccttcattgtctaaaacatgtctattgttgtgttcctgacctcagataccccaggctgagttgttcacctgctcctcctccccagcccctggcttctggctccgtcttggggcagaaatgtctgttctgcctttggcctagaggctctgggctgcctgtgacatgggtgactagagactccttgggggcccatggcttaccctgggtgcccctgctttgttttgaagcttcagacattgtgtgctccgcttgactgagaacaactcacagcccctgatgaccaagctgcagtggctctttggcttcctagaacacagccaggtgagtgtaggggcagtcagaggggggtggagaggcagctctggtcaggccccgacatggacacctttcccttycccaggacctgcctgcatctggctgtcatctcccatgtcagttgctgagcccctggccgggctggcatatggaactgatttagtgccctgctggggcaggagaaggcgggcccccttgagccctgttccgtgttgtgctgcccaatctttccctttggcaattcagtccatccatcgcattatggtgttgccatagtccattttatgctgctaaaaccaaatactcgaggcttggtgatttatgaagaaatttatttctcagttttggaagctgggaggcccaagatcgaggggctgtgtctggtgacggccttcttgctgcattataatgtgggtagaaggcatcacagggtgtgagagcatgcatgagagaagggaaagcgggatgaactcacccttttatcaggaacctgctcctgtctccatttgtggctgctggggaaagcaaacggcctgtgataaggaaataatacattcctgagggcagagtgctcaggacctcatcctctcttgaaggtcccatctcttaacactgctgcactggggattatgtttccaacacatgctttttggaggacacagtcacaccacagcatgttgcttcattctgctgttatttttgagtacccacatggccaggcagcctgagagctgttgagggtacagaggtgaacagaacaaacaccatctctgccctcatggagcctaaagcccttggccagggattatgcaaagctctgtgtgggggcacagaaatgagtaatccctccctggctcatggagggaagggaaaggtcagtgagggagrgttgggaagatgacatggaagaggcagcgctgtatctgggactcatcttgacgggagagaatggcagtgagtggaggcagggagagaatgtttgaggtgtgccaggaagagaagattcctagagcctcgttcatttctctgagcccaatgccctgctcagccctgctcagaggcgtggacatgtgggctgggttgggtcagggacaatagaaaagcrgggaggacctcatggaggaggccaggaagtttgaggccgagggaatgaggtagaccctcaggcctaacctgtgcagagctggctggtgagtggcctcctgctcctgaccatgcctttcgcctgccttgtcctagcggcctgccatttccccagagaacttcctctccgcatcctggacgccctggttcagccctggcacccagcaggactgctcggagtatctgaagtacctgctggatcggtaagggggccagggctacgcgaagactccaggtctagagggtccttgggggcaagcccagtacctctgagctgtgttgcagcgtccagggaataagtgtgctgcctccaacatgtggagggcgtggagaaggggtgtgctggaagggcagggactgagtgtgagggaggtttggtagatgctgagtggaagtgatctctgggaggtcattgtgtatgtctgcacaccgggccgtgcatctttgtcactgccatgggagcacattacatagctccagcaagtctttatgtagggcgtgtgggtgagtgtagcaagcgtgctgttgtgagcatgtacgtggatgtgtgggtgtttggtgtgtgcatgtgtgtttgtgtgcgtctcaatgtgtggctgttggggaaggtaaatgggcatggataagctgagtgccccggaaggggacccrcatgtacatgtagtgactctgtgctctctgccccaggctgcaygaagaggagaaaacgggcacaaggatctgccagaaactcaagcagtccagctcgccctctcykcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctsggaggcaaaggaaacactgcatcacagaggacacccccccmaccagcctgtacatcgaaggcctggactccaaggaagctggtgggcagagcagtcaggaggaaaggrtagagrgggaggaagaagggaaggaggagagaacggagaaggaagaagtgggggaggaggaggaaagcaccagaggggaaggrgagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgygagtcgtgtgcctccctgcaggatgccgagaaggtggtggagctgagccaagggccgtgctacctcatcctcacactgstgcgcttctctttcgacstgcrcmccatgcggcgccgcaagatcctggatgacgtctccatccccctgstgctccgcctgccactggctggtggccgtggccaggcmtatgacctctgcagtgtkgtggtgcactctggagtgtcttcggagagtggtcactactactgctatgcccgtgagggcgctgcccgccctgccscttctctgggaactgccgataggccagagcccgagaaccagtggtacctgttcartgacactcgggtgtccttctcttccttcgaatctgtcagcaacgtcacctccttcttccctaaggacacagcctatgtgctgttttaccggcagcggcccagggaggggcccgagkctgagttgggctcttctagagtccggacagagcccaccctgcacaaggacttgatggaagccatttccaaagacaacatcctttacctacaggtgagmtgagccgtggggcctttgatctgatctcttggtgkagggagtccagtcccactactggcttagataagtcatttcccctctaagtcttttttgtaaatcccattcatctgttgctcagtgctgggtatatactggtggcccagacagacctaaccccttacttcaaagtaacagacactgagtaatgaatgacgcagtttattttttaagttccagggtacatgtgtagaatgtgcagatttgttacttaaacgtgtgccatggtggtttgctgcacagatcaacccatcacctaagtattaaaccctgtatctgttagctattcttcctgaagctcgccctcccccgccaccccccaacaggccctagtgggtgttggtcccctcccacccccaccaggtgtccatgtattctcattgttcagctcccacttatgagtaagagcatgcggtatttggttttctgttcctgcgttaatttgctgaggataacggcttccagctccgtccatgtccctgcagaggacatgatctcgttcctttttatggatgcatagtattctgtggtgtatatgtgccacattttctttatccagtctatcattgatgggcatttgggttgattccatgtctttgctattgtgaaatgtgctgcagtgaacatacatgtgcatgtatctttataatagaatgacttatattcctttgggtgtatagccagtaatgggattgctgggtcaaatggtatttctgcctctaggtctttgaggaattgccacactgtcttccatgatggttgaattaatttacactcccaccaacagtgtaaaggtattcctatttctctgcaacctcaccagcatatgttgtttcctgactttttaataatcaccattctggcttgcgtgagatggtatctcattgtggttttgatttctctaatggtcagtgatgttgaatttttctttcgtacgtttgttggccacatgaatgaatgtcttttgagaagtgtctgttcatgtcctttgcccactttttaatggggttgtttttttcttggacatttaagttccttgtagactctggatatcggacttaggtcagatgggtagtttgcaaaaattttttttcattctgtaggttgtgtctactctgatgatagttycttgtactccgcataagctctttagtttaagtggatcccatttgtcattgtttgctttygttgcaattgcttttgatgtttccatcattaaatctttgcctatgcctatgtcctgaatggtatttcctagattttcttctaggggtttaayacctttgggttttacatttaagtctttaatccatcgagtgaattttttgtataaggtataaggagggggtcgaatgtcaacattctgcctatggctagccagttcttcyagcaacatttattaaacagggaatcttttacccattgcttgtttttgtcaggtttgttgaagatggttgtaggtgtggagtcttatttctgagtgagttctctattctgttccattggtctatgtgtctgtttttataccagtactatactacaaggctacagtaagcaaaacagcatagtttgaagtcaggtaggcattargcttccacttttgttctttttgcttaggatggtcttggctatatggactttttggctccgtatgaattttaaaatagttttttctaattctgtgaatgtgaatggtagtttaacgggaatagcattgaatctgttaattacattgggcagtatggccattttcatgctattgagtcttcctatctatctgtgagcatggaatgtttttccatttgtgtcctctccttcacttcccttgttagytgtattcctaggtattttattctgtttgtagcagttgtgaatgggagtttgttcatgatttggctccctgcttcttgttggtgtataggaatgctagcaatttttgcacattggtttttgtatgtatcatcttgagagttgctgaagttgcttaacagcttaagaagctcctgggatgagataatgacatgattctgtatcatctagaaaaccccattaatgcagttaataagtgtgctgaaggaggagtacagggaccagttgagtctgagggggaggaggatgcttcgggtgtggggggagggggtcccactacccacgtgagcctcctgtgtgactccctagagtcaagggtggcactggcatactgagcagctggaacagcatgggctttgaccagtgggatgggtgccagtgcctggagtttgtgttttgtgcgggggaatacagcaactggtgtggggacaccagaccgggtgtcaccaacatcaactccttcttccccaaggacacagcctatgtgctgttttaccagcagcagcccagggaggggcctgaggctgagtcaggctctcagggacagcttctgccatgctgtccagatggaggcagggtggcgggtaaggatcgccatgaggctgacgtcctggtagcaggaggatgggctttctcataggcagagcccattcctcgtgatcatgaggcctgcggacaggttcccgygtggtgtgatatgaccctcgaagtcctcagacctctcggtaccacattaggcccttgtcagctagtcagtcacaccctagtatcagctggctcagggactagagtttttattgagaggagggggtcttttgaagtcttttgaaggtgtccaccccrgatatcctgccactgagctgcaatgtctctgtgtgtccaggccctggggacctagaggaaacmttgaaaggtgttgtgctgggtagactcactctggcttcagggtgtgaattctaagtctaagtctcctctcatctgtgttcccaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgytgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttcsgactgctgtacggtataaagcacagcaggatccaagcctkgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggttttgggggggggggcggggggctagcttctcacagcaggaggcctttgcccccacagcccctccacgcctgcctcagggcctgagaagccaccacttgcatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcttaaataaataaaagtaagcctaagcaagagattgttcttccttggactcaggggctgtgatggccactgggttttgctcacggggtctggggaggccaggactcagcctgccccccagtgacgtgtgagatgccacagggagccaagagccctctactgaatctactgaagtggggtgtaagtaaacgtgtggactgactgacttacttaccttactgagggctgggtgatgctgcccgtggagaggatgcacctgggaggcagctctcaagcctttacctacctccttccccaggggctgcctgctgtgatggtggtgtggagtttgggcccaatgtcacagaccctcaagatgtcacatctaagtgacctgtgaaagcagcagacagacacgcccagaacccatctctagacgcctaagaaagctggatgggtaaatgctagtatgatttccactttacaacagacgctgaggtagagagcatttgttcttattcacagccaagaaaaatacccaattatttccaaataaagcaaaaattggaacagactggagtgagaacgggttccaccaccaagcccctcaagacaagatggacacggcagctggttctggggtgcatttctagtggactttattgtcctgctccaacaccacagtagaaagggacctgcaagctccaagcctgtaccatgtgtcaccacagcaaaaacatgacccacttgaacacactcctgtcccacccaccggataaatatgttacaatttaaaaaaaagaatacaacagaataaattaataacttaagtgattaggcaccaacagtgatttgaaaattaaatgtcaattttaaatggtaacaagacaagaactcaagactgggcttccactagcccattttctcttcctgacaaacagtgacaattctgcgtgaaataattctagatttcaagacacaagtagccaacaaatacacaacacatgccaccataaatcacatgacagcctggatctcttggggaccccctcggcaggtaccccattgtggtcccaggtcctaaacagcagggctagtcccagaaagacgaccccccacggaagggctttagcgctcctgagaccagtctggcttcccctgcattttatgaaggcccagatggggaaggaagaactctggaaatgggataggggtgctgggccgagatgtccccatgggagaaggggccagagggaggatgagctgagcccatgctccagtaacttcagaatggttgtgcttttgtcacaggaatggggcatactttgttaacttctacattggaaaccactaaagtcaagctaggaggggactggggataggtactgcccaccccaatcccccagaaagaagttacagaggagggagtctccccttcaagcagctgagcaccagctgtggatgggacctcagcgcagctaatccaacctcccattccacagacaggcagatcaaggacttaaggagacaccatctccctatttctcatcgttctcacttgacttaaccttgcagaagtggagctggaagtgggtgaagaaggctccttggagagccccaggcagggggcctgtgtgaagcagtgctgagtgggaaggtatcccctttccgtaggctcagtcctctccaggcccccaggagaggtggactttgacccatggataggccaaaggaccagttttttcaactgagttgactcctttgttggaggaggtagtgggtggagggtggggatatgctagatacggctggtagtttggggcctgtgagccagagctttgctttcaaaaggtcaatttcacctctcatccttccatctctacccctacacttgcacccgagggattttggtagttaccagaatagggggctggaaggaagcctcctggtagttaccagaatagggggctggaaggaagcctcctgggagattcgatttgaacacctcagtcgctctccgaagattccagccaggtccactcacatcatggcacactcagaacatgctcacatgtttatgggaggctgcaatagtctgggcccacttgtggctgctgcgggtacagggaaggcaccagttaaaagctctgtcgtatggggccccttgtagggggcctttaaggcacacattcagggctgggcagagtgaaccagcaccctgccaactctgcccagtgtagctaccaccactgcttccattcacttattggaacaccaaggcatggcccctgcacttctgagtggctggacccatatgctcaaaggccttttgttcccaagacacaaggctttccaagcctctccttccttcttcctccactggacccaagccctgccctcctcctctgtaaaaatctgactcatccccttctaaggcctacctcaggcactcccttttcctagaatccaccttccctgatcccccactcctgcctctgacaccaacctccctaagtacttcctctgccctccatcagcatttgaagtctctgtctgatggccatcaccactgtctcatgtccttgtcctttttctgattgtggctatcttaagttcagggagaaggtctgattgattcttgtgtccttagtgcttaaccccagaaactggagacagcagccattaataaatactccttgagttgatctaaactaatgctaggaggagaggtgcagctcttgaagaaataacttcttccaggatgggacttagagaatggctaggccattggtctggtgaactatgcatgctcatgggagctgaaaggggaatgggggcagaggacagtggtagctgtccccatcaaacatggcaggaagtcattgtttgggaggaagaagttctgttcgccccagggtagaatgaaacgtctggtctgtcctgttgcttctgaaactcttgaaaatttagtcaagaacagtcaacataaaaacattcagatcccccacccttagtttaagagaaggaaccttgggtgatgccctacaccccgtccctgctaatctgatggcctttcaaacctggggaggagagtccaagatggctcctggaatgctagggagcaacagagggcggatgagctgaggaaacactgggccggcaccaggccagactcgttcctaccctgcgatctgacatacgccacagcccatgggcacaagctgtcagccatgcctgatgtggtcctctaggcatcattctgccctgctttctccttgtcctgcctgacccactgtcccatcctaggaacggtcctcatgtcacaccaccatgcacaccactcttgcacgtgtccctccttcactttctgctccaccctgcacccccaaggattgcgttgggcaccccccaactcccaggccctttggatgtatttccccacttgctacatggccttcaccactgcttcacatctgtctgctacctctgtgcccgacttccactgcactgctcactgcaaagaaactcacttcccgaccccactgcagagtcccctgcactgccctgtgcctctgcccagcctgtgcctgtcccagggttcccctcagtccctgcatcacccccatccacaccacactccctcccatattccccacccctttaccatgtgttcctgccccatgtgcttggtcgcccagcttggtccaagccttcccctgtatgctgctttcaaggtggggctggcgggggcctctgaggggactggggaagaggactagcccttgggcctagagtggcctgtagctccagagttctggggacccagaccccacagtgtccttgtcatctccaccacccgagctccaagccctgctccttgctgctctaggttggccatcagttttcccttccttttgtccttcatcttctgcctctgcaccccacagcagctgtcctgccatggcctcagcctcaaagtgggttccctgcagatgtcagctttccctcttcatctgggcatctaagtcctttacccctcaagaccactgctgagcctccgtctccaccatctcctcttttagtggccttgcttctctcctgccaagaaaaacaggaatgaaaaagtccattatccactttggtttgctggtccttgactccctgggttggtgagacttgtcttctgggactgaaggagaggtagcccagtggccggagggaagatagctgagggctgtgactgaacgtgaggtgtggaatctggctcagagccccagcccttccctccaaacatctggtagagagtcaggtctaaaggacaggaagaggctgaaggatgctttttggaagtagctcctaactaaggtgggtggaggcatggccattactgataaaaatcacagctgggccccgagtgggcagaggaggtgccttgatcaggccctcacctcccaggggaagggttcagggtccctgatgtcaagtgctttgaaggctgagactggcagagtagagaggaggtggatgggaggaagaacgggagaggggagaggggagatgggaagggccagctctggagatgctgcctcctgggctctgcggtggccctctcatcacagcttggcacccttggaaggctctgaggactgccgcacgtctgtccactcctgcatggtgttctgcagggcctgggtcttctccttgtccacctgaacgtagtccaccttctcatcagaggtgacggatgaagtagatggctgaggggacagagtgggaaagagggagtagctgtgagttaccagttaggtggggaggaagaaggtgggcacgggatcttcctgagctgtctgaaggggagaagagcatggcctctgcctgccactgaccagcctcaggagcctggcttctctttctgaatgtgggctttaaagctcagactccaaactcatcatccctcctgcaggatgtagcagcacctgccagcccttcttacttcccggcttctgggaggacccaggcccttccttggccctggtggatgggtccaggccttcatctctgcctccacccatctctgtcaggtcgctcatccaggggaaggaatttgctaggtgcaaacaaacatcagccacaggactttacgtgctgtgctcactgccaccctgtgaaggggaaccatgctgaggcacagctctgcacccttctgtctagactgcttagctataaggatgcctcctggggaggctttcccaggcctggaagtcccttctgaaggctgatgtatcgacggcagggctctggacccactcgagagcccaggaccaggaggcagtatcctcattcctggatctgttgctgattcactttgtaaccttaggacaatcagatctctgtgcactcatttgcccatctctacaacacgggggatgggctgactgatgaggttctctgactgagggtactgtgctctgagagcaggaataggagtctttagacctagatgaaagctctatgactaaagatgcatcataaaagctgggtactggagcaggagggaggctgagtgctgctgttcagtgttgaaggcaccctggcctccatgatctctgcctccgggaccctgagagctcttactgcccccccaactctactccaggcaccttgcggtgggggcttggggagctcggctggaagtccagggccagataatcaacgctgccggtgctcttcttagg

SEQ ID NO: 12560 - DNA, 43173 bp, Homo sapiens
ctactccgtgactcaagaaagacagcctggctttcctcagaacttgcatgtcagccgggtgcaatggctcacgcctggaatcccagcacttcgggaggccaaggcaggaggactgtttgagtccaggagttcccaaggagcctggacaacatagggaggccacacctctctctctctttttttttaaagggcctgagaggtttgtttttgtgcaacaaaaaacaaaaaaaccagttctaaatcaaaacacagcctttctctgaaacctttctagaaatgcagtcttcagttttctgttgtctcatttagcaacaagcaggactaaaacatagagacacaagacacagaagatgcactttcttcaggagttagttattacagaccgaaattcaggtcgttcaatggaaaagatccatgccttcacaacattctcctctacacactacaggaggaaaatgataaaaacaaagtaacaaacagaaacaacaggccagctgaggcccaaaaagtgtaagtgacaggactcctaaggtgtttagacgtagagggagagtgagcaaaaccaaaaaccaaacacgaaaccaaacctttcaaacttgggtgagaattggtcctttcacataagattctttggcaaagtatacaccaccccacctatacaaaaactgagactttattttgaaacaccaagtcaaatgtattgcctgcttgatcagacatcagtaatttcacatttgcttttcttagatttctatcccatttgcttccaatagatctgaggcagctcatgcttcagactctgtgagaggccagaagcccacctgtgcgtggagagatgatcacaagtaagtgaatcaactgattccacatatcccctggtggggcagcacctccagagatgcccctggaatttgcgatgtctcattccaaggaggaaccagtgactgtcattttggggtaagcactcctagttctcagggtttcaagacagacacctaaggcacctacaaacattgttcataatatctagtgattgttttataagacatatcactgtgtacaaggtgttgcaaagtaattccgcctttttaagtaaaaataatgaggcagcagatatcagacagccaaatctccaggaaaagagtagtaagaagctttagctgtaaggtatcatattttattaaaccaaagacctctgagagttcaggtgggactcttgtttctagtcaagacacagtacaagaactgtattaactttctgcctgaaataaccacaaaatcaggcaaaatatacgaagcaacagttttcgaagcactgagtactgggctatgaaagacagtgaatctcagaaagatgggagacaaacaggccccaactgctcagcttcctgtgtgaagagcttccaggttgtggtgtgggggccctgagtagctgggactacaggcatgcaacaccccactaggctaatttttaaattttttgtagagatggggtttcaccatgttgcctaggctggtctcgaactcctgggctcaagcgatcaggccacctcagccccccaaagtgctgggattacaggtgtgagccactgagcccagactctcaatactgttaagaatttaattctcctacattgatctgtagattctatataccgtcaatcaaaatcttagcacactttcttatacaaattggccgattctaaaattcacatggaaacacaagggaccaagaatagccagaaacctgtgcaaatgtatgaagctggggggccaacacaccctgatttcacaactcactcctcctactcctacgtggtttttgacaaaggagcaaaggcaattcagtaggggaaaagagactgaaaaactggacatttgcagggaaaacactgactctagacttttctttgtatttttttgaaatggagtctcactctgttgctcaggctggagtacagtggcacaacctcggctcactgcaacctccgcctcccgggttcaagcgattctccggcctcagcctcccaagtagctgggattacaggtgcctgccaccacgcccggctaattttttgtacttttagtagagatggggtttcaccatgttggccaggctggtctcaaaatcctgacgctcaggcgatctacccaccttggcctcccaaagtgctgggattacaggcatgagccactgcacccgactctgactctagatttgtatttcacaatatatacaaaaattcactctacatagatcgtagacctagatgtaaaacctaaaactctaaaatgtctggaagaaagtataagagaaaactttgtgacctcagattaagcaagatttcttggatactaaaagcacaatccatagaagaacaaactgatacatgtgacttgaaaacttaaaacaattactcttcaaatggcacagttaagagaatcaaaagacaagttgaagactaggcagaaagtatttgcaaggcgaatatctgatacaggacttgtatccagaatacataataaactcaaatactcaataataagaaaataaccaacccaataaaaatgagcaaaatatttaaatagacacttcgtcaacgaagatacatagaatggcaagtaaatacaaagatgcttagcatcagagggaaatgcaaactaaaactacaatgacactccaccacacacccacaagcacagctaaagttacagactgaggacaccacacgctggtggcggagtggaactggagctcccatacactgctgggagagacgcacacgctggtggcggagtggaaccggagctcccatacactgctgggagagacgcaaaaggggcagtcacttgcaaaaacaagaaattccgtacaaagttaaacatacattttccatatgaccctgagaacttacttctagataaagaagtaagcagaactcacctgagaggagtaagaatatatgtccaaacaaagggttattcacaaatgtttacagcagctttatttaaaacaacccaaggccaggcgcggtggcttatgctggtaaacccagcactttgagagaccgaggtgggtggatcacctgaggtcaggagtttgagaccagcctgcccaacatggcgaaaccccgactctactaaaaatacaaaaattagccaggcgtggtggcaggtgcctgtaatcccagcgactcgggaggctgaggcaggagaatcgcttgaacctgcgaggtggaggttgcagtgagccaagatcgtgccatggcactccagcctgggccacaagagtgaaactccgtctcaaagaacaaacaaacaaaaaaccccaaacatggacacccaaatgtccattaactggtgaatggataaaacaactgtggtatacccattctactaggtaataaattacaatcacactgcgttgtgcatgaatctcaaaagcactgtcctaagtgaaagccagatacaaaagactatgaaatacatgactgcatttagataaggttctagaaatcgcaaaatatagtaacagaaagcaaatgggggaccgccaagggctaggagtcaggggagagggctgactgcaaaagtggtcatggcaatttcgggggtggtagcaatattctaccattctaccaagaaagattccatcttgaccgtggtgccggttacgtaactgcatgcatctgttaaaacttcctgaagtgcacattatatgtagactctatctcaaagctggtaagaaaacatcatccacttacacttcagacaaagaatggatgtatgtacaccaaactgtcaacagtagttttctttgggtggtaggagtataggtgattgaagtcttcttttttgtattttttataatttttacaatgcagtcacttgcatatccagaaaaaaagtttttttaattcaagccttttaatagaaataattgtatgacacatcgtgacctaaaatatagatattagactactgaatgaatgttactttacaaaaagaagacaccagaaaaaaagtcgcttataaataaaatatccaagtatggtaaaatgtacttttttgttacttcagaaacggaacaccatcactttgaattaaatgctaccaaatctgtttgaataccttaaaggcaaccactaatcacaaaacacaacagagaacaaaaccactttttctgaattttgaattttttcaaaatctgtttgaatatcttaaaggcaaccattaatcacaaaacacaacagagaaaagaccctcttattactgtggcaagtgacacagtcatgagttttacatataacgagaaaataatttgccgtatacttgcaaaatatgagtcacgtggctcctagaaacacacctccttctcttccgtaatgggataactttaaatatggttctaagcagcttaagcctgaaaacaaaaattccaccacggcaataaacaaaaccacttgttgcctctggggctcccggccctgcagtggaggcaaacgccctgcctttccgctccccggcgagagcctgcgaggcacccggagcggccgcccggccgcgtctgcgtcacgcggggcaggagcggcgtccccagccccggccgccgcctcacctggtagagctcctcgaggttgtacctgatggaggtgctgctctgcacggcccgcaccgcctcgtgcagcttccgccacgtgtcctgcgtgtagttgtcgggcagccgaggtctgtctgcagggcggagggagagcgggcggctcagggcgcgccgcgaagcgccccgcgtagccacccccgacccggccggcgccccggcgcccccgctcccggggcccgcacggatctcggggccttccccccaagtcgggcggggtctcgtggggtccccgcccggggcgcctggccctcgacccggccgccgcacccacctcggaagttcttgatgaccagcttcttggagccgcccgcgccccccggcttggcgggcgcggcggccagggccgcgggcttggtgaggccgttggtgcggcccacgagcgccgagaagctgcccttccgcggggcctcgtccgccatggctgggccggaaccgccgcgccccgccccgagcgccgccgcccgccgagctccgctccgcccgccccggtccgcgcggcctccgccccgtcctcctcgcgcgccccgccccgccccgcccgcgtgcccgagcccaaccgccgccgcgcccggctactcctgagggcttaggaacgcgcgccgggaatccctcctgagggatcggactccccctaagagattcggacaccccctcctggctcgagggcgcgcgccgggactcccgtcctgagggatcgggaccctcacccccggctccggggggcgcaccgagaccctgcccccagggctccgggcaccccctcctggctcggggatgcgtgccgcgggcacccctcctgaggggatcgggagccgggacaccctcctgagggccccggggcgcgcgcctcctgagggctcggcacccccaccccgggcgtgagaccacctcgagggctcaggggtgcgcgccgggacgtgccctaactcctgcaggctcgggagcgcgcggcggaggcaccttatgagagctcgggagcgcgcgccatgtccctccccctccccctcctcgggcgcgcgcgccccgaggccctggcccagccaggcgcggagggtcctccgcggcctggttttcacaaggggcagacgaagggtcagcgcagtgaaaggcagtttagccgtggggctgtcctcgccactggaccccaaacccctcagcccgggcgggcccgaacacacaatcagagccgctggcgtcccggctgagaggacggggccccggcagaaagaccccgggccccctcagcccgagcgcgtcgccgagccggtccccaggttctccctccggaaccaacctgcgcacccgcggcggggccgggggcgccaggacccagacggaccgagggccggaagtgacgccagctggcccgcttgaggcgtagggggtggcgctctccgttcggcggcgctcccatggcgcacattaccattaaccagtacctgcagcaggtgggtcctagccggggagcgcgcggcggcgtggttggccctcggcgtgttccgtgtgtcccctcctgccttggaccctcaggccttttcctttcccgcctcgccaccctttttccgttcgggtccccggcgggcagccgcgcgagccgaacagcggcggccgggactcgggaaggcggcccgagttctcccctgcagggccgccgtgggggccgggcggtgtccgtggatcgcggagtcgtcgcggtgtaagtagacgcggcggtcccaggtcgctgccctcacttgctggcacgtgtggccgcgctcccaggcggtccgaagggcctgcgggccacgccgagggcccgctgtgggcggtgctgtgtcggatggacgctgtttcccagcaggatgcgggatgaattcggggactccaggaggcgatggaggagtaagcgcgaggctgtggccgtgctgcaggccgggctcgtgcccctcgtcctcgctgtcgtttaacgcccttcactctccgagcacaatgcacacttcatatcgctcggtacatgcgtctgacagatgttgttcaacagcttgtaagtagcagaagcacagttaaaagatggacacttgtaaagattcaacgcatattctttccactaaactatgcctgtcttcagaaccagcactgtggtaacagggataggaaatatagggaatggatttttaaaatatttgaaggaaacattaccaagacgtggtgaataagaatgggtgggctgagggacacggaggagttaagaatgattcccaggcttgtaatctgggaaaaagatgaatagagtggatttggagggagaaataaagttttgggcatgttgagtttgaggtgtctgttgacaactgggtaaagatacgtacttgatagctgaaaagtctgacatgattgggcccagcagttgcttggttaattgagaaaactggttaaaacaggaatcacgaagaaatggatgtatgtttttaacttaaaacatgaaagtatacattcacttgccaattttttttttacaccacttacctcaagttctatacttgccaatcttttgatgtaagcccagggccttttctttaggctgtgtctgttttggcctaatcttwgcagacttaacattttccaatatmagtttatttaaagttaaacaaggatataggcatttaagaaccaatttgatacgattatctttagaattttcttaatcttttacaatttttcccccatacctaattatttttttaacaaactcaagtgagccttttaaaaacatacmacttagcttatagagaaacaactgtttccttttgcattcatatttcattgatgagcttaaaagtacataactaccataacaggttcgggtagcaaaaatagatttgagaacaaacacatctggatatgagaacacatacaacttagctggcaaaagcttgcgatrtattagagtgaagcctacttgctgaaagtcgtcatcataccttgggcatcagctcrtgtatttcagggagggattggagagagtcatttttccaattcaagtcagttaaagtgagactgataagcgagcttctactctatgtgtgtaaactgaagtttaaacagacagatttgggttaaagatacaaacctgagactccttcgtagtcacatgatgggaaagactgagaagggaaggggtgacccagggaacaagtagagagagtagacaggggctgggcccaggatggacttctatggagatgtgcatgcctacatctccgcaaagggcagtgtagccactggggtgagacagcaaaaagtccgcttcctcctaattctgatggataaaaatatttctggttgaactggcatgttacctaagttttatgtattaacagattcttgaatattttaagaaaataggtgcctcttcgatacagaatggcaaccggttatacatggtaacacatgtttgatttgttgtataggaacataagtgccaatgtcactgtatctctttgggaataaaaccatcatttgcacattcatcaaagctaggaagttgggggaaatcattgactcctcctttagtctcagcaaatagtcctttacctaattggatgtatctccgaagtctctcagatccatcccttctttatctgttgccacatgctccccagccaggacgccctgctgcaggtactggttgatggtttcctttactttgccctttccaagtgagacacagcaaagagaccatagactttaaagacaataagacttcagcccaaatcctggcatttttactaattctgggaccatgacaagttatctaacttctgtgactctccatctctaaacaggcttcacataagttgtgagaattaaaaagaccatgaattcacagtaaatgcatttacttagtaaatgatagttctggtattttattgaagaagagttgagcatctgcctctgttactaaaacttcattgactctctgtttcctccagggaaagttccaaatgctttagcacatcatctggtccatgtttacctgttaacttggcatcaccagtctgaaggtttatttcacttatgytgaatgcaccattgccccaccgaagtactcataacttaaaatataccatttaaccattttaaagtacacaattaagtacattcacaatattgcacaaccatcaccattatccagaattttttgtcaccccaaatggaaatgtcataagcattaagcagtcactccctggtcctccctccygagcrcttgtcaaccgctaatgtgctctctgtctgtatggatttgctgactctggtgatttcagtatgtggcttttgtgtgtctttcccttgcatcatgttttcagggttcatctgtgttggaacatgtgtcagtgtgtcgttcttttttatggctaatgatattccattgtatggagtattttgtttatccattcatcagttgatggaccacttcagttgtttcctctttttggctrttgtgctgctgctgtgaacattcttgcgcaggttttgtattctttttggcatatacctaagagtggaattgctgagtcatatggtaattctgtgtttaacttgttaaagaaatgccaaagcagctagctgcatcattttacattttcaccagcaatgtatgagggttgcaatttcttcactttcttgtcaatgcttgtttttttccattctttttattatggccrtcctgctgggtgcggagtggtatcttcttgtggcaccccatgatctttcttgtcccaaagattttcttcattatgttccttttgccaagaacacctctcttttttacaggtgtagtgaacatctttatttagggaatcagctttgagttagatactttactccttaatcttcagtagttcttcatattgtctttcaagagtttatggaattggaaagtttgactattcagaagtgacttcagaggttcatgacctgtaatgattttgaatttttaaaagagttatgagttccaagagtagatggtgcctcctgtggaccagactggagggcgtgaggggcatgcagcaaccacaaggaagtcttcctggggccagagccagggagcatcccctggtgagccaggcctgggggtgccgctcagaaggtgctcacttggagtctggttgtgtggtcccattgagggctgaaggctctgcagcatgagctgttaagagttggccaggtggctgggctgctaggggtcctgtgtccactgcggcgccagtcgcacctttagggcttgcaagtaccgtccgttgccatccctgcttttcctcttcacatccccagtcttctcacagtttagtcattgaggcaggggcattgataggaccacccctgggacacattcatgcctgccaagcaagctggggccctccttgggctcaaggccctgtggcactgagccctcctctggtcaggtcaccygtgggacactgggtgcagcccaggtaggtgtggccaagcagagcccaggatgtggcgacatcaccctgcatatgtgcagggaccaccctgggaggtcacaggcaaaggagggctaccagtragtgcccccagcaggggtctcygcctctccttggagggccccggtgtctgtactccagggtttgatcccttcgtgaccactgtgtccccagtgtgtttagtcattgaagtatgcttccattccacagtgcttgctccaagtctgggactctcagctttcagtcactcataggttccttctgcagagagctctggaggccttggcaacatcagaacatcatgctcaagtgtgacctgtcaccagagtactgatgttaaccagaacactcctcttctcaggctcctggggctgggcccagtgcaaggccctgggtggtgcgagagatcgcacagtgcggggcctggagtgcctggaaccataagcaggggtggctgtggggaactcttagcttgaacctcctgtttgtgtggaaccaaagagagcacggcttggccagcaggctccagaaccgctttctagccagaagcsccttagttgagcaaggttggagtctgttggggctcctgtggctaggcctgcccacatggcacagggagggccactttggaaggcatatcctctytggggctaaactgactaatactggttttcttgggggacttgcagaccaagacctgggtgggatcggttgttttgccttccatcccagggccaactactgatgggagggcaaacggggaagacgcagtgtgcctgcctggccaaggcagttgccaccctcatccttgagggcgctgttccattgcacctggtcagatggtctcgagggagccagaggaggcccctttggagctgggcaccagtgagttcttgcagggcgtgggcaggggacaccggaaagcctcctgcagaggatgggcagataccagtgttgtcttcttggggccatcttcagcttcttgatgatgattggcaaatgcagtgttgtaaattgcaaaatactgatctgtagcatggtgattttaaagaggaaacctaaccctttcccctaaacagctgaggatcttagtatctgtctgtctaccttttagatgaaatccctaaacctgtggccagggctatgaagagaaacttagtttccataatacttgggcccaaatcrtcttgcacccatttgtgactttgaaaatgtcaggagctaggctatgatgtgacgttgagcagcagcttgtgaccttgcatggactggggcaggagggctgcctctgaatggctgtagttttcctatgaaggcagaaaacctgcaagtcttcagatggcttcagctgaagataaagttaagttcctgcttacacctccaacccaaatcccatgggactctcccttctcctgctctgtgccagtgctgctctttctcactgacgactgtggtcccggcgacaccgccctacccactgcactcacaagcagttcaggattagggccctagtgccaccaacaacattctactcagtgatgttgaaattcaggattttttttgttttgtttttggcagtctttttgtccttagaataaggacagtcaaattccacaaactactgttttcaaaggttactcatataggtatgtattttctatttgtttcaattttaaggtttgtctttctattttatttcttgaatggggttgtaagtaacttatatttaaaggtgtgctcagaaactttccttctctctctcacctcattccacccccctctctagaaagataatcatttgcattagattctgccttctccatcctgtatttccttttgggatgtacatgtgacacacacacagacataaacacacatatttttcttgtttccyttcattcttatacaagacgcagcattctatacatactcttttacaacttgcttttttcacttaactgtatcttcctagaaattattgcatgtaaattcctagagatcttcctcattttcaaaaaatggttgcatagtgtgccttaaaatagatgtttcacagagtattcagcctgtctctatggatggatatttagtttgtgtccaatattttgtgattacatgtagccgagtacaaataccttctgtttctagttgtaagttcctggcagtgtgattactgtttcaaaatgtaaatgcatgtgtagttgtatggaatagtcaggggggaaattccttatcatggaagttagtcttcaggaaggtggtgtcagcctccctgtcataccctgagttgaacaatggggtagtaggagttgggctccagtgtgttgaactggtggcatgtgcctccctttcttctgggtatggacacctgggcacaggattactgggtcagagagtaggcgtttgcttgctttagtagaataccaattttcttctaaaaatttaccccaagttaccccatcaccaatgtgtgagccttctagttgcttcaggctcctggcaacacttggtgtcatcagccttcctagttgtaagtactcttgtgggtgtgtagagggatctcatctgcttgtgcttttttgccatttgcacatgcatgttatgacatccccggtcagtcttgtgttagcataaaatgtaaatatttaattttatcatagttaaattatactgtatctaaagctttgtgcttgccttttttcttagttagaatttttatgtcctttttttttttttttttttgagacggagtcttgctctgtcgcccaggctggagtgcagtggcgcgatttctgctcactgcatgcaagctccgcctcctgggttcgcgccattctcctccctcagcctcccgagtacctgggactacrgatgcccaccaccacacccggctaatttttttgtatttttagtacagatggggtttcattgcgttagccaggagggtctcgatcttctgacctcatgatctgcccgcctcggcctcccaaagtgctgggattacaggcgtgagccaccgtgaccggcaatttttttgtaaatataatttaaaagcatatttggttttctagttataaaatgtctgttgtggcaggcgctagatagggcaaaaggctcccgggtctcctagtctccacccgacgttctgcgcagtcagctggtgtggtatggtacaggccctgcattctttcctgtgcctgcatgttgtacgtaatttttctcttcttttttctcccaaatcaagttatacagttttcctgcagttaactttttttttcatttaatcatcatattgtggacattttctcatsttactacatacagatctattttattctttttaacagcagccgagtatcgcattgtatgaatgtgacatctatttagctatttccattttccttttattttatattaaggttgagtggaagctttttgaattttggatatatgtggtttttaaactgatttctttttcataagctgtatatttggattttcaaacatatattagtgtgattgagtaaaattagaataattcatcttcatgaagagctacatgataaaccactgacttatttttatttgcttaacctgtttttttgcttcaggaacatctgtttttgtttttttggtctgttttaaagagacgggtcttgctatgttgtccaggatggtctcgaactcctggctcaagcagtccttcctcagcctcacaaagtgctgggattacaggcctgagccagccaggaacaacctattttgaaatgaaattattgtttacgattgcgccactgcagtccgcagtccgacctgggcgacagagcgagactccgtctcaaaaaaaaaaaaaaaaaaaaagaaattattgtttacccactgcagagagtagtgaccatctgttacwttttgattgttctgtcttctttcaaagtaggggaaaatgaattttcccctgtgtggcattcagtgtattgttgtaggttctattcgaacagaatattttattttctacttaggtttccctttcaaatgtttcaggtgtaygaagccatcgacagcagagatggagcatcttgtgcagagttggtgtcttttaaacatcctcatgttgcaaacccacgacttcaagtaggtgaaagagctgtgcacacagrtgtctgcagacaattacagggtaaccactttcctaagagaagcgtagagtttgagtaagaagaaaactaatattgtcactcttayttgaaaattttaaagtttctttatgatttrtgtaatttcaatccatttgtggagcactgactatgtacgyacactgtggtgatgtggacctcctgcccttgtgtttgattcctagacagctctctgaggtttagagaagttagatggtggagaggcggtggagcttagattctgtctaggcctgtgcgtccccaaagccccatagacgtcatgtaccacaggtgtctcccatttaagttgttagtcagaaaggctggcaagccaaggcccagcctggggttgtacatggagtttccatgtcatctgtggcgtagatgatgttgaggcagtattttctrtagaaaatcttgtggacatttggtaaagccctgtttcctcattgacaccctttatcatattggagtgtgttcctactggaagcagcatttttcttttggaagaaaaatgggcttatctattggtgattatgtttggcggtgtacagacttgcaactcagaccaggtaaatcagtctctgaagtagcagcaggcctgtttttgtttttctaataaagttacctaggtgattctatgtgtagacagtgttgaaaaccattgctctaagtaggagttagtgctagagactcgatgagactcaggcttgccttggccagaacaccccatggctggtgccctgtgctttgtattgtatgacatgagaggacacacactgtcctgtttgcaatctgagacagatcccttcattgtaaaattccccagtaaactttctttcggtggtttcattcaccagggactgtagaatggtgatttttctgatactgtcattcttctctctcaccatatcagcatgggctcattgcttttgtaaacaaaaccaaacaaaacaaaaaaacgcagtgtgcttataatccattgtgtgttagtctgggttctccagagaaacagagccagtgggatatatcaatatttatagagatttagtatgaggaactgggtcctgtgattgtagaggtcaagaaatcccacacaaggagtgaattctttcttcctcgacctcttgttctattcaagccctcatcagattggccattgcccgtccacactgaggagggccatctactttcctgagtctactagtgcaactgccagtctcatccagaaacaccctcacagacactcccagaaataacattgtctggggactccacagctagtcaagttggcaaaattaaccatcacctgttgagatgttcagattatctaaaatttgactgttaggaggaaaggaaaacttagaaagaaatgtcagctagactagcccaggagatgagactggtggtctcagcaggaagccgagaagaacgagtcctaacatagcaccatctgtaactcattagacctcacttactaaacctatgacagttacttaacaagtatttcttgactgactggtcaagaatactaatatactgaaatgtatrtgaaagtgcctagaatattttctgacttgcagaaggcgagaccaaattatattcatgggcttctttttcccctgaaatattgataaatatttgttgaagtaatgaaccatttatttatttatttatttatgagacagagtctccctctgtcacccaggctgtagtgcagtggcacgatcttggcttactacaacctcccccacccatgttcaagcgattctcatgcctcagcctcctgagtagctgggattaccagcgtgtaccaccacatccagctaatttttgtaattttttttgtagagacgggctttcaccatgttggccaggctggtcttgaacttctagcctcaagtgatctgcccacctygccctcccaaagtgctgggattacaggcatgagccactgtgctcacggcctgaaccttttatttagagtggtaaatataaagtgttactgtgaactgtaaagcataaattctcttgaaacagaggtttaaatctctttctatatgttgcattctttctgtgcctattaattttacttttgctatttttcttttttaaaatcagatggcctctccagaggagaagtgtcaacaagtcttggaacccccttatgatgaaatgtttgcagctcatttaaggtaatctgttggggaggaagaaaaacacacacatctggaaattgctgaattaactggggattttatcttgcattatcttrtgcttgaagcagtgaataactgactttgaaaaagtgggaaaatgcatttgtaacttcagtttggtaaagcctgtggaaattgtaaacatcagttatataatactatttttaacatcacacagtatttagcagagtgcctgctyagtggtctttttagtagagtttggagccgaactgttcacttacccttttcgtggaaatatgtctgtttttgaagctctttacgttactgggaaagaaattagagttgagcaaagcaaacaatgctactttttatgtacacttcatatctactgttttatctctaaaggatcagttcaggcagaagattgtgtccttatagccatgtgagatttgattactgtctttcagagcagcctgggctacaggaccagtgtggggtctgtgagcaggaatgttctgtgaaccccacagggtctttggaagagttggggcaccaccgtgttccttgtagtacaaagcacctgtgatttcctagctctgtgcagtgtgcgataggttccagatttggcgatgaactaacactgacrttacccagctgggaatctagtttgaatgtcattgtcagcccctgctagagtggaagggtcatactatgttatcaacatgtgttactcataaacctgctggtgctaggtccttctgggacttgaaagagtagtctccaagcttactgtgggacttcctcttatcctcacctgtttgtgttcagccatttgtgtgtttcttccttcactcctttcatcccaggaccactgggacctgtgcaaygaagtgagctgtgtgggctgcataactagtgctaggtttttattgtgtgacagcatgtttctgtttctcctccaggtgcacttaygcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcrtttcagctctttcacttgggtacttaaatttagcayggatctgaagactcgtgcagtacttagtaaggaagaacactggttaggaagaaggatcttactctgctgagaagaagaatgctttgttgcctttagtaaggtagtaagtatatttacagggactggttaagtcctgttggtgaaataccagaaatccagaattcaggcagagatggacaagagtggcctcagatgtacatcggcattgaattgtggcagctgaagaccttaaatcaaaccaattcatacttcagtcatttaaagggtatctttagttacggcctgagtcagtgagtgtgctaaggatttgtatgtatctctagattttgtcttttcgttttaaccaccttgtttaaatatacacagaagagagttgggctatttgctcacagcctccttagaattcaagaattctagagttgataaaatcagccttatgctacagattctaaagcacttaaatataactcatgatcatctgggctcagagaaaccaaataaaatgtcagaaagggctgattttaaaaaatcttgtaagtcttttttatttaggagacagtgtgtatgaaataagtgtatttagtatacttgagcctaatgagatacagatatttgtaatgtgagcttataccttttttccttcaagaacttactattgttgcaacataaatctgctcaagggtgakctacattccttaaaatttagattcttattctttacttttatcgtacgtagcattatttgaactttgtatgccatatcttccttaatacagtacatcattcttgcgagcattccaggcccacaaagaagaaaactggtaagtgtgaacagaaacagctgaattagcaaatggcaatttttttagcagaatctttttacaaatttgctttaaataaatgtgtattgtattttccatgtggatatttggtaatcagtgtgttgacatatggtaatatctacacagatgagtggagtcacaaatctagtaaactgaaatggtagatcagccacattgtttgcagtgtgtctatgtcaatatagtattatttttatttcagatgtccatttccctagatatttattaaatactgttttttccttcagttgtcaattttgaacttttggttttaaaccttagataaaagaggtagaccaactacrgttcatttggggtgttctaatacataataatggtggtatttttaaatgccttgccaaactaaattttatgatttattaacaaactataggttaatactgaaatttgtttatactgaaataaccaaaggccttttgcaaacaaacccgcccttttatctttttttttttttgagaaggagtcttgctcagtcgccgaggctggagtgcagtggcgcagtmttggctcactgcagcctctgcctcccgccacccttttatcttttaacgtgaaaacttgcacatgaaaacagtccagttttgccagttggctgtaaaagttgttttgtgacattttgtgtattacatattctggttcctgttaggaaatctgatcaaaccacttcttttttagtggtgctgtttggatactggtgggaagctgaggggaggaggatatcctgggagcccagaactgaagcagggctgaggtctctgacagggttggggacaggggtgtggagcaccgcattgtggggccccaggatgatcaggaagtctgaggcctgcagcctgcctggacagaaggtgaggaagcagacaactgtcagagttttggataagtgcggactccattctggatagtagccctgggtgtccgtgttcttcccacctctggggatggaatcttggcccacgtagcccctcacacttgtttacttttttgccctgcagggctctgcctgtcatgtatgcagtagcgcttgaccttcgagtgtttgccaataatgtaagtttaatttgctgtcattattattttaaaactaaaacttggtgactatctgttgtttaatttcatgtcattcttcccagaagttttgaggagcaaattggagttgagatgtgtctggtatagggagcaaaagaaagatattgactattctttctgggttaacaccaacagatttatataaacatttgctcagatttccacactrttcatatagagggagaggttccattttgtggttaaccatttatggtatgtgttatttttatgamgtgagtggaacaacaacaaatgagcttattctgcatctcttctacctttaagatgtggcctgctcccccaccaaaaagaattcagcttcatatagatttgggcagtaggagggggcttccctggggtgaagggagatcctgggttttatggaggcgacgtccccatggggacccacggaagtccccattatggagcagcatttgtcaaccttttggttttaggacgacccctttacagttttagaaatgattgttgacttcagttccagtcaggatgcaatggatttcaccctattgtgcctgctagaaacagttaaaaccctgggagttgtcaggccggcatggctatgggaggtggagagaagagggggatggggctcagagtcacgtgtagggagtctccaggtttcctttttgtctcctgtctgtcctggactgggcgcgttagaaacctgaagcctttcaccatcaggcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggrctgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaactgaaaagtatactgaagacctcagaaagcttttatttttgttatatctatttatatttactgtattagaaattttaattagaaaagattttaaaatattcattttaaagcaacaataataaaccttttacatgtaacataactgactttttaaataaaaaataactatatttccaaaacaaaatactaagaaaagtagtgtcacatcacttttgacctctttgatgtctagttcagcagaggcaatctggtccccttgcctgcttctgcacttactctgttgcagtacactgttttgagtaaagtgtttctctgcctgatggtgaaaggctacatcacaaagttgtagatggaaaagagaggaatattctcataggctttccagaccattgagataattctttgactctatataggaaaactccaagaggcagttttttttttttaaaaaggttagttacaatgtggcttctgaagtgtaccaataaactttttctacctttacactgaaatccactggtctgcctaaagcactgaatggatttcgtaatatcttgtgttagtcatgtcttagtccatttgggctgctataagaaaatactataaactgggttggcttgtaaccaacaagcatttatgtctcatagttctggaggcagggaggtccagatcaagtcagggaggtccagatcaagtcaggcagggaggtccagatcaagttgagtttctgatgaagagggccgcttcctggctcatagcatcttgctgtgtctgcacatggtagatggggcaagggatctctctttcccattcatgacagcttcaccttcatgacctcatcaccttccaaaggcctctcttccaaacaccgtcactttgagggttaggatttcagcatgagttttggaggggacacaagcattcagaccatagcagaccatttggagtatattagcttactgagccatgcagcacctcccaagtgctgatataccactgttaaaaacccaacccccaaacccctaccttccttaacatctccaggggcstcatcagaaaagccttggagtaaggaaaagctgctaagctcacagtagttcataaaagttttccagaattctggtttttcttgaaagcacaaatgttgtcattggcaacgagtaccatcagttgtttgcctggaagtgacagatttgttctattcgttttggagaatatggtcagccagatgcccaagcctgggtagctgtgtctgcctgtcagttttctgttctgcaagaagcagctagttcagctcacagctcagacagctgcccagagcttttctgtaaacagccatgagacacccgtgtgcaacagaagtgctgtatgcttctcatttcatcacaaagaatataaaaaacgtgtgctcaaggaccaagatttaaraaaattcatatttactgcattatcaaggacattttatttatttatttagagatggtcttgctctgtcacccaagctgaagtgcaatggtgcagtcatagctcactgcagccttgagttcctgggctgaagcctcccacctcagcctcctgagtagctgggactacaggtctacgccatgataccgggctaatttaaaattttttaattaagacagagtcttgccatattgcccaggctggtctcaaactcctgggctcaagtgattctcccacctcagcctcccgaaagtgctgggattacaggtgtgaaccactgtgcttggctcatcgaggacattttttaaaggaaactaattttactggtttgttgattgactgattgattgcagagtgtctggtgtttaagaacgtggtgattacttgcgtagtttggtgccggtgggagcactccagcattttacctattgctgtttttgcaccatcagtgcaaacgttaatacagtaaaaaaagaccataatggcttagtgttgttgtgaatatagtttgagctgtgggtcatctgcaagcctgttgcaggcctcgggtttgtggagaacacaagtggcagaaacagactctttcttctttaaccaaggccatcctcccaaatgcgagggaaaagtcaaactcagtgatgactttaatatttgttaaacgtttttatttcaagtgttttgactagccaacttcagggactgaagagagagcttagttgcttagtaacatatgcagtgcaggtttgaaaaattggtgactgacttaacttgaaataattgaagaaagatttggtttgtgaaagaattggagtaatacagacttctcaatttttaaaaatattatagtacatgctagctgatttctccaggatctttcgggactttgagtcttaattgtacccattttttgcttcaagaaataaatgttttggctgggcacaatggctcatgcctgtaatcccaacacttccggaggccaggatgggaggattacttggagtcagaagttcaggaccagccagagcaacaaagtgagaccctgtctctacaaaaaaaaaagaaaaaaatattaaaataaattttaaaaaaacaaaacccaaaactagccaggcatggtagtacctggttccatggttccagctcctcaggaggctgagatgggaagatcagtggagcccaggaggttgaggctgcagtgaggtgtgattgtgccactgcagtccagcctggacgacacagcaagatcttgcttcggaaaaatgaaataaaagttcttatattttattaggcagatcaacagttggtaaagaaaggaaaaagcaaagttggkgacatgttggaaaaagcagcagagttactgatgagctgtttccgggtctgtgccagcgacacgtgagtaaggacttgargaccgaccaccagacgctgttggtggtgttttcattgcagcgttcaccctttctggcctgtgtttattgttgacacatatttcatttctacacatgctataatcccacarccrttgttatttttgctttaaaaagttgattgttttgtaaaggaaataagagctgagggaaaaaagagtcttcatttgcccacatttgaccatgcctggagctcctctctgcaggaaccagtttccgtctagtgccatttccctttcctgaggcactttcttccacatttgcgtttggtgagggtctgagggcagtgaatcttttaagctttcatttttctgaaactctcgttattttttttaagaaatgttctctctttaccagtgaagaagcagcactgatcaccttcatttttaaggctccatttgctacatggagtctcgtgggttgacagttttttccttttggcactttaaaaatgtcattccatctggtttcctttgcttctgatgagtccttgccatcgttccctgtatagaatgggtctttttcctctggctatgattttctctttatcattggcattcagtaatttggctctgatgtgcatagttggttttttttttttttttwaatttcttctgtttagggttcattgggcttcctgtatttgtaagttgatgtttttaaaaatttaatgttttacattctttaactacttttggccccattttttctcttctctttctgggatttcaactgcatgtgtgttaagtgcatgatattatccctcacaggccgctgttagtctttgtttattttttaatcttttttttttttgagacagactcttgctctgtcgcccaggctggagtgcagtggtgccatctcagctcactgcaacctccgcctcctgggttcaagccattctcctgcctcagcctcctgaatagctgggattacaggcgcatgccaccacgtccggctactttttgtatttttagtagagatggggtttcaccatgttggccaggcttgtcttgaatttctgacctcaggtgatccaccctcctcggcctcccaaagtgctgggattataggcgtgagccactgcacctgacctcaatccttttttttttttttcctctccttcattttaggtaatttgtattgacctgcttacaagttgactgatcttttctgccattatttatttttaaattctcaactttccgtctgattctgctttagaatttccattttttcttctaaaactcccatctcttcaccaattatataatcacatttatttatgagatttaggaaattttaaagcaaagaaagattatcaaaggtatccatatataaataaacaaaaaactattgttcccagagagtagttgttttagtcctcttgtgttgctataaaggaatacctgaggctggggaatgtaagaaaaggggaatacctgaggctggggaatgtaagaaaagaggggaatacctgaggctggggaatgtaagaaaagaggggaatacctgaggctggggaatgtaagaaaagaggtttatttggctcacagttctgcaggttgcacaagaagcatggtgctcgtatctgcttctggtgaggcctcaggctgcttccactcatgctggaagacaaagaggagcccactacatggcaagagaggaggcaggagatagaaggggaggcgccaggctcttccacaaccagctgtctgggaaygctcacaggagctcagagcgagaactcattcattatggcaaggacagcaccaagccattcatgaggggtccacccccatgacccaaaaacctcccattaggttcctcctccaacaacggggatcaggttttaacatgaggcttgatgtggccaaaaaaccacatccaaaccatagcagtagcccagcttctcttttcactcattgtgtttgttgccaataaactctgtagcctcaaaagatgggaacttttccttttgggtgttgtggatcccatccatgaaaccgaaagtaagtgttgagcagagcaagctgtatgtaaaggccaaggaatgaagaagcaggagtgtggctcacaaatcaacttctctactcctgaggggtgaggggattgaaatagagggtttcttgaatgaaggggttggacattgaaagcaaggggaagaatattcatggcttttctggaaatggacggtgaacttctgggagctgaagcactgccatctttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacgtgagttacggagtacttgtgtgttttgtttggtttttccatagctctttgaagtcatagaacagtattattatttgtctccgttttcagatgaggaaaacgagaccttgagagacttttgtttgaggtcatgcacgtagggaatgataaaagtcatagacctgcttagagcagctcacaggcagttataaaacagggtttgatattttaaaattgtatttttacattattttaagtgtttctatatggacacattttggtctttaagagtaattttatgttctgtggcttgtaaaccacctgcttgttttctgtactgggcacttttgtatttttgtgccttgactttgagtgattttatcattttgttaacaccacagagtgtacttcgtaaaccgagatggcgtggcctgctacacacccccgctgtgtggcgcagcctgtgggtcctaggctgcgaggagcaagagctgcactaaatgctgtaggcagctggaacacagtgggaattatttgtgtgtctaaacagatctaaacacagaaaagatgcagtaaaaatacagtgtgagactccgtagggccccatctcacatgtggtcaagtgtgagactcygtagggccccatctcacatgtggtcaagtgtgagactccgtagggccccatctcacatgtggtcaagtgtgagactctrtagggccccatctcacatgtggtcaagtgtgagactctgtagggccccatctcacatgtggtcatctgtagttgaccgaaatgttgtgtaacatgtgactgtttccaggttaattgcagacagtggcacaccctcccctaggttcttcagtttctgttttttcagtcttttgaggtaaaatttgcatgcagtgaactacctacagtattatctgtctgcttgctgctgaggtataggacatgattgccaccccagaaacttccctcatccctcatgtggggcaggccctttcagctgtctggatttgttccactgtgggttgcttcctgcctgttcggtgacttcatgtaaatggaccaccacagtgtgtactttttgtgtctgccttggtgggactcatcctctttgtgtgttttactggtttgttttgtcgtactgatgagaagtatttttccatttttcttttctttttttstttttgttttttgagacggagtcacgctgtgtcacccaggctgaagtgcattggcccgggtttgagtgattctcctgcctcagcctcctgagtggctgggattacaggcacacaccaccatgccctatttttccatttttcaaaaacggtttataacaattaacttttacgcattgttgctgcaaatgaggcagtttttagctggtgccgcggaggaaggatgttactcaagtagttaattgggattttcctggtttgttttytcttttatttttacccatcaggtaagacatcttttttcataatgttattttgtttgatgaatatgacttgatatgaataagttgatatgaatatgacttgagctttgggacttacctcaagatattaatttgtttaggcagtttattttgtgatttataaatamaatttttatttcctatgtaacttaaaaaaaattatttccccatagccgtgctggtatagaggactctaagaagtggggcatgctgtttctggtgaaccagctgtttaaaatctacttcaaggtgtgcttctgtttgaatcctttctgtctttacaattttcgattgtcctggrcttcccacatatcatatatatatcagctagcctccctggcgttgcttgtgaaatgatcataaccgtattcctagtcctaatagcaaacatttgttgaatgcctactaggtgcaaggcactattctgaatgctttacaaatgtcttcctgttgacaatcagccctctgaggttagcgctcccagccccagaggaaacgaaggcccctgtgtgtgaagcagctgtcccagtgtggtggaattgggctttcagtgcaggcggtttcactccagagcgttttgtcttctgtggtcataattaactatggaaaagcaggcacgtagatggatagatggataaagaaaccattgccacataaagtcagtcaggtgaagagcagcccatcacgtgtcagcagctgggacttgtgccttctgtccagtgccttccactcctgtagagcaccccaccttcctgccggtgctgcataagcacaggctcctgcagggctgcgccccctggaacggcttcccagagcctccacaagcacgggctcctgcagggctgcgccccctgaaacggcttcgcagagcctccactagcacaggctcctgcagggctgtgccccctggaacggcttcgcagagcctccactagcacaggctcctgcagggctgtgccccctggaacggcttcccactgcagggctgcgccccctggaacagcttcccagagcctccaccagcatgggctcctgcagggctgcgcccccggaacggctttgcagagcctcccagggtgaatgccatctatgctggctgctctctgttttggttttattatataaataattgttatgatataataggttttgtaatttgcattttaaggagacatgcttagtaatttgttttgccacctgtttttgttgtttttaartattttaaatggattgttattcattatagatcaacaaactccatttatgtaaacccctaattagagcaattgacagctcaaacctgaaagacgattacagcactgcacagagagtaacatacaaatactacgttggacgcaaggctatgtttgacagcgattttaagcaaggtatgttgctaatctttttttcccagtattttaaataagacattgcattctgaacaactttgaataatatagtttcagagaacacaattactgtattttatttttaaatgtggaccaagttatatatacatatttgacactaaagctgattaaagggaaattatattgaagattcttaatccayactgggtctctgaagtgcatgctggagtctcacaggcattacagacatcgtttctgagttcactgagcatgactgttctcagaatagaatgtaaatcattgttttctttatttgctttttgaccctgtaatagatgctggttatgttgacataggaaatggagattaggacaacatttagttcagcgactgacttcatgacctacacatcccgcatggagatgacttagaagcaggggatatgcccttggacctggtgtcaaagctctcgtttaaacagcctcgtgcagtgtgtcgctaccacagagctcctgtttaaacagcctcgcacggcgtgtcgctgccacacctgacactattgtattagtttacgttggtaactttctcaagaacaggaaactagtcttctttttgtaatttttatcggctgtcacggcatcattcttggtgatctcttctctygtgctcaaaccagactttaaactcttcttcagctgtttgtggagcacacagtcccaagtacatgaagcaacataactttaggcaatgcaagataaataatagccctttcataaggacgctctggctttttattctataggcttktatagaccatttcctttcacagtttttactctgtgggcttgtatggactgaccatttcctttcagtttttagtagatctagggcttttaaagaagggcttttcttatctgtctctttttttttctcttaatatgaagcataaaggtagagaagcttttaaattctatcctattggattttattaagatactgattttttttcttctgaggattcagtaagtggtatttttgaatacctaacatagccagaaattgttattaatattgatgcgacatagtcatagtttctgacatctttagagctaaaaagtttgtttaagtctgtatcatccaaccctttcgtttgactataaaagaaataggaagccattgagagtgtgatgctctgagattactgagtaattctgtgtccccaaaaagccagcgctggccatagatcttctgccttgtagctcgcagagattttgttttccattttactgctaggaattcctagagccctgattgtatttaagtggataaaatgtctgcagagattgtggtgattttctttcctgtgattttatattatttatgtaagaaagagtatttggagtatctcagttgttgtatgtatacttttattaatttattaatttcagagatttatacccctctacatatttttgactccaaccgaaatatattatttgatgcaaaatgacttaggttccctcaaagacagcagaaaaatctcagcttgcattaactattagaaaatgcattttttggccgggcgcggtggctcacgcctgtaatcccagcattttgggaggctgaggtgggtggatcacgaggtcaggagatcgagaccacggtgaaaccccgtctctactaaaaatacaaaaaattagctgggcaacggtggtgggtgcctgtagtcccagctactcgggaggctgaggcaggagaatgacgtgaacccgggaggcggagcttgcagtgagctgagatcgcgccactgcactccagcttggcgacagagcragactccatctcaaaaaagaaaaagaaaaaatgcattttttgtacatccaggagaatttgagattaccttgggcagtagcaaaggtacactttttagaggctagtttgcaaaagtcaaactggcagctggtgggatattgcagactctcagtgaatccttgttctttggtctcagccccacagggctcctcgtgggtcatggctttgtggtttggaagagacgctggccccacagcattcacgctcactgtgcaagactggatgttttttgtgccaatgtggccacatagtttaggagcagaggcagtgtgtggtctcagtgtggrttccctaggcctcgacccagaccccagggcctgctgcttctggtgacccattctgcataagggagggcctctgcagctctgagcatctctgttctcttatatttgggacttaatatcactgttcaggaagaacttacataaacaggaacatctcactttcctaattcttgacccaaactcagccttagtgaagcctcttctcttcacctagggagaatgtggaatcattgtccagaaacccctgacccttcagctttccagcctcaggacaaggctcagctcctgcctgcctgttctgagagttccttgttagcatgtgctgaactctttgcaggcctgtcgtgcagtttgtgggattaatcttgacaaatagaattacttttgtattttgaaatctattaaattcaaatctgttttttaatattgctctcaggmcagaattaatatgttgtgtgttagtaataataagttaattttttaaagcatgtggtcatttaaaatggaagatatatgatcactaattatatgttaagctggaggatggtgttttactaagttattttcattgtttaattatgggtgattaaaatgtattgtggaggtacatttttaaatatgtctttatatttttcatgaatgtagaaatcatctgagcagggtcagacttttaaaatgttatcataatggtttgccagctgaccttaggcaaatcagaatctctgtgaaagttattttcttcagttttcctctgttaagtaggacttcccaggcagttcctgttgaatttgggggtatggattttacttaaggaaagtcattgatcacagaaatgaaactgggatgatattttttgagataataaagggagggggcttttgccttttaaatcaggagacagtggtagaaaatggagcaggaaggggcctgaagcaggtgcgttggtctcatgcgtgctggctctgccttctttgcagctgaggagtacctgtcatttgcctttgagcattgtcaccgttctagtcagaagaacaaaaggatgattctgatctatttgcttccagtaaaaatgctattggtgagtgattattactccaygtttatagatcctggtgctttcacaaagttgacagctgataggtttttttaaaacctagcagacagtctgtagttgatcacagcctgagctgtgtatgagcacaccccaaaataaagaaggcgcatgcattgtgtgtggcccaaacccagagcttcatgccttacgcctccaggtccttctagaaaagctctccctgtgtcttgtttcccttaaaagtatttaactcaagagtttaacgttcatgtgacaaaataagtacgtatcatttgtattcctcccttaaaacctaagttaaaagcagtggattcaccaagaaagaaaaatgtcatttcaccctctctgtgggtatttcatttagttactaaaatgtatttttgatacttgaaataactggtaagttaattgactaatgagaaaagcattgcacacaggtggctaaagcttctgtagctctgaatggattgtgatggagaagcgctgctgtggccttgccctcctcacttctcaccccatttaactgacagccagtttcaaatgcttagctgattcttctggaagctacttccgtatgcctacatctcatgcttatactagcatttcttcagttatcactctcctgttatagaaattcgaagaaatgtgagaaggtcaagatcaaggtcacgtgtcatggaatgacaaaagtgtgttgtacccaggtgttctgatttctagacctgtgttgttttcctagtgtactatgatgtgtttaatccatggacattctaagaaactcaggttgcaattttcttaaaacttaattccttgatatgaatatttatcaaggacaattttgtcaaaaatgaaagcattttcattctggaaaattgactcttagggtcacatgcccactgtggagctcctgaaaaagtatcacctgatgcagtttgcggaagtaaccagagctgtgaggtagagtatgccatccttcctgtttggggttttaaaaatgcaagcctgatgagagttgacgtgcacgctctgtgagaaactcaccctccttctgacgcgcctcccccctcaccagcgagggcaacctgctgctgctgcacgaggcgctggcgaagcacgaggccttcttcattcgctgcggaatcttcctcatcctggagaagctgaagatcatcacctacaggaacctctttaagaaagtgtaagcatttccccggcacattgggctcccagtgtggctctcggcagagcagtcagacatccagggctgttgcagtctaagagagaaggccaccgtgtgggtggggtcgttatcttccttccattgtgtgggataaaatgaagcctccgcccactgcctcctggggaccctgcgcgagacacgtgagtagcacaagctgtgcctggacttgtgggggaggtaagcaggttctatgtgagaagacaacttgagaacatcagccctgagagccgcggtaccacatttcatcagagcacacaggactcgccactcactcccctcccttagtgctgaccaagtagccctcccagccacttctgcctgtcacaaaggcagatgcagagatcgtcattcctttcctcacacgtcttctgaggcctcgtcccagcaggatctcagttgtgtaaacttcaggcaaaggccaactttgtatagagctgtgggtagcacgtcacaaacagtagggaccctatttcgctgagtctgtgagacacagcccattgtcaggtgcttcctgatttcagggagattaaaatgtgaaaaaaaaaaccgaaccttaatgaaatacttagaaaataattaaaaattgtgtttgtactagtgactttttaaagattgaaaagtcaaattagatttaatagctctgagagtgtagtttagagtttatctaataggtgggaatttttttactcytttagaacacyggcttattaagaggtgccttttcttggctgtggagtattgcatcctgtcggtaaccacagtgcccttctcctcccctcttccaggtatttgttactgaaaacacaccagctgtctctggatgcttttctggttgccttgaagttcatgcaggtggaggacgtggacattgacgaagttcagtgtattctggctaacttgatatacatggtgtgtgagtcctggttttaatttaagcagctactcacagcaagattcagcccagaatytgaagcttcagtgtggtggtgttaaaattgttaaaaggccttctgctttttttttgatagaactaattttagcccaggaaataccattcaccagggccttaggagcatgaggggacggatactcttgtatgtttgcatattctttactggcggtacatccctcggtatctgtcgattctccaacccccctcggataccaaaatccacaggtgcttcagtcactgataggacgtagtatttgcatatgagctatgcacgtcctcctgtatactttaaattatctctaggttacttaaaatactcagtgcactgtagatagctgttgtactgtattgtttagggaatcacggcaagggaagagcgtctgtacgtgttcattacagatgcattttttttccccaaatattttcagtccacagttggttagattcatggatatgaaacccaccgtggatatagagggttgattgtatttatttttactcattgtcttcccgctgaactgaactgtgccgctcttggggaagaatgctaatgccaaattaattagatcaccyagcatctttgacatgactcagatccaaaaatgtaaacgcattcctccctttctgccccgcagggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatrgggttacatcccaataaacttattttatttgcctttgctttgttggttaaaaaaaaatttcttttaaaaaaccatcttaaattgaaaatacatttaatacacctgctactaaacattatggctcactctagccttccttaacatactcagaagcctccactcttaggcaaaatcaaacacaaagccgattttattttataataaagtgtagatgccgggcgtggtggctcacgcctgtaatcccagcactttcagaggccaaggcaggcagatcacctgagattgagagttggagaccagcctgaccaacatggagaaaccccgtctctactaaaaatacaaaattagccgggcgtggtggcgcatacctgtaattccagctactcaggaggctgaggcaggagaatcgcttgaacccgggaggcaaaggttgcagtgagccgagatcatgccattgcactccagcctgggcaacaagagcgaaactctgtctcaaaaaaataaataaataaaaataaaagtgtaaatacctcgtgtagcttaccgagtgctacactgagagtggaaactgaagggctgcgtggacgctgaggcatggctgcccctgagcgcgtcccttcggcaccacggcgaggttgacagtcgctaagttgggccactcacattgggctgttggggctgccatcacagaataccacaggcagcttaagcaacaggaatgtatttcctcacagttctagaggctggaggtctgactgagatggggttgccagcacggtcggcttctggggagggctctcttctgagttgcacacttaagaataaggtggtattccttgctgtgctagagatggtacagatagagatgactctctccctccttttttgagacaggacctcactctgtcacccaggctggagtgcggcagtgcagtcagtgcttactgcagcctcgacctccgagactcaagtgatcttccctcctcagcctcccaagtagctgggagcacaggtgcatgccaccacacccaactaatttttttattttttgtagagacagggtcttgctaatattgcacaggctggtctggaacgcctgggctaaagcaattcccccgcctcggcctcccaaagtgctgggtgacaggcatgtgccaccacacccggctctcttcctcttacaaggccacagttctgtcggggcaattcccccgcctcggcctcccaaagtgctgggtgacaggcatgtgccaccacacccggctctcttcctcttacaaggccacagttctgtcggggcaattcccccgcctcggcctcccaaagtgctggggtgacaggcatgtgccaccacacccggctctcttcctcttacaaggccacagttctgtcggggcaattcccccgcctcggcctcccaaagtgctgggtgacaggcatgtgccaccacacccggctctcttcctcttacaaggccacagttctgtcggggcaattcccccgcctcagcctcccaaagtgctgggtgacaggcatgtgccaccacacccggctctcttcctcttacaaggccacagttctgtcggggcaattcccccgcctcggcctcccaaagtgctggggtgacaggcatgtgccaccacacccggctctcttcctcttacaaggccacagttctgtcggggcaattcccccgcctcggcctcccaaagtgctgagtgacaggcatgtgccaccacacccggctctcttcctcttacaaggccacagttctgtcgggttaggaccccacccttatgaccacatttagccttagttaccccctgaagaccttacctccagatacagtcacactggggctaggacttcaatgtaagaaatttgggggacacagtttagtccccagcactgccatttttcagagtatgcacatttccccgtttataaaaaatttactaaagaagaacacaaaccataagagctcatctttgcaaagttactgcatttgaaagctgcttgttcaaggagaggctattctacaaagtgtgaatccctctttctctctctccgggccgcgcggcacaggactcactttgtgtggctccttcctcaggttcccctggatgcaggagctgccccagggcttcagcagcactccttagctcgctcctacatctgcaggtctgcagtttcttccgggctgggcggggaagcttgtgggctcttctggggcccgaatgggcctctttgaaggtgactcattcccgtgtattggcccgggctctcacctggagctcagcagggctgtgggtgggctcccctgtttctctccacacgtagggagctggattctgggagcgcagatcccagtagagccagggaagccagatctcttttatgccctgctctcctaagtcacacccggattccagccgtggactgccacacgtacacgcgagagatgaatgcacgaaggcaagcgcctgtgcctgtggagttcatgccaaggatcctcttgacctacgtagctgctccccagcagcagcaaggtcctcagcgctggcagtcgtgacaagtgcctcctatgtcctgtggggcagacacggagcaaactcatgccggcggaggctttgggcgcgcatctgttttctagctacccatgtgtccagtggggccccgttctcttgcagtgttgggtacggaaatctgatcttccctgctgctctgcatgggccttgaacatccttcaacttttgatttaaatgattttcttgcagtaatttgaatattggaatttctgccagcatacctgaatttcattctggatgtaatagcggtggaaagctcaggtttgtcaacatttctgggtaacgtattgaaccgtccatagtgacacctaaagtcaaggattgatactttaaggtaattggatggttattcttagcgatgaaagaaacaacctcagtgtaggtgtccttacgtttacctcttggtgttcaggcctctgtcagttcgttctcacgctgctataaagaactgcccgagactgggtaatatgtaaaggaaagaggtttaatggactcacagttccacatgactcgggggacctcaggaaacttacaatcatggcggaaggggaagtgagcatgagcaaaactgccacttttaaaaccatcagctctcgttagacgccctcactgtcacgagaacagcgtgggggagccgcccccgtgatccaatcacttctccacacgtggggattacaattcaagatggaatttgggtggagacgcaaagtcaaggcctgtgtccagcatggcagcattcaagtccacgggcgtacacatgggcatgtatcagtgtgtttgcatggattcaaatattggacttaataatctctgcccaagtgtgaactagtttggcccttttaaaacatcatcacaggctggatgtggtggctcacatttatgataccagcactttgggaggctgaggccagtagattgcttgagccctggagttcgagaccagcctgggcaatatggcaaaatccatctctgcagaaaatacaaaaattagctgggcatggtggtccacacctgtagtcaggaggctgaggtgggagggtcaattgagcccaggaagttgagcccactatgagctaggatcgtgccctgcactccagccttgggtggcagacagagaccctgtctcaaaaaacaagaaaaacagtcatcatagctagcttcccttttcttgagttttactgttttgttagatttgtttatggtgtagtttctaagcatgtcattaaatgccagtagagtagttacttcattttgaaggcccctcatgtctctgctgacagtctgggcctgtagctttctctgattgttcctgatttcacagatttcaccattacggagggagggtcttcatatgctttgcctctgcccagctgtgtttgaagtaggtttttttttttttttgagatggagtctcgccctgttgcccaggctggagtgcagtggcatgatctcggtttactgcaacctctgcctcccgggttcaagtgattctcctgcctcagcctcctcagtagctgggattacaggcgtgagccaccacacttggcaaagattttttttttttttgtatttttagtagagatggagtttcaccatgttggtcaggctggtctcgaactcctgacctcgtgatccgcccgcctcagcctcccaaagtgctgggattacgggcgtgagctactgcgcctggactggaatagttttcaagcagggcttccactctagtaaatccaaatttgtaatagaagtaccagaagcaagattgcagacatttctgcagcattatgtacagaaagcctgccatgttcattagctgattttaaaatcattagtaggcatttaaagcagtgacttacttaccttattgtagtttgagaataatacaaccaaacttcactaagactttaaaattcaccctagtgaattttaaactgccctccccattaatttgccttaaattacagtgttgctttttgccaaggacctttcagagaaatgggccatttcatctacaggttggagaaaagtttaattctggggttaaagcgtaaatgaaagagagtgtgctgaagaacagtaaggcttaaaaacccaagttatgtgtaaattgttctcaactcaagagaatatttgtccacctacatttttaattcctctttttaaaagtcctctctgctcttcaacgatgctctgctctgtgtcactcaaggacactggtggagaagcagctgtgccccttccttaactaagtcagagttaaaatgtgaacatttatgccatttctgtccatttcagtgcaaattcagaccctgctaggagctccagtctccaaggacgtttcactgggggctggactgcagctctgtctttggtacttgcattgcagctgcagccttcatgacagcaggtgtttactgtgattcagcacgtgctgtcctggtctgttctacaaaataccatggactgggtgataacagaaactcatttctcacagatctgggggctgggaagttcaagatctgggtgccggcagatttggtgtctgctgagggctctctgtctccagggtagcacctcactgcagtgtcctcgtatgggagaagagatggaaggggctggcagagccctcatggcctagtcacctcccaagggccccacctccccatatcatcatcttggggtaagttccaattttggagttttgaagggacacacactccagccacaacagtgctgggcgttgccctagctgcccatcagcccattggtgaggtgctgggattctaccctgggcgaccctgaggcatgaagaggtggaacagttgtccaagagccacctggtgggacgagcagagagctgggtctcagtgctcagccctgacttcgggccccggaaccttccgtgggaaccctcccagagaagggcgggtgcacaaccccgtgagacgccggcgtgcctcctcagcctctcttgtgctctctggccctttcctctaatgctgcctctctgggatacccacagggtcattctcctccattgccaacctgcttctagtggctgcttctgcactgagccatggtcctcagtcacagtggcaattggtaaaccaacagaggaggtcactttctgctgtaaccggagattgttgtcgcttctgcaccagaacacactcaccagtgtgcaggctggggtggctattccctgagcacagggaacactggacttggagaaggaaagaatttctggaaaccaggctgctttatgactgacagattatcttattttattatttaacgtatctcatgttttcttttaaggtctctattgagataaagagttccagggaaagaaaggtcacagtgctcggtaaacaacccagcaaacggcggctctgctgctgcgtgggccaagcgggtggtctggggctgtgacggcctctcagtgtgtgatgaagtttcagcgccctccacagtggcagtgccagcttggaatcccgcttccggttgtgttgttcattctggct

SEQ ID NO: 12561 - DNA, 206330 bp, Homo sapiens
tttagtaaactgtatcgaaacttatctacttggaaggcaaacaatgtatgccacaaagtcatccagaacataatggaactcagaatgcaataggaaaaaatttaataatcaattcaatttcaataaggctgtttcttgtttgtatactctcctcacttcgagtttatatactttaatatttatagataattttaacaaatacatttatctggtgtcaaattctataatggattacatgattagatgtagcaaatttgaaaaagggcatattgtcaatttatcaatcaacaatctgaaaatgaggaggcaagatagaaaactgtgtgtgtgttaggaagtgtggagaagtggtgaatcacaaataccagaagtcctttttgattcaaatggaaacagtctcacatccttcagtaagccccgagggtgtcactgttgaaattcagaactcaaactgtttgtcatgtttggttgagcccaggacatcaagcaaaggctaaagtattttcggtgtatcctatttatgaagttgagattgtgtgtaatccagatagaattttaggtgtcttggtgcttaaagagatcaaggatctctttaggtaccatggggtacttcatccttgacagactggattaagcaagattttctgttcctcttatttggtattaactgtctatttgttcagatatccaatgtcttaatcctttcaatacacaaatctttattgagcacctacttgcctggcaccattttaaacactggatatgtggcagtaaacaaaggagacaaagtctgtacctttataggcttatattttaaacggggaagacagcccaaataaataaggaaagtacatggaaattttaaaagttgtacgtgctatgtagaaccataaagcagggtagcaagaaggaaatgtctgtgtttatgagttgtaattttaaatagatttatgagcaaagatgtgaggaaagattcataggagatgagagtcaaatgcaacagcaagtataaaagtcctgtcataggatcatgccaggtggtttgatggacagcaagtggtaagtgaagggagatgaatagagatgatgtcagagaacaactgaaggcagagatggggcacaaatcacatgagccatggcaggccactacagtgaggactttggttttgaagtatgggatttcgtagttactattgtagtataatcacccaaaagatgatggtggtaggtagtagtggaggtggtgagagtgatatcttggatatattttgcagatagacagaatagatcttacacaaatatatacggggtattagagaaagaaatgacattaatatgatactaaagttttcagcctgaggaacaagaatgaagttgccatttcagaagtggcgaggattggaagaacaggtttaagaaggaagaacagtagttcgttcatggccattttaagcatgagacacttacctatcagacatctttgtagaagtttcaatatagctctctctttattcaacaattgctggtgttagtagaggaatgatgaagtttttagaaggtgccctagattcagtgttaattaggggtaggtggcaagaagtttcccagagaagatatctatgctgagacctaaactataagctccatcaagacagagccaaaaagtctctttatttttatttaaaaatctgttggcaagccatggtggctcatgccttactctttagctgatgattttttttttttaatcatcaagaggagtgtgaggatagggcaatagaaattttccaggtagagggaacaacatacttaaagttggaggaccaaaaggatcatagcatcttcaggagaccatcaagcacagtgtactaattaccttccaaactgatgcttgtatagtattttagtgtttttagaagtactttctcatagaccctcatcatagtctctgaaaggtagagaaatgtttttattatcaatcagttggtgtgaaagtaggcttacgggactcagttcacaaatctagttaataataactaaggtttgaacttgggacttatttcgtcaaaatttaaaataacttcttatgtttcgaattatctaaaatcttgtcatgcatccactgtgggggggtggtggtgaggaaatatacatagggaatacatatattttgatattgaaaaaacatggaaactgcaaaagaatttacaagatagaaatgagtaaactggaagatgatgataatacagtcatagctgtcattttcaattagggtgcaccagatgtggtactaggatctttacatttatttactaaatttaatctcacagcagttgaaaaggaggctctgttttcacctcaatttgagagatgaagaaattgaggctgagagagactaaagcaacaccttggaggtcattatacagctaggaagttgcagagtcaagaaatgaaccaagaacctctgaaatgagagttcaggctcccaatagcttggtgaggagctacaccacctgggccgtactttattttcctctttataacgtcaaaggtaaaattaacaactccaaggaggttctgatgagtgacaaattattttctgaactacagtaacctttacatttgtgttcaccggccctgaattggttttcaccctagctttgcacattcttttatcacagcttaagacagcagatggctctcttgcgttttctttcacttacctccatccgtaaacaactaaacagcgttttggggaggtaaaatgaaaacgcagggattaacctaaaagaccttgattatcccaatgctgcccccctctccaagatcccttaaaataggaagctacgttgaagagaaatgaccgcttgaggctcctgaaattcacagccagaatagatgcccggagactccggagtccgctgttcaggcgctgcgccaggggtcgggacgctcgagaaagaaagagtatctctcggttatggaaaagctgaaaggctttgtgttccaaggtgttattaacgtcggtagaagctgtgaagatcaatttccttcccatcatgagggaaaaaagtgagaaactgcttttaggggaggaaagtgtcagagaccctcacagccagcgcttttctccatcagcgaacttgcttctgctgggagaggtagggctggggcgggatccctgtccgcggtgctgaatgtcaggctggtccgaggctgctgaacaacgaagggagggctctgagagggccaaaaactgacctcctgacccccaagtccaaggatttgggggaaagactgcagcataagaaaatgcctgcaaaaatagaggcacggctataagaacaagaagcttaatgtcactcttttcaaattaatattgttggcacatacatcaaaaggcttaaagaacctttaaaaataaactaggtgtgttggggaagtcatactagatttaagaggtcactatacttaacattttacttttttgaaacactcactgcaagaagcctttgataataaacctggatgctttaatcttacagtcatttgcaaattcaaatctagaacttctgaaatgtacaaatggcgtttcttcaataatagaaaccaagagtagtgactcttaatgttcagtaggactcatttcagtgaattaaaacaacagacacactcaatagccatttagttattttcatctctctatagacatctttccctttttaagcaggactacagcaacacaacataaatgcacactcacaaaaaaatggaagaaaagagacatatgaaactgaaaatagagagggaaaggcagagcaaaataattagcattcccctttttctcacttttgctattttatgagtgactagggattgcaagtttctagcaaaacaactctagcatattccttttaataattgtagaatttgtagatgtaacatagcaaagtgtagaaaataaacttccagaagtacactttgtaatatatgacaaacaccgtcgtaaagccaatgatccctgccttagatctaaatctacacactctcatcaggttgcatttccttcccaaaaggagacttgttggtaaatgtggagtgaaggtaacaaacaacagcccagcagtggctgcttccatggagaagctgtggataagttgcttagagcagaaggtgcccagcctccctgtaatctgctgcacttccccccagttgcctggtggcgagtactctactgcctattcctgagacaaagagaaagtgtgttttggttgagaactgctcccagggctgcctgcgtagtgtgcttgccctctttccagctctaaagcagtcactggagaagaaggttgttgcaagtctcttgattaccaagtgagccatctctcccccttgcttcacactgaatttccagaagtctagttcgagcatttctttctctttagctgcctgagctgataggcaaagcagtgtaaagggaagaggagaaaagtaagaagcccggagccagagctgcacttggttctgccactctggtgtatcctagaaaccacggaactgtgttcatccaagcatgaagtgtttctctcccaacctccccccggctttttgtttttttcgggtgccctccactgccgccctttctcttggaccttcacattttcaggtatccaggagggaaccgctgtcgggacacagacagaaaatcaagggggaggagacgccggctgttgtatttgaatttcagacacagttcagatggctttgctccctgacagagcttctttgcccagggacaccagaagatgacagctcaaattggagtgtcctgtctggctgcttttcactgtccctggaatagtgtgacaccctcctctgccccttatatttctgccctgacttcttcaacattctcctgggcgtttatcctacccagctgctgttctgtagcagctactgcggctgtcatctcctcctcccagggctggggagcatatttgggagtggggtctttctatctcgcttaatcacaccttctctctttccattccctcctttttgctccgtgtagcctttcaaaatgacaaacctacccttcctgcagcagaagggagggtcctgcaagtttgggtggactaggtgaggagtggaggctcctccctccaacccggggttgggggtggcgacgggggggcgttggtgctggagggattagcagggagggcggaaaccacctcgccctccaaccgctgctgagagtttcagtgcaccggtaaccacgttaagaccgagaagccccaaccaagccgcggaaggctcgggaaccagcgagttgcatctaagaaaaagcgccccgatgttccttcaattccacctgctttggctcggcctcttagcaccccatccctgcaatccatcttagctttctttcttattatttttaaatcattattacctatacgttttgtttctttctgaagaggtacatcaggagggggaccacataggtggagggggtgtagtggggtgggaacggagcgtttgattagagatctcaggggagaagattggtctctccagatgctgatttccaaagcacttgacaatcaccggcagaagccgagagcgggcggcgccggcggcggcaccggcccgcgggcagctggagcccggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacgtccggcttcccgggatcgtccggctgcgccctgggcgcatctgcgcgcctggccccgcgccccgcggagagggcgatgggtcccggtcaggactgagcsccccttcccctctccccagtcccgcctggcacccyctcctctgccccgagggcragccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcgcagtctgatctgagctggtgggggtttccatggggtgggcctggcctcacttggtctctggggtctcctagaaacctcccgggttcccagaccttggacaaatgtggatatcctggcggtgcccccagcgggagctgctgtagaaggagtggagggtgtgtgaactatggcccagtccgctgaggttcagcagaaggctgcttagcgcgcagccctgggctctgcagcccttcagtcaaatcctgggatggggacagaggctcagggagtctaaagaaagaatccgaattgcggggagcggggggcagaagtaaaaatccctaatatgtgtcagttttaattgaaaaactggcgaattgcctgagatacaagccgttactatataaaggtgactagaatagttaccttactacaggtatttctttgagaaactagtacctaggatgaccttctttcactgcctttgaaatgccagggtctgagaaggcatcctattcaggagccaggcgcttttgtctctctctctgcctgtctctgcatccagttgctaaggctggttgttttgcgagcatgtggtgtgttctgtgggggaaatgggcattgctggcttttcataaccragtggggttggtaggaaacattgaagaatctatttacgttaatgggagtatatgtttgcccagcacattacattgtcggctcccagctgtatttgttttaaatgccctgttgttccaaagacgggggatagaagcataagctatacatgtgtttctcaaagagtgagtgcgtgtccttacatttgcaaattgatgaccaaaagttttgatgctttttttttaaaggctaatgctgaatattttaaaaggacaatttcttgttgtcacatttaagaaattggagattacttgctcttactatcaagcttcaaaggcaaagataggaagaaaatcagagtggaagttctgttagagaaataaaattatataagtaaaataagaacttcttgttggagaatttgggatcaatcatattttcagaccagtgtaggagccattaagaaaaaaatggattttaattttccacattagcctagagccttattcagcccacctttgtgtaatgagaccaactcgactgccttaatcaccgttgatagacggaggatcaatctattatgacttaaattgtgcttatcctcttatgtcatcaaacagactatcttttagaatacagttttcaccacatacagctccaaattggctgtctacataaagtaaattaacatactatctactaaataagcttattttaatayaaacaatgattaaaacttgtgtgtatttcttaagaatatagccagtagattattttataaatatgaacaataaatgttttgtgccatattgggtggcgaaggaggatttgctttacacttaatgaattttaagttgggtgtttacttttttgtcagtatagaaagctgtctgagttttctaatggtccgtttctccattttcaaccctgactgctctgttggtattcctgattttgaaatgataagcaatcttcaatgttctgtaagaaaaatatatttgaggtcacttttctaccttactttggacaggaaaatagaagggaagatacgttataaggaaattgtatgagaattttttattcttcttatatttcttatataaaagtatatatattcttcagaggagaaaaatacagatatatctcttgagtatcagaaaaggattaatttattagtatcactaattttaagcaaaacaaatattaagactttatgttatgtaaattatatatcgacatataatagtatgcttttatattattatatataacaatataattattcatttaattaagtcttattgtcgaacatattttcaagcatatttaccttcttattacacactctttacatagggaattgccctcagaaaattttaaaaaatcatatttattaaagatacaacctttaagtctgatggttttatatgtctttatagctgaaaataatataacaattattgaatctttacaatctgttaggctctgtagcaggtattatatatacatacagcagtgaatagaagagttgaagttcctgccatcatggagctcacaaacatggggtagagagtcattgcctatggaaaggaacaaattaataagaaataataaaattcaaagtcctataaagcatgaagagagctgggataaagaattatggaggagagaggggtggggagagggatctaattagataaagtagtcagggtgggcaacactgggatccacaggttgagagatgacaggtaagaaggatgcagagattttaagagcaggtagaaaaagcaatgtgtgtgcagagaccttgaggtggaaaaaatattgtcccattgggagaaaaaaaagaggcatagaaattttaagcacattgtcaagtagaatatagtgtgatatgcttgaaaacagaataaagaatagctccacattttgtgttttggggaagggtaatacacatttttgaaatgtagggttttaaaaaaatcctttattaagtagtaatttatttaatgtaaagattattgagttggagccctacacccacactctttcctatctccatcacccctacccctatagaagagtgatgtttataccagttgacttactcttrtgaaggacagaaatttgcaagatggctattaatggtgtggtaggcagcatgactgcaacccacctttccagattcagctccatctaccctccaccgacctccacagatttcaaacacaatacaatgccacacaccccgcaaattagtcatatgctttcaaatccttatccttttgtttgtgctttactgtgtgtctagcatcttctcctcacttctacattcacctgttgaaattatgaaattattctcattttgaaaagctgagagaaaatgccatctcctctgagaagccttcatttattggatacaattaaaaataattctcctgtggtatttcatacgtcactgttgttgtttatatatacctgataataattaattaagtatacatattcagctgattgtagggaagaagcaaagtctgtgttttctgcatcttcataggctctcaaatcttgagagtgtttgccatacactgggttctcctcattgcccttggattggagtgaaataaggaaggttaataggcccaagctaaaaaagaaagtatccttgaaccagagtgatctaactagataattttagacataaaaatacttttcaaattttataccttttttactttccctaaataaatataattatatctttttttaagagaattagagggattacatatttgtgggttatttataagaatgcaagaacataaacaacctcattttaaagcttaactaatatatgaacaaagatatttacatatattgatttagccaaagaaaggggaatttacaaggaaatcaacagtttgcaaatagttttattatttggaatcttaacaaaaatgaaaactaaagtagccactgactacaatggtgtataatgaacattgtatccccaaaagtgttatgtttttattatgaatttttcaatcaaacaagaaccataattgttcacaggataataacctttctaaatctttggcatggctgctaatgcagttgtttcttgagatttacttttttggggctgtgatcatgagagctatggtattatgtgccatgtatgcttaatcagcaggtgcctgggcttcttactaacattttaactaaaataaattacagtatgtataaggaatggaaagtgaggtacttaaaatgtgttttcaagttaatgcataatataaaaagcagaaatgcatgtacacctatagaaataaactgctttgctccagtgtgatagtgaaatccatcagttattctaagaaaagtgtccttccttcttacaaggtgctatgtaaggaaacaagtgtctaccgtctcagaaaataatccacagcaaatagtcatcaaaaaaaaaaaaaaacactgtttttgtgcgctactgttttagtgtcattaccatgtgctcatacaaagaccacatgcttgtttgttttggctgttttggctaaactaaaacaagggaacatttttcttcaaagcactttttattttttggaagatattttctctttggtgttggttttctaaggccatacccattggagtcttactacatattaatacctgttgctaactttttgataattataattttattatttgttagttgtattaaggttagatcaaattatggtcttctaaattaaaatgttgagttttgttttgttttgtttttaacaagggacatactataaatgcaatttctaagcagggaatcttatgagaatattaccagattggtcaatgaaataatgttagagacaaaaaaggcattcattgtttatgcattttcctcctgtggcttaattgttatgatttcacagtccatatttgctataggtttctgaaaatgtttaatacctcagtagttcaataagtaaagtgtaaaatagtgtaacagattaggtataatgtaattaaacataaagaagatggtttgctttgggtttagttatatccatagattgagttgagtttacatatattaataatctatggccaactgtctggtgaagaaatcctgtgacctttcctaacaagatttcagatacacaaaaccttctgtcccaaagttaccgtaatcaattacgggcttcacttcacattttgaatttgaatacttttacatttagccccaaacttgtgatttttgttagtaattccattctctatgatgttactgtgagaacaagtattttcaaacccaacaagaacctcccttctctttggtgtaaagttacgtcttctaaattttatttatttaaatttttttaaatggtagaaatttaaaaggaaaggtttctaaatatgatttatccacttagttatggaattctatatttttcttagatataatttatattaatgtctccccaaatgttgagaaactttagccaaagaggactatgatatttagataatacaaatgttatataatatttcaaatattgttttagcacccaacaactaaaacacacacacacacacacacacacacacacacacacacacacacacacacacacgaatccaaatctctaagagaccatttcagagacgtcaatgcaatttaaagccagttacagtgtttgcattagaaaacaactaatttcatagttttggtctataatggtccagcattcaatttaagaaactcagatcacatgaaaatgtcaccatttgctgtttactggggtgacagtataccagtaggcatgcgtagaaatgcagacacagtgtctacaccattttatgataggtactactttgtcattcagaaaaatgtctcctttcataaaattaaattttgtaatttattttgtggaatgtatgtttctccctatgattttatggtttttgatattgggattgataggaacccatacggcatcaccatagggaagggccacttcaaagtcattgtctcaccagtgcctggcatacagctaacacttcagaagtatttgttgagtgaatgaaacataccacatttgtcaggacatatatgcagcagaagcatagaatacaattgagataaatgaacgcatagcaatggctataattggataattattattattattattttggtctgatttactttttattttatttatttttttatactttatgttttagggtacatgtgcacaaagcgcaggtttgttacatatgtatacatgtgccgtgttggtgtgctgcacccagtaactcgtcatttaacattaggtatatctcctaatgctatccctcccccctacccccaccccacaacaggccctcgtgtgtgatgttccccttcctgtgtccatgtgttctccttgttcaattcccacctatgagtgagaacgtgcggtgtttggtttttttgtcctggtgatagtttgctgagaatgatggtttccagcttcatccatgtccctacaaaggacattaactcatcattttttatggctgcattgtattccatggtgtatatgtgccacattttcttaacccagtctatcattgttggacatttgggttggttccaagtctttgctattgtgaatagtgccgcaagaaacatatgtgtgcgtgtgtctttacagaagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctatcacctgttgtttcctgactttttaatgatcgcctttctaactggtgtgagatggtatctcattgtggttttgatttgcatttctctgatggccagtgatgatgagcattttttcacgtgtcttttggctgcataaatgtcttcttttgagaagtgtctgttcatatccttcacccactttatgatggggttgtttgtttttttcttgcaaatttgtctgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgttttagacatgaagtcctcgcacatgcctatgtcctgaatggtattgcctaggtttacttctagggtttttatggttttaggtctaaagtttaagtctttaatccatcttgaattaatttttgtgtaaggtgtaaggaagggatccagtttcagctttctacttatggctagccagttttcccagcaccctttattaaacagggaatcctttccccatttcttgtttttgtcaggtttgtcaaagatcagatagttgtggatatgtggcattatttctgagggctctgttctgttccattcatctatatctctgttttggtaccagtaccatgctgttttggttactgtagccttgtagtatagtttgaagtcaggtagcatgatgcctccagctttgttcttttgttttaggattgacttagcaatgcgggctcttttttggttccacatgaactttaaagtagttttttccaattctgtgaagaaagtcattggtagcttgatggggatggcattgaatctataaatgaccttgggcagtatggccattttcatgatattgattcttcctacccatgagcatggaatgttcttccatttgtttgtatcctcttttatttcattgagcagtggtttgtagttctctttgaagaggtccaataattggataattattaatgtatttaacaactacctgcatgacactctgtgtctattgagtactatttaatcttcacaacaaacccatgtggtaggtacactacattatccattcattaatacactaaattatccagtaatcgataatacactaatattatccattcattcattttacagatgaggaatcggaaacaaaaataaaaagcttgcatagctttgaagagtggggctgggattaggagaagatctgctaactgtttagcccatctgcctgcctactatttgcctgcacttacaaggctgaatttggctgaagaaaaatacgcagacacattggtcctactttaaattcacagtcaataacctcagggggccccttggtacatttcttttttaaaatccattttcacttaactggatcatatttcttaccttacttcccttcaaacctcttatgtctcctctcccatttctactctcagctatatccttacttctatttgtctgagaaagtagaaataataagaaataaatgttcacatactccacaactgcttttataagtctatctgcagatctatccatttactcctctttttatttttttactgaacttggggataaactcctagtgctgtaatctaagttcaagacctcatcaaatttagcattagaccatctctcctactcagggaaatcaatccaataattttcttctcttctgcatcatcctactgtgttatcccacatcctcctgtattatccttaacagtatttaaatatgctctaatatttagaacatcttaaataattaccccatgttaaaaaagaatcccctcttggttatgcatttctctctagctattgaattaattgtctgttactggcaaaactctttgaaagagaaattgcaactatccttctcccattctctcttggaccctttctaaacaggtgtttgtccccagtaacaaactgttcttgtcacggtcacccatgacctgcaagtgatcaaactcaagattctgttttcagtycttatcctacccgtatagtatttggcattcaaattttcataataaatttgtattttttactacaaagtggtaaagttagcatcgaaatactttaaacctaccatttacccaaccagtaccctttatgcgatcatctttttatagtgacgatatatttgggtttctaattgagagtattaatacgttaactattccatgtgatttgatgttcagccaaacactaatagtactcagttggtattcgggtaccattagaaggcaatgcttggtgtttccttacttgggaagaatattcctttcatcacatgtatttgtgtttggacagagtggcttgtctctataaaacagaagaagatgaatggtctttctgagaattagtctttgtatttaaatataatagatttgtgattaagcaacggctgcttttcagactccttaattactatcatagcaaataatcattggcaaactaaaatattagtttgcttaatgataaatatcactcaagtttaagcattatgtagaaagaaatagtcataaactttggaagggccgtttatcatagttcattttctctatgtggaacgttttcatggatagatttgttccttatttttacacctaagggtttcaagtattgataatatgttctacctcttctttacctacctattacacagacatgattaaggtaatgtttctacatttgtgtttttagtttttctatgttaattttttgtcaaaatgacaaacagcttttaaggtataagcaaatggcaaagagctggcaattagagtagatgaacaaatttatagacatgataatattatctcttccattgagattttccggggtaacatgtaactacttggctcaacaacgagacatgaatgcagtgtcttttctcaggaaactctycaatgatggatgggtatttacttgtttgttttcttcagaatccaacaattctctttcttttgaaaaagcctttaaaatagtgcgattctcattgcttaatgtctttttattacaccacatgcctcattttatctctttgaatttctgtaaataattcctgcttatccttggatacaacatgccctttaaatatttgttcatggcttttttattcctcttaccatttggccaacttacaattgtttaaccctattaatctttctgcataagtaaatgccaccagcaccttaatcatttctgtggcttagattgttcaataattacctcatccttattccagcaaatgagatgactgctgttttcatgaagagaatttcatgctgaggccaaacttggggtagagaagactgaatgcatttgctgtcttgcttctctctggggtgggatctgatctgaatacagggataaggatattgtacaaatctatgctaggtagaagcagtcttcttggtttcatacctgatgaattaaaggaaagtgtagggaaagtaaccagacatcttcactgcatctgctcagatgagaagtgttgcataccacatctcatacttctcccaacaacagggtgttgttggtattattttcatttcatggatgagaggaagtgaaggaatttttccaggaactcatagtggtcaggggtagtatttgaacacaagtctgacaaatatggggtacagttttagaattaactcaatgaatccttaatcataataaaagtcagcattatactctagtgtcttcctggatgtacccatagaacaggctagaatgtcaaccacaagattccctctgttcattcctataatttattattattattatactttaagttccggggtacatgtgcagaatgtgcagttttgttacataggtatacatgtgccatggtggtttgctgcactcatcaacctgtcatctacattaggtattcctcctaatgctatccctcccctagctccccacctcccaacaggccccagcgtgtgatgtccccctccccatgtccatgtgttctcattgtccaactcccacttatgagtgagaacacgcgatgtttggttttctattcttgtgttagtttgctgagaatgatggtttccagcttcatccatgtccctgcaaaggacatgaactcatccttttttatgtctgcatagtatcccatggcgtatatgtgccacattttctttatccaatctatcattgatggacatttgggtaggttccaagtctttgctgttgtgaatagtgctgcaataaacatacatgtgcgtgtgtctttatagtagaataatttataatcctctgagagaacatgatgcagaaactgctgggacagtaatgttacaaatgatggccaccctgcagaaaagagccttctccagatctgcctccactcctttctgttcaatgcatgggacaatagttttaaaagttatacaggacagcagagttcagacacgtctgttccatcatctcttagactttccttttggagtaagccactaaagagggtgaagcaagattgaagttttcctacaagatttcaagtatttcatgtttgaccaacttttgttttctgcatcccaatgcctttgcattttggaaaattgtaaaagttgcaaaagttgctaaagtttcaagaatatggcactcatgagcaaaggtttcctgttcccatgctactgctgctgaactgacacattttttatcattagaaatgcccttagtgtccaaacactcccataaatgttatcatttttactttctgcatggttgtatagtcaagtgaaactgagatgcatattacactgttaagtactttttgcaactttctatactaacaaatcaggctaacctaaaggtaaaggtacaatgtttgtgtctttgtgagttttgcttttgccctatggtagtagttataatgaattctccagcagaatctccccaggaacattcgtttacaagctaagtctttctatttgttcactttttaaaaaaggaaacagcactttgcaatatccattttttagcaataactggtgtcatcataattgactagcctcacactgctattccttctcttttttaaattttctgcaacattctcattggcatctccagagataggcctgttgattttttttttcttaaaacctgaatataagaaaataccccaaatttcacctgcattttgtctcacacatttccatcagtattatttaccactatccttactagagcccaaaggtccacaaaaaactgccactcttcatggtgtggtcggtgctggtaaagccctggaggtagacacactgggccttgtgctcccacaaactggctggaaaacttgggcaggtctgttaacacrcagagacctctatgcaatgaacccattgaacaagacaatttgatagatgcctctcagctttcagttcttcttttgcacgctgtgtagagtccctcatgaattagatcttagaacattgagacagtagtgtattcctttgccagagsaattatatgttacattagaaggccacctacattgtggttttaatttgtaggatggatacttaaggtatccatgacttcaacactatgcaatctatgcctgtaacaaaattgcacctgtactccgtacactcatacaaacaagcaaacaaacacaaaaggccctctggagaacaggactgtcctctagatgctgacagtctatgttcagtgcctgtctccctgtctctgccttaccccctttctttagggttggcttagactccatgcttcctgttagctgctcattaaatgcagcctgaaaatagttggttaatcatctttgtatattctatagattctgtatatttgtggcacacagccctccctccttccctatagtcaccctgctctatatttaggcatataaaagctacaattctcctgtattcacagatttgaatatagagacaggaaaaaaaaagcctacccaagtctccactaaaagtctgtttaatgcctcccagtatttatagaactcgattcttccagacacttttatttgttttatcttaacaagtctcattattttcttctagggttcgaatctgtacagaattatttttaaaaattacagcttgtgtacataacagcagtcacactaggtgcaaagttaaaacccatttaaagagaataaagcttcaatgaggaaatatggaaataatgacaagcctaggaaaagaggtctaactaacatgaatgacaccacacacacacacacacacacaccacaattagagtctccacaactctgatctgtaacttaaatgaatgtcaaattgcctcacaggaatttcagatcttcagtctgaagttctggtagataatattgaacatattcctcarcaacagcatgcatgcttctaaatagccactagaattcattggaaaagagcaatatacaaacaaacaaaaaaccccagaaaactggcaagctgatctagatggcaacattggatgaactagaaaactgagaccactggatactaaccagtttgagataacagtatcagctggctttctttggaagagagagagaagcactaaataagtgaggttctcaattttaataagttgcattattcaaacatagaactaaagctattagatttttattaaaagtgcctcctttgaaagaaggctagactaatgtgtttctgattagcagtcagccagtgaaatttcagattctcaaaaccatgacaggattttgagcaggaaagacatcccttgataaaactctcagtaaatagtaattttgcaagtgaagaaaataattataagtcaagagaattgctttatggcttcaggaagttagttattctgcacttactggcgcttgcatttaaggtgatttcatttagattgtattacacacagatggtttgattaaacatatgagttaatagtggcttggtatcaatattggctgcatcactattggctgcaagcatcttgtttcatgaggaaaaatggggtgggctgtaaactgcatatattggcatggtatttaaagttccaattaagaaactatataacacacacaaatattgggtatttgtctcttgggtttgttgttaagaaacgtatgagcctctttcatttaaatacctctggacactgtaaagaaccttagatagacacaagaaaagccaagaagcttaaaaaaagaaagagaaagagcataaggacagaaaataataatataataaaaaaaagggagcgataaacctctaaaatgtaggtgccagaattcttgggatgggggaccttgcctactcttgtatatattctcatctcagagtggctctaagtatatggtcctctttaagcactttttgttttgaataatctaagaatgttgctaaattgataaaactgagatattcctatggtttcaagtaaaaataaagcaaccaatatcttagctcatcaarcttcatcattatctgcattgaacttcacaaaaactttgatgtggtgatggtatcacaagtatatgaatatgtccaaactcatcaaaatgaattgcatttttgtatgttaattatgtctcagtaaagcttaaaaaaccctttaaagtagataatattctctttatttttcaaacgaaagaatggaaactgacagatgttaagtaatttttcctgggtcatataatctatggtagtagtagtacttttctatttcttctgcacaaactcctcgcgtatctgtttgtttgattagttgggttttttgggttgtttatttgtttgttttttgagacagagtcttgctctgtcccccaggctggagtgcagtggtgcgatctcggctcactgcaacctccacttctggggttcaagtaattctcccacctcagcctcctgtgcagctggggttacaggtgcacaccataacctctagctgatttttgtatttttagtacagacagagtttcaccatgttgtccaggctggtcttgaactcctgacctcaggtgacccacccgccccggcctcccaaagtactgggattgcaggcatgagccaccgcatcccatctgaattccccattttgatatgactccctcttcacttggggtctctttgataacaaataagaaaaatggacagagggctagttgcaagaaatcagatttggaagtcactacttgggaagtgggagggagacatcaagaattatggctttagttcatcttctcccatccctttctcgcaaatgttgctatttcaataataggaattccaccatattttttttttcagaaagactttctttatattttcttgtttcataaaatttgaaacaccataaaatccaggagacaacctaacagaataaatgttcttcccaacctgtgggaaaaattataatcctctttctgtccattcctagcttttatttctcctctaaaaggcatttcttttattttgatgagaaaatcctttcagtatttctcaagcaagactaaagttgaagatacacaaaattcctagagtagagcacttgggcagatttattaaataacctatatattgaagatgatatggaggtcatttaattctatttcataaatatagcagtttttacattcaaaatgctctttcactttcaaaataaatattattgagatataacatgcacattaaaagaagtccacaaatcatacacaacttaattaatttttacagagtgaataaatacacttgtgtgaagaccatgcggatcaagaatagagcactacccggcccccaagaaacgctcctcatgtgcttttccaatcaatgaaaactaaaagcagccactctcttgacttctaacacaatatattagtcttgcctacttgaaaaaactatatatcaatgatgttatgcagcatgtactttattgtgtctggcttcttttacctaatattgtatttgcaggttcattcatgttatctctgctagtagttcataaaatctgtagtgaagtccccctttttttgagattgacgacttgtaccttttctcttttatctcatgcagtttcgtttgggtgtattaaattttatttagtctttttcaaagaagtgacttttggcttagctgatttttcctattgtaatttttttgtattaaaatttcttcttaattttattatttgtttttaattcctttaggttaaatttgcgttcttttaactttgtgcaagtataaattgtaagcttgttgattttaagccattgaagaatttaaacattcatggaaaatggtaaatttacctgtagtcatggctttagctacactaaaaagtagctctctgttatattttaattttcacttagtaaaatattttcttattctgtgatttctttcacttaggattatttagaagtgcttgtttaatttcaaaatatttaacaattgtctggttatctttttataacaaaaaattactaaatttctagactaaatctaccataatcagagaacaaataaaatagcaaattgaaaacaaaatgtatgttttattttgtagccaggtgcaatattctctgtatgacaattacattaagtctactgattttgtagttcaaatttttattttttaatttactttcttttctccatttttatcagttactgaagcaaactgcattaaatatctcccattatgattgtgaatttttctatatttcctccagacctgtcagtttttgccttcattctttataggctaatataacattattatatcttactggtagatatatccttatatcagaatatattgcttttcactttcatgtttactttttatttgctatagtataataacaccagctttctttggtctttatcataatgtcccacatgtttttactcccttttttagattttatacattttttatgttctttgctttagggtggctattttcaattaaaacattttaaaattattyattcttctcttgctattgaactcatccattgaatttacctttccagtattatatttttttccagttttaaaacttccatttgattaattcagttctttggttatatctccatcatttacttgattttcttaaatatattaattatagttattttaaaatctgtgtctgttaactcctatatgtatttatttttttaattgttccctttggtatctttggcaatttcagtagttttaattgagtgttggacattttagaaagaaaactatagaagctatgattttatcgtctttgaggaggattttttttctttttattacagttggggcagaagattccagtttactgtagtatgaaatatatttgaaattggctttcacatytatgtgtgtgctagcttgtctatttctagtttgatttttggctaacgtatagtttataggggctccaactgaaaacctggatgtttaccaaggctactctttattggcaagccttgaactctaatttttgtctccttagcattgtggattgccaaaagctttgctctgattctcagctttttgccttcctccacttttgaagcagcaaattcttgagagaaagagtaatgtacaacacagtgctcatctccatatgttttcctttcttccaaaatgttggccccttaactcctggttgccttggaagctctccagtgccatcaaccaattttctttcttttctcttcttgtttttaaaaatatctagctttcacatatggtaggagtgttggtcttatgcttgatagttggttataactagaagtgaaaattttaagtcataattcttagagaaactggctattaggaaatattatttccattttgggtccctacttcttaaatatagaaagactatcaaatatcttgacaaaaatagagaggatgtttttcttatataaagctcatgaccaagtcttcagcaccaaatttgtatgtaaattctttgaattttttggaagaaaaatattgactagctttttatttgatttgatctttcagaacattacccactgagtaaatccatattccactctaagttttaataaaatctgtgacagagatgggtatttctgtcaatactcatttctggggatatgtgtgtgtgtgtgtgtgtgtgtgtgtgtgtgtgtgtgttgtatgtttcatgcctttatacaggttgagtatctcttgtgtgaaatgcttaggaccaaaagtgtttcagatttcagatttttaaaatatttttgaatatttgcactattcttactgtttgaagatccctcatctaaaaatagaaaactcaaggtgccatggctcatgcctgtaatcccaatattttgggaggctgaggcaggtggatcacttgaggtcaggagttcaataccagcctggccaacatgatgaaaacttgtctctactaaaaatacaaacattatctggacgtggtggcacacacctgtggtcccagctactaaggaggctgagatgggaggatcacttgaacccgggaggcagagtttgcagtaagccgagactgcaccactgcactccagcctgggcaacagagtaagactctgtctccaaaaaataaaaaataaaataaattaaaaatcctaaaggcttcaatgaacatttactttgagcataaccattgaacatcatgtcagtgttcaagaagtttcagattttggagcattttttatttcagatttttaaattaggaatgctcaacctatgctactaatactactagtatttttgttgtaaaaattgggttattctttcactttccaagtttatttcctggcagcaacaaagttgtagattatcaaaccaccttccagaatgttaaaaacctatgagcttacctgaaaaagtctctaataaagatttgtgtgggatctaattatgacttagctcttaaagttcacaagagaggttggaaacagcatatctcttactccaggctgctataactctgggcaacaggtgtattcttactcataagcaccctgcaaagactggagtagccctgacaagaaatctgagtattcttctctgaagcctgtggttcaytgtgatgctgctgccagctttggccacaccccaaatagacctctatttgcagagctcttccacattagacctgtgtgcttttgaataagtgactcggctgctctaatcttaatatccttatttctcaactaagtttataattctatctattctgcttaactcacaagtaaaacttgaatgagataatgcatgtgagagcatttgtgagttgtcacactctaggcacatatggtgagcggggcaaacccaggacctaggtaaatctttccacatgtctatggatcagaacccttttcttctcctgtacacataataatatatatcctagcataccatgtttctaatttcatttccaggaataatgatataaatcagtttggaaatgtgaattgggagaaaaagatagaagttatttgttacttacttccatctttcttatccttatttgtctctagtatattttcttatgtcttgcctagaagcagtttcaatgattatcagttcagtcatcttattttatagataaagttaccccaaaacatagataaggcccaaaactgtgaaatcccctattatggtctcatggtgagtcattgtcagagcctgatgagaaataactctcctaattggttttattgattactgttgatgcagcattgcatcattgtagataaagcacacacacagatatacatgtctgcctgcgtgcrtgtaggtacacatatgccctccaaaaaattgcttatctgaggctgtaggaaaggatctattatatttttcaactcttccttcatccctaagtgacaggaaagaagggatttcctttccactcagattccccgctgttaaaagcattaatgttttctttttggagccttttgctgcctctcattatgtttttctccattgcggagttggagtcacactatgagaaaatctgaatattagaacacaaagtctgcggatatgacccataggcttgctgaggagtgatctaatagccagggagtgatggtaggtgagaggtgaaatgtacagagtggggggcatagaagagggagctatggagttcaggcaaaygcaatgcaaaagccacagcaccttagtgtgagtgccatcatctgaaactgtccttggtggtatgggaagcgttgatttggggcaagaaaaaggcaagatatttatttgatactgacttgatgatatgaacacaaaatgagaaaaatattcaggcactgctattgccccaccttaatagtaaaaagaaagggaagggaggtttctgctagctagcaaactttgcaaatgggtatgaatacccttggagaaccaagcagtacatgggtatgagaacccataggtatatctttgtgcagtatcaattttaattatggttaagtaatttaaaatrcttgatatcaaaccaaacaggtatttagtagattataattgttaggatattcaagtagaatacaagattccaaagaaattcctgattaccagatgctttgagactccatccctcaggctcaccaggaaacgtgaccatttactttcctctaccattgaaagtacttacgtaaaaaaaatacgtgagaatcactggagcatttttgttatagaatatttctaggcactccatataactctcacaaatctctcctttcatttttgtctctaaatagcaaacaacagatgttccctttttaacttcctaatgcaaagtatagaaagttgattcattgcaaattgatgcattcttttcttacgttttacctttttaaagttacttctctcgggcaggtatgtttgcacttcagtgacccttctgatgagagtaatcatctttcacttggtttttaaaggtcttaagattttgagtgattctttacttagtgtgagacaacatgttacattcatgtctagaataagaacaagtatttttattgtgcaaaattaactttgaatgaatgaacagaagtaggaagtaactggaggaatggagatgaaatacataaagtatttctttatgctttgcctggatttatatactgaaattgacatccttactttatacttataaaggactaaaggcatttgtaagaaaattacattatcaaacttcagaaactgttgaaaatccaatgatttctttaaaaatgttacttaatataccttgtaaaatgatctttcccaaacagtcattaggaatttaatgacttaggtaagatctctgaagcatatacccacattaacatgacaagaaaaggatgtacacttaracctttatttaaggaagtccagagatggatattaatattaacagaatttcaaaagttgaattactgaggatatattcagcaaataatttaagagttccagatttaatgatttgaaacatgtctccatattggatgaactaatattctttatgtgattcttaaatgagggcaaaaaatgttttcatctattttattttgttgtctaaggttacagtagaattaatattttttttctttttccatgctatgcttctcgatgcaaatgcaaattgtgctggaaaggcaaagttgaaggtgactaataaagagcaacaatatctttgtcagtttcaattactgacaccattgctactaagtagatttctcctcaccttccctcctttttttctttaatcttacagtaaaggaaaatcttattatatgtcccaaaccatgataggaagctagagaagctcagtttcacatctaatgctcactctacattagttaccaatgaaatctgtcagtgggtatatgttaagcaatataacatgctataaagagcctcttggcagaaatagtaggttaaaatgggagcggaaatttctttgtcaacttcgcagctgtagcgctgggtgtggggcaggactttgtgtttctgagactgcttctttgtacttaggacaaggataagtctcagtcagttgccctgactgggggagttcattggactaatagataattcctgagatgctatctactgctaatattttatgtctatggcctatacaggtggtgtttcttcaattagaagcaccagcaagctaaataaagtatcatgacaataatcacacaaaggtgaatttaaagctttaccttttctctcacctaaccattttcatttttctatcttctcttccatatttgtatatttgtaagttattttaatcataatgtagatacaatccaatcttagcaggagttgttaaatctcaaatgagttaaggtatatgaaatcacctttaaaactctaaagggctattccaaatgcaaaagaagcctgatattattgtcactctttcttaaatatctttccatatctctgcaagataaaaagtgtgaaaaaaaaaaaagccaggaaaggttgggttgagctgttgtgtttagtgaaagcactttcactaacacagaggacctgccttatgatgcctctgggagtcaaagaaaacacagaccctccccatgagatgctaagaatcttgtcaggtgtattggtttctcactgctgtaacaataagtcattacaaacttaatggcttgaaagaacataaactgattatcttatagttctgtgggctaaaattctgacgtggatctcgccaggctaaaattgacttgtcagtagggctctgatcctttttggaagctgtagaaaagaatccatttctttgccttcttccatttctagaggccatctacattccttatcacgtggcactttccttgaacttcaaggtcaacaatgttgcatttttctgataattacttaatagtcacctctgccttccactctccttttaaggaccctgttattacactggacacacccaaataatccaggataatctcaccatgccacagtccctaacttaatcttgtatgcaaaggcccttttgccatgtcatgtaacacagtcacacacttcaggtataagaatgtaggtgctttcagggagccattgttctctccaccacagcaaagcaatcacatggacacataatcacaatacatcatggttaatgccatagcagcacttggctgcagaatattgtgatggtacaacccaggctgacttcatgcagctcaaggtgcaggagcaggaaaaacctgccagaggcaatcatggacagagaggtgatgacagggtgaataggaactagccatttgaaaagatgcagagactggctttcaatagcaggcagcccaygcagagaacaagcctctattaaaatcctaccatcctgcctcccacattactctcacaattaagtccttgtcactgtccagcctctgagaaaggatctggcatctactgcaggrtcatgggtatggcatcttaactgcatgcatcatacccaacatccagtgaccagagtgatagttcacctgtctacgtatgatcttgccactgcctgctttaatctactgacctcaaatattcttaggatgcaattcattttttgtataattaacagacctcccaagatttgracacttggccatcttttccatcctcattccgtggtgatgctactttcttatctaaaataacatttgagattcatacagcatcctgtgctgttatttggccagatatggttatgtccacctttcagagaaattcaagaggctatgacttacattaaaccacatagctaattggcaactgaaccccactgttttcccagcacactatggggagaccagcctactgtcaaatgttagattttgttcctggagattttaggatgaatatgggacaaactacctccttgttytctgcaaattcattttccctttagccatataacactgggtttggggtattttggggacgtggtagtgagtcataacaagcttaattccttttacttcacatgttcaatggcccatgtaattacaaggcccagggatttcctctctgctgttaaaagaattatcaagttaagaatgttttgatcttaattagcttttactaggcctttctgatgcccaaataatatatgtggctaaatggtaaacaataaggatgaggcctatttttttgyttgtttctaaaacacttttcaaagaatgtacagtgggaacctacatggaaatcttcataacaaaaattttttaggtaatataaggcacttttccttaggggaaaattaagagtttagataagggacacatttttaaataatcaaaaaaaattgaaaagatgcttcttttgcatctttggattgtgttgtgttcaattccctattattttattttccttgctatgcaaactctagacatcttgaaaattagctattggtaatcttatcagttctcctgtaagtctgccaagtaattggatagcttttcttgttttttgctatgtcacatcttcgtacctctaacatgcacactctcattctctgtatttatttatagagctctcacctctcaacttctttctctatttctgatattctccatctgaagcatgtatcagaagttctctctgtgattggtggaataaattaaaactgtgtgattatttactactacattcagcagcttggatcaaaaacctagatttacaactttctaactgtgtgaacattgttaaatttctgattgggttaagtttctaattttatatgtatatttatatatgtgtgtgtatacatatgtatatttgtatatgtatgtatgtatatatatagaaatacatatatagatttgtgtatttacataaataaaattagtgcattaataatagatttgcatggttttcaaaggatgatgtcaattaatgtttataaaattcttagtagtgtgtttgacacagtgaataatggctaaatgatggctgtcattcttattactgttgttattacaaccagcatggtgactgcatatgggaagatacagagcagactatgaggaccagaaagagaaggatgcattcttgtattactactaggcattaggttgctttttgcaaggtggtggctataaagtattctgggatggcactatctgaacgctgagagcaaagggcccatctccagagggcacatctggaattgggttatattcctcacaactggagacagggaaggccaatgtgatgtgagggcccaggcatttggagcaaggtaactagactacaggggctattatagaagaagaggtacaaagcaaagggtagtgggtctcctcacacaaaatactcacctctctgtattatggttgccagtttcacaaaagatgtgaattatgaattcaaacttaatttcctgtaaaaggtacagtgaaaataaatagcaaaagaagaaaaagttttaacctcggcttagcctgtactaagggccagataacagttctgaaaccaccatccactggatcttggtgatcctaccttgatggggtagacattattccccttgtcttcttatcaataagaaaaaaaaaaggctcttgaaaggtaaggcaccttatccaactcagggagctggtgagagggtaactggctccacctttgcccctacttcaagttctttcctcctccacccccaatcccgtcttatccggagtcagtgctgcagatgtctgagcaaggcaggcagaagtacacgtggctctgggcctggacatcttgctgtgtgtggcatcaccaaggtaatgcgcagctacaggaccccttgacctgtctgcttccatgaacgtacagaagcgtaaattctgctccttgactgggaaacattttgttcccacatggaggttgtgtgagagtagagcattgtggatacaccccatattgttgtaacctattttctgctgttcttgccgagatctgaggatttttatttaaagttctgcctttctgggatgaccttaggagctatagatttcattttcctggagggacttagaggaacagaggtccccaaatggttctccctggcacactgcagagcaaagcagacagaaaggtttttacaagtcctgggcagtcagcgttagtccgttttccaagaacaatgtgttttttttttcaggtaagacaggaaatgcttttcacttattaaacttagaggtgtgctacaggtgtggactgcttaagaaagaaagaaagtcatgagacaaaagcacccaaacctcctcagcaaggctctgaaatatgcagaaaagcagttgttcctatctagtactgaagccctcgcataagttaaaaattatatcagaactgaactattacactttttagtctaaaggagctatgtcttttgttttgttttgttttgtttttgcttttgtattgtttaaaggaactgaattttagaactcagcaaagatggtttggtacaatatcataattagggaacacaaagactggttcttgacaggagagattagaaactatttcataaatggggatatttaagctaagccttgatatagggcagtgttttgacaggtgtagagtcataggaaatcatttgaataaagatgaatatgataaaaatgcatgagcataggctaagtagcactgcaaagcactctcagagcctgaaacatgtagaggttggaatcaactctctctcattaaccagacaatactaagcagatgatgcacgttctcagatgcagattttcttcatgtattgcatggggtaggtttcagatggaaataatgtatgttagaagtttctgggttaaaaagtacatcgtgaagttcccttgctctttcttttatctgacaaaacatcagcttgacgttttgcttgatgagtggtttgcagtctatttcccaatgtggagatggatggatttcttcagacgtgggtttataaatatgtctggttattttttttcatttatttatatttcacatgagtaaaatcagggccataaaatagctctacaattccattaaacttaaaaatctagaaaacatatcatagtacttaaatgttgagacagaaagtgaatatcaaattcctttcttcaaatactttagtgaatgagaaaaggcaaaaactatcctgggagccgggtgctacaactcagatttttctcatagttagctacatagtcctctgaagtgaaggcggttttgtctctaaatcggtgaacgtggcagttgaactttattttttttaaatggcaattcctctattagtctgctggggctaccttaacaaagtatcatagacttggtggcttcaataacagaaatgtgtttctcacagttctgaaagctgcaaggtcaagatcaaggcactggcatgcttgatttctcctgaggcctctctccttggcttgtagatgctgtcttcgccctgggtctacctgtggtcttttacctgtagttgtctgaggtcctaatctcctcttccataaggataccagacctattggactaaggcccaacctaatgacctcattttaacttaattatgtctttaagggctctgtctgcaaatgtagttcattctggttaagacttcaacatatgagttttagggggacacaattcatttaataatactccctttgatgctttcacaccattagacacaagtaagaagaactatatctttgaagaagtgttttgttgtgctctatatcagaaggtaatcttgaagacatgtggtcctttacagttgtctgcctttgagttgatcagggagatgctcatttatttaactgcatgaacacatttcagaaaaatgttgacagggatttaaagctttgctattgtctactaatgatcttgttatatatcctccatcataaggcaacagagtaagcttgattaaaaattatttaaattaaccccktgtggaaatgtcagtaggaatcatattgaattacctaaagtcacataattttttaaaaagcctcccaattcttgagcacaagctttaaattttacacacacacacacattcatgtatatatttatgtgtatgtatatgcacacagaaaatgctaccattctccacagaaaagcttaacatttcagaattagaaatttagaaatacagtccagtactttttcaggttaaaattttaacatttattttaccaatcatctattgagtgaagaataggttaccgctaccagcagttcccagtgttctctaaaatgtgactccgatgggtcacttcttgagaaaaagctgagaaaatatgtttactatttctctgatgttcagtgtgcagacttttagcttgagtttcatgcgtgcccagagctgcctgcagactgccatcagcctcacctactgttatccccaaagcctccaaacccatctgtcttcaaaaaatactttggacttcctcccaggaggacatctccttacctgaaaaaggtacttcattccatcatccacatcttggccatctctgactcaatttcatctcactttctctccaaagctttccactaaccacctggattaaaatgaccagatgttaacaatttgtatctatagcaagcatttttattgttaattttttgatacataaagattgtgcatatttctrgggcatgtgatatttagatacataactacaatgtgtaatgatcaaatcagggtaactaggatatccattgcctcaaacatttatcatttctttgtgtggggaacattccaaatctttcttcctactattttgaaatgtacaataaattattgctaactatagtcaccctaatgtgctatcaaatactggaccttattccttctatttaactgtatttttgtgcccattaaacaacctttcttcattatttacccctactccttcccagcccctgcaaaccaccattctgctatctccgtgagatcaactattttagctcccacaagaatatgagatatctgtctttctgtgccttatttcacttaacataaggtcctccagttccatccatgttgctgcaaatgaagggatttcactcatttgtatggctgaataatatttcattgtatattatataaattccattatatatgtgcatgtgtgtatgtgtgtgtgtgtgtatatatatatatatatacacacatatatatgaaatatatttacatcacattttctttgtccattcatccattgatggacattgacccccatattctggcaattgtgaagagtgatacaacaaacatgagagcacagacttttttttcatatacccagcagtgggattgctggatcatatgatagttcccttttttattttttgagaaacctccatactgttttccatagtggctgtactaatttactttcccaccaaaaagcatatgagggttcccctttctctgcatcctccccggcatatgttattttcctcattttgattatagccatgtcaactggggtgagatagtatctcattgtggctttgatttgcatttttctggtgattagtgatgctgaacattttaaaaatataactgttggctatttgtatgtcttctttcaagaatgtctattcagatctttgtccatttttaaatggggtttgttattttgttgttgttgaattgttcaagtttcttatatattctggttattaatcccttgttagatagatagttggcaaatattttctcattctgtaggttgtgtctccattctgttggtggcttcctctgctgtgcaaaagtttgtcagcttgatataatcccatttatctatatttgcttttcttgcttacacttttgaggtcttaaccccaaaattcttgctcagaccaatgtcctgagaaattctttaatgatttcttctggtagttttaaagtttcaggtcttacgtattacatttaaatctttaatacattttcagttgattttttaatatagtgagagatggggatctatggttttgcatatggatatccagtcttcctagcactgcttattaaagaaagtgtccttttccccaagtgttttcttggtgcctttgtcaaaaatgagtttgtgaacaaaaatgtgtggattcatttctgggctctctattctgttccattggtctatgtgtctgtttttatgccagtatcatgcagtgttagttactatggctttgtagtatattttgaagtcaggcagtgtgatgcctctagcttgttcttcatagcaagcatttttatagttacttctaaaggatgatcatcttccttggccagtgacatcatataaattactataaagtgttttttgatgctgagctgttttccatataatccaacctgatggccacataaagctgtaaatgttttaaggaagaaaataccttaaacttcctagtagatttggatcttaacactgtcttttcatagagctgaaattaaaggaggagtttttgtttggttttcacaaacatgtcctgaagcattaacctgaaattttaaaactggtttgaaatattagrttttctatcccctgcaaagctgtactataaaattaaaggaaaccaaaaacaggcatgggaatatgatagttaggtggtgttcctgagtgtggtattttaaagttttgactttcagtttcctcatggcattcacttgaaacctggttcattgagggctagctgcaaaccttccagatcttgtccttctttgcagctccaggtttctctggcctatggttctccaggaccctgcagttttttttttttttttcagaggcctgtgccacatcagttacacacacaaaaaaaggcttttgggtaaagggaaacttcatgtactgagcaagaagcatgaatgtaaaaatatagaacccctagggataaggaattcagtggctacctatgccattcgaaaggagtgtgccaaaatgtgcgctgagtagtgcctttcccagcattttctttttttagaaattaaaagtatggctctgatgccaaagctacaaaccataaatccaattaaagtgaaggacttaaatgtacatttgggagagtcgggggaaagtggaaagaggatctgtttctgaatcacctcgcctctttctcttcctccctcccaccctccaccctgaaaacatgtccacacagtgggattgcttgttaaattaggacactatgactatgtaactatatttgtgaaatagagtcaaattaaaattgaaagaaaacaactgaaatgcaaaaaatatgaaaagaaagttgaatccatgctctagtgcaaatgttcttccagctcaaactacctctaaaatagccctggactgcgtgcaactccacatctcacagtttgctttatgaagtatcaaaacattctcaaacttttgactgcaataggtttccatgtttttaaacttttgctctaataagcaaggtctgtctgttttcttttaacaattttataagaaactgtttccttttctcctctccattccttcactcatgtccacccttcctcacttactaattattcatagtcaagcccctaagaagaaaggggcagcgtttgccatactttactctgtgtgtgtgtgtgtgtgtgtgtgtatgtatgtgtctgtgtgtgtgtttggtcaagattaggcagggagacagggatcctaaactagtgctttttaaatgataatacatttccacygtttaaataaggtatgctttttttctcaagatttttttcaaagcagcaattcccttcccagttcctgtagcaaatgaccatccaactgcttgaacactttcagcgacagggaatgcattactttgtgggagagttgattcttacacaggatagctaggagtattggacatttcattgtccttttggatgtatttattcatatattaatgatgtatttattgagcacctactatatgacaggctctgttctaggcacctggaatctagcagtgaccaaagggacagcaaccactgcccttatttatgttccatcttggtgtcactctacttatttgtcctaattctgtcttctgaggcaaaactaaatcattccattccctgtttytgtgacagccccacaaattgttgaaaatgacatgtcatcatcttcagattaaacattttcttacacggttttccccaggcccaccctgtctgtcactctcctctcrtctgtcagtgccccttcactgtgtgtttgtatcaggggtggtctgagaacactgggatgtccacctagagcacagctgagtggtacctgggcagcgtgagaggccagatcacagaggctttcacattcacgccatcatttcctttttgtgttgctcttgcacacatcatatagtgactctctgcctccatttccttgtctttttttttttttttttttttttttgagatggagtcttactctgttgcccaggctggagtgcagtggtgcgatctgggctcactgcaacctccgcctcccaggttcaattgattctcctgcttcagcctccagagtagctgggattacaggcacatgccaccacacccggctaatttttgcatttatagtagagatggagtttcaccatgtaggccaagctggtgttgaactcctgacctcaggtgatccgccagcctctgcctcccaaagtgctgggattacargtgtgagccaccatacctggcctcattttcttatctttaaagtgaggataataatgctacctagctcaaaaagtcgctatgcatattaaatgagttagtatttttaaraagagcacttagagtcgtttctggcccaaagtgtatgctcaggaaatgatagctattattcttactattgttatcattagcgctggatattacctttctgtttatacagcctcattgttttaggactcacatcatgctattggtttaatgatgatgtggacaattgacagcaatctgctktggttgtaaattcctctcagctcctaacaaaacgcttggaacaaagtagattcacartaaatgcctcctaaaggagcaagttaaatatcttggcatttgaaaacatgcttaaacaaaacatagaaaggatttctcctcctgttttccaatgtaaaatgttgtatttctgtggctgtgttgcagaattctagagatagatgtgtctgtaagattgattaagggtgatgttatgaaytgcctttctaaaattttaagccttaataaataaaaatggtsaagaggcatcacttcctggtgataaaataaggagaaactttgggttttagagatgcatataactggttgcaactgaattcaagagcaaatgctacagtatccttcatgaaattttcacactgatttccaggagtattcttttctttctttctgtacataacatctggtttaaatgtttttcctgtctggttaaaagtgtagatgtctacttggattcataggtatcgtatctstgaatgccgcctcttttcttctccttcccttgctgtttgggagattctgtagagaggattattaataaaaaaaaaattttatcactcccatctcctcccagaagcagctagaagacaaatgtctggaaaagaaactcagaagggaacagagctcagatgtttgyacctttctttaaatggaagtagctttaaagtgtttatcactatcatttccaactatctacccattagrtggaggtctctaaatagttctagatatgaacagacaagatgagtgatattcttgctccaaaatgttacttcttaaatatatgagcctcaactctggaggatgaatagatcagtccttgccatgtgcagttattttcttaaattcacccactgcttatttttttaacataaaacatttaaagaawtgcttcctggctctaaagcaaatgtataaaaaaaaaaaacagaaaatatatttttttcagacaaagttcccagtttactgctctactatttatctgaagaaatagataaaactgcacatctggtgtaattcttgttttcatggttaatgcaatatcctgatgcaatataactttccctgaaaggcttttgattctgaattttgttacataaaaatgcatttttttttcgacagatgtctttggttctttaacatctactttttgtcatgctaattctgtatttcagacaatgtaatggcagctgaagaacaaattaatacggtctgctataggtttaactggctgtggaaaattctgtgaatgaatcaagcagcagtttttcttcagattctttaaatttagggaatcctatttctagtttccgaaaggagaagtgaatcattctkcgtagtgttttagctgaatatgttaaatctgtgtattaaatttaacataatactgtatctacagttaaaaaaagaatagtatttagataacaattaaactgaattatctcatatttccctctttagatgacaatagcatttaagaacttacataaaatcctctttgcttcataatctgggacatatgtactctctcagctggcagtgtagtccttactaatgtttatgttaatagaaggatacataaaagttcctgaaagtaccataagtgtcttttagtgtttggtgtcattgacatattaacaaggagtctgaagatgagtaacacacccacatctgtcagtgccacagccggcacttgagcgacacaccagcacctcagacagagcatacagcttctttgctggtgcgcttgtgttctgggaaggagcaaatgaaatcattcacaaatcaggaattcctggcacaatatagaawcaggaaagctttttctagatgtgattgtaagtgatggattgacttggatcccaaatgttatcaccaaaagatacrtgcttttctttcttttcttacttaaatatgcacaagaattttgctgattgtattttgcaattacataattgatatttaggatttaatttggaaaatatgtaattacaacttaaaaataataaattagtaggccaaagcacacgatgttttatcatacaattattcatctttgtatgtgatgaataaataaggtgggacaatagatttgatattttggccattttattgtccatttctggattgtgtgggccatgagagctccaatgtgtttctaatatgttagaactttgcaatgagaaaatttcattagaaaatagtgttggaaagagtgcttttctgagttccaaagatttccttccttctgtagtttatatacactggatattcaaaaagctagtgagagttcaaccctgggctaggaatcccaagatactcctgttaagtctgttccttggagataagggtcaagtattaagcaggattcttacagtctcccttccctttaatgatctcttcaaacattttcccctagaaaaagtctttrcccatagtcattctcttaatatactttacctagaggaaatgttttagctacagtagttaaaaagcttaaaattatttgtgtttccgtttcaaaacccacatttatctttagctcaagcatgcttttctccaactcttaaatacaatataaaaaattcattttgcctcaaaaaccatttatagatatatagccactttaaaaacaaaacagaaagtgaattcggttcaataaatactatttgagcatctgttctgtggcaagcaccgtggtaggttattttgagtaatatgcaaattatcaagggatttatcatttatttgcagagcagaaagacatgcaaacccgctaatttaacacatggctgattgatataaagccatattatagtttctttcctctcctcaataaacagcaaactctttgagggcaagagctgtttgggtttttcatttgtttatttttgttgttgttagtttgtttttgagatggagttttgctcttgttgcccgggctagagtgcaatggtgcgctcagctcaccacaatctctgcctcccgggttcaagcgattctcatgcctcagcctccagaatagctgggattacaagcgtgtgccaccatgcccggctaattttgtatttttagtagagatggggtttctccatgttggtcaggctggtctcgaactcctgaactcaggtgatctgcccacctcagcctcccaaagtgctgggattacaggcgtgagccactgtgcctggcctgtttgttgttaatgccagatgctatctctagtgcctgcagacataggattctgataggcagagaagtggtggagagctattctagcctgtggragaagtgttaaaatttaacacacataatagtacattggaatgggaccgtgagttgggtaatcactctgaagtaactggaaccaggttcctagagggaaggggttctcgaggtagcattgggtcaatccataaaggaaattcaatgtaatcttaagggataaacaaagatagcaaattttcccatgcctttaattttatctatcattttccttagtgtccctatcccacctttattttctcagtcctttggaaaagttcctggacacagtttatttttgtggttggattatatgataatatatatctttaagcaaattattcaaatactattttctgctactgggagtgccaaaatctaattagatctgccacatttttttctgcaaaaatgtacattacaaaagttgtttttaccctataaaaatgtgtgattttttccatagctaatagaagagaacttacgtttaagaacctatactgataaccaattagtactgagatttatgtgtatataaacatagttcgtatgatgtatatacattaatgtatttgctacagaaaaacatatgtcatagtgtacatttttccatttaaatcataatttaaaataagtacaccatttgattggttatcctgattcttctttcgccagtcttcccattgcatgaaaaccatttatgacggtgtttaatttaattgaactcatttctaagagaatgagtgttttaattaaaaatgttgtgtatttttcccctgaatctgaaggcagtcggactgatttgcatttctttcagttctgagtgttgagggtaatatattatgaaacatctttttttcttgatatgtatgcacattagttttcattatttctattttaatatcacagatcattgttagcacagagttttgtgcaaggagtatcttcaaaacgtttttagtaaaattatcaggcacactaaatagaaaataaaagacaaaactggaggaaaaggggaattaagacaggcaaagaagagattctaagtttttatattttcttaagcagagtaggtattctgaacacgaatgtttcagaagagaataaagaactaataattttatgagttaaaaagtattttgcatttttgcatggctagctaaaatataggtgtaggactttagatatttatttttcaattattcattgggaatctgtattgtaagactttgggatacatcagtatttaaaacaaaaatacttgtcttgtaggccttrtatttaacgtttactagaaaaatatcatgcaagccttcttattctatcagtttattgaaaaaaatgagcatttttttacatattacatgtatttttacatattacattaatacatgtttgtcttacacatgtaatatttccacacttttatatctgaaggtatgtgcatttaggatgaagtttcattttttatcctagtaactatatttcagattgtctttacattttcaaactcttttggctaatttcatgttagatttcaatagatcatcatttgtttttgttactagtttctatacttgtttttaaccacaaaatccatgtaaaagaaaaatctcatctttgttatttgttttgtgtttattttagcttattttattcgtatcacctctaatccttattctctctatgggatttttccccctaaactattctaactttaggtaaactagataatataacttataaatctacttaaccaggaacacataaattgctacacattcacctatgataccataaaattaccataaaattgtccaaaggaagaatttgatgtcatctgaagtttcaggaaagtgctcttgaggaaatggacgtgttgatagaaccagagtggggaggaggaaaaggaggcagctctgcaaaggtgtgtgcatgtgggtgcatgcctacacagatgtgcaaaggggcattttaatgcaggtggccatatttgagacagataaggttaagggaacaggatagatgtgggaaattatggaatatttataggtaacccacagtgacccaggtgaggctacttgcaggggatggataagggctatagtgagcagagccatcagataagatagggccttactgcggtaaggtgcatacgtaactcagtggatggtgaagagtcactgcatatttccagacatgaaggatttgaaaaggaaaactgcaggtgggaagaccacctaagagaggtaatgaggggctggcagtgaaaatagaaaaaaagaaaaagagcgagagatgcggaagatgcatcaaaaggaattgagcaacccatttgttttaaacttatagtactgaactagcaattttggtaaggttttaatggggcagagatgtattggaaatgtggccaatggaaaagtgagatggatctgagaagaggtttttcaagatctttgatcctttctaacctttgcgttactgctttgtaatcacaaattcagctctggctagcaggatttgggtttagacacagtggcagttaatcttcaaaatacaagttggttttggttttttaaasagatttgatttgcattttatttttagtgttgaagacattttagttcaattattccgcttgtacaggctgcattaggtagcagttaagtgggcagggtccagagctgagtgatcagattccagctgttaacttactggttatgtaccctttgtcatattattactacttaattgctctgtgtctcgatttcttcatcctccaagtgggcttctattaagtaaggtaatggtgaggatccaagagttaataatagaatgtgcttctaataatgcctggcacctgagaagaatagaatcaatggcgttatgatttctaaaaaggaaaaacgtcaaacaatatgtaaccagatgaatcaaaatcaatttggttgtattttctcgaagttaaaggagaaaaacataattttacattttatttgtgctccctcacccaaaatgaggcataatcccaaatctctctgtataagcatgagggcgygtgtgagtgggtgggtaggtggcttctcactgcctcgcctgatctagttaattcaactccagaagacagagtagctcaaataggagactgcttaggaataagtgatgtcagaacataaaagttttacagaaaaattgtaaatcactaatattctcattttttttcttgacaagagartaataaaaaattctctttttcatgtttttaactctttttgcttttattcgcttcttttccatgctacatattttcagtgaagagcataaataaaatacagcaaaactaaggaagaagtctttagtacttagcccagtcaggtcttccaggtgatgggcagacttaggcacaatagtattttttttccactagtgcatatcttagaattatgtgatttgggaagttatatactacagaataaggaacatatgtaacgcaatgcaataatcacttagatatttatttttaaaatcctactcttttaaaagctttcatattctaatacagctagtcacactgatgttgtgatgatctgctgttcgtgcattattttccaaaaggatttttccaatattataccatctatgaagcaagtctaggtacaatggagtcacgtctcaaatgatcagttttaaatgatgtgcatagaaatagatactgaaattctttgtaatttcttcaggactaataaagagcttaaggatagctctcaaaaaaatttttttgtcttcacctatttgcaagaccacaatttttctattgattataaggtgctaggtttcattactcagtaacgtccgactgtttcgacagcggattgcattagcatggcccattcagctgttgtggagagatgccagttgccatggtgaagattatgatgtcccacatccaatctatccctgagatggggatggcttttgcaaaaccacatgcaaatatttgttttcaaaggtacaactgactctttgtgaagcactggattactagagtggatgtcttttcaatgaatcatcaaatgaggatctattaccacatgatttccctttttgtttaaataaacttccactgccctctatctcaatgcccgttgacaaagaatcagatttcatattgtataacttgactgtcctttttagttatacaagttaatgagtttagcagtttaatttgtctaatttctctatttgattgcctcagagctgacctcatatgcgtgggtttgctgtgtttcccctgagctcacaagtagagttttccgttttcctgtgaatatgtctaagcagcacagatacttccatggaagtaacaatgacccttcacacatccaggggttttctccaaattggggcttttcctaagaatatgtatcatatgttagtatgaatgtttttaaaatataggtattttttgttttgtttgtttttaattttgggaatacttgtcaacttaagtaaaaggagaactccattaaaaaaccttttaataaaatttctgagagtcaccagtttgcaaaattcttgtcctgccatcatgaatgataatattgtttataataattcgtttatagtttaaactaataattaaactgacagcttaattagtttaatagttttaattaataatttaaatatgcatataccagttttataaaacagcctgtttctgtggcttactactgcatttcctttaccttctataaatagaatactgcaggtttgataaaacacagaagaatctgagagacaaaataaaatatgctacttgtataaaatgtcctcttctgaaaaaagaaagagaaacagaaaagataaaggaaactatggtgacacattgtgaggcttatgataactatgtttgcctttcagatccccagctcaagggtatagtgaccaggttatattgcaggcaaggctactacttgcaaatgcaccccgatggagctctcgatggaaccaaggatgacagcactaattctagtaagtgacaacctcaggccaccagttacatagttggtagaagatacactgctacttaaatgactttttaagattcatttgcaaatgtttggtcgtgttggttcatctttacaaatgttacacactaggatgccatttacaattttatttaaactacgtggatgaaaatattaatggagtaaccaaagaaacctatggtttaaagatgattatgttactatttttgttttttattcagacagttatcatacccagaaaattactgttacttttaatcttattattgtaaaagttaagtaagtacactagtgtatttaggtaaaaattaattacatgttttctttggatgtattattttatcaggctctgaggttcttaacgatgcctgtggaaactcaaaagctacaaggaatagttttgttttgtttttttacataatagaaatataatttaaaattctttgcatttaacaaaaaaaactttcttatagaaaaaaacataaaggttgtgtactttgaaattcattgtgcaaagtgtttgcagaattgcatctgtgatcatttttaattaaaaagctacacatcttccactgtataaatgtctgtgttctttttcctatttctttatgtataacatttctccgtctggtgcctctccttactcaactgtctgtgttttgctctcccattttctgtttatattggcatctgattcatttttaatttagcatattagttccaaaataagcacactttttactgtttgggggagttagtgaaaagcaaaactatttttattagaaatacttaatcataagaaacattatcggtggatcaaaaatagatatgaattttttcattaatgtatgtcttattcttcacatataaacatcattccatgaaaagaagtgagggtttgaataatacacataatcaaatcagaaggcacttccttttttatttttattttatttatttttatcagctcaatttaaaattcagcacttccttttttaaattccagtgatcaaattgccagtaacactgattctggcagtagttagcgatacaaaataggttatttttacatgtcgttttgccatgtgaaatatcattatttttccagccatcgtgttcactttttgtattttgtgcattgcttcactttttattttttcttcaattcctttttaattgttgtgtatatctacattgtcctccgtgtcaatttctaatctctttactctctttgtgtctcatatcactcttttttatttttaaatttttcctttttatgtttgtttattggtttatttttagtttatttcctttttgatataggaaaagagaaggtaaaacaattcagctacagaagaaagaggaggcgttttatgccaaacatgtacttttgcagcttttgttattagtttgaactttcaaagattattggtagttgacaatctttgaccaacaaaagatgtcagtttcttatggttcaggctaatacatgtatctctgctcagtttcttttccccttaaactctttacccatttgttgacaaaaaccatttcctttctcttacgtgttactgttgtgtaggtcacaaagtttagcgattcataatttctgatgtcttcagtgttctctcattttgtttggcctgggaggattagaacgtaataactagtttcccataactctgatcactaggtgagctatgacactctgaaagattcatcaggctaaagactgatgccatccattttatgacaaaagttttcaagacaggacatacaccatagcttcataaatatattgctttattggactacgtgaaaaataatttcactcaaacaaaggttttatgtgttttttctctagcattttttctttgtgtaatttttgcagagccaacaaaattggttacctttaatgataggaatcaatattattttgagaagtgtctattagacattgccttttaaaagcatactgcttcagaattgaataagcactttctaaatatggaagtgcagatttattatgtgcacacatacaggtctggttatctgaataattttaaagactaaactggaaagctgagatactaaaaaacactccaccttctgttctgtaaatatatgttttttttttttcttctgtatctgcagtagaaggagcaaaaactcagaacgaatcttgaaatttcttctgacactctaaatgctagtgagacacagtcctgagaagaaagatgaaacaggatcccctttgtaaaagcaaatcagaagaaaatcataatgcccacactcgaggggctcaaattcctgtgcaaagttctggtccacagcttttctgagayattatattgcatttcaagtgcactgtaagccagttagtttagttttgttactatttcaacatttgcaaagaaataaagaaaaacagtgggtaaaatcaatattccctcctcaaaaggttctacaaattatatgactataaaatttaatacaattggcagaatcgtagcagatttataaaagtaatggaaattactaattaacttcatttttatgtcctctggcctatgcaaattgcaaaacggtgtttcttaggatgaatttaaagacattttcttttctctagttcatttcaatagtctcatgaatcttatgaaaaatgtaagcactgaaaaattctttaaaaataggaatgtgctttagaaaggctgtcaggtcctacttagagtacagctcttytgttgtgaggacagaggtgatgtaataatcatatagtttcctagttatgaataaccaacccatggtttgtattcagggagttataaaaaatggaaacatgtttatgaataatcattcataaacatactgaacataaacattatgaataatcattcataaacatgtttccattttttatgactccctgaatacaaaccatgggttagttatccataactagcaaaaataattttaaaaaaaccaaaaactcacccagatagcactgttaaagtcactaaataacaaaattgagggcttgaactttcgtatcttcatgaattgagttcaatacatttcccacactaaatatggatatttagaatgaaaaaaagacagaaccatcctgctaaactgcctttgttaaaaatttcagatgaattaagaagaggggaaaaaggcccactggtaggcaaacgttggtgcccctgttctccaagggtttccagtctaatatatgtagatctctgggaaggaaaagtagcacaaaaattgtggatgatgggtaaatggttctggtggagaaaatactgtagcaagtcaactgctttattattgactaccataataatggaaagatctttcacaaaaggaagtgagcacctaggtaacctcattaccactctcatttaaagttcttctaaatgtcagcatccccatgaactacggtactttattagtgggtgagttttctttccccccactttgcttttggggatgccatggattttttctgtgctcttaaacttcattgttcctactgacagacaatagctactacaagcagaataggactctacagatatcaatacactattaactatggtaatgttaaaacctcaaaagtccctctcaccttagaaatgctcaacctggtaacttgatgtgtaaaatatttcgatcactcagtggccaccaccccacaggatttaggacggcagttctcaccgtccttagttgtatattagggttatttgaggagcttttcaaaaaaattccttatgtcctaaacccgttcccaaagattgtgatttaataggtatggggttgagcctggccattctatgttatgaacacagctagttttaacgtgcggccagagttgaaaatcactgttatatgaagaactagaatgttccatgaatgaacaaagtcacaaaaacatctccattattcttactcccctaggctttgtgacattgccttataattatgtaagaagcaaagagagtggagaaataaaattatatctcaattaatgtgggtatctgtgtttttaactagtaccggttccatcatggccagctctgaatggttctccacattttagtgtacataagcattcactttccactatcattctgtaaattataataccttgttttatgtatgtatgtatgtatgtatgtatgtatttatttatttatttatttatttttgagatggagtttcgctcattgcccaggctaaagtgcagtggcgtgatctaggctcactgcaaccttcacctcccaggttcaagcaattctcctgcctcagcctcctgagtagctgggattacaggcatgccccaccacgcctggctaattttgtatttttagtagagacgaggtttcaccatgttggtcaggctggtctcgaactcctgacctcaggtgatccacccgcctcggcttcccgaagtgctgggataacaccacgcccggccaataccttgtattttataattcaggtcccaaccaaaacacaagggaaaaacactagtattttttcagtatgatcattttaaactatcttatataatttttatgtttcccataaccacatcattttggtgaattcatgatctatttgttttctaaaattatactacctggcctatataaaatatgtggcacctacaaatatcattctgagtgtgtgaaagttagaagaggaaagttagaataattaaatttgaattgattaagttagtgtaccttgcgtggacagtcatatgattatggttttccctccaaaattttgtgtataaatcaggaattattctatggtgcccattctttcaagatgtaaggggagatggtacagttcaggtgttctaaacaagagtgaatatagccatctcccaccaagaaggaatactgagagtcgccaaatggcacaggtagctgtactcaacaactccacatctatatttaatattaaataatggaaatgaggaaaaaaaactaattctttcataagaataacataatcccctaaaatcctatagcagaaaatctgatattagtttacgtagtgaaactaatatccaactaaccatagatgcccctgagtatttttccagggataatattcatggctctggcctgaggttttccttttatatttgtgtagcacagacatcttgggatcttgaaaacagtagcttgtaataatcagaagagagggtgtaattttcttcaacctattaggaggaaacatgtccctgagaattaaatataacacaatttgtaaagtttgtttttaattatgtactacttagacccttggaatgaagtccaaattgcccacatttttcaaatgacttggttttgtgcaatacagttgagagcctgagtttggatactgtacttacacttacatcactattttagtgctttcatttcctgttctgtcctgcttagaattagacttagttaagaaggacttgagtagcagcagataacctcactgtaaataattaatagttctcttacaaatgtatctataataaaatctccaaaatcatcaagcagttatctctaagactgatgcaagaaaacctactaaacattcaacatgcagcactgccatggaaatacattaaagggatgttaagtttttttaatgttataacgttgctatctgcactatgcaaaaatatataaaatgcttttaacattttatcaacagagaagaaacaaaacatggaaacataaatgagtagcctctctgacatttgcatgccattcagttttgattagktctttctaaatttagctccttggcaggtgcacatcttttcctggcttcgctggcrtatcatattggttctaccaccgtcatttagttttggaatcacctgtttaacttctggcctgacctcattgcaatgacaaatcacaccttctgtgcgaagggtcagaataaacactcgacttggacttttaaaattctgctctttgagagacttcacagttgatttcttttggtatctaatggtgtcagagacagtgtttctagaggcacgattacaggcttggttctgtttattgtcgcatcagcccttcagaatgctgtcagcaagactgctcacatttaaaggttgaagctgaagtactcattttacccatagcagaaacttcttacttataaagcaaaatataagttwtttrattgsaatttctagaaagtattggcaaagatgatgtttcttaaataaaataaatcagaaagaaaaaattacactctgccctgcttcttcctgcccattcatgatagacaatgtttatcttcacagcactcttcaacctcataccagtgggactacgtgttgttgccatccagggagtgaaaacagggttgtatrtagccatgaatggagaaggttacctctacccatcagtaagtaagacgccaaagatctcrgccattcgttcaatgcatgtaaaataacaatggcagcaacaacaaaaagaaagttctatgtctgttgtttctgccagtttttgccttagtatttgatctttgcgagaatgcttagaagctgtttattattcaccagtgtttagtaatatgagtttatctaaaggaagtgtaatactatgtcttaaatagtgcttttgccatattttaaaaaataacctagtatacacgtgaatctaatcttttgtatttctagttagaaatgcacttatcttagagagtttcttataatgtttttaaaagaaacaatatgaattctaaaaaaagagaaaagtaaaaggagagtattttctaaagtaagaattcaaattgtgtggatattttactgaaaaaataactacttataatattgaaatgtgtatttcttgcaagcctctgtgttttgtggtaatatttattggaagctgagcacttttctagccatatgacctcttctgaaatattttctatttacaaccgatttgcactcagatatgctgtattcatgcatataatgtagttagaatttatttctgccacaggtttaagcagtaaagacttaaaggtgcttttttctattatcccttgagcaaaaattgataaagtcttaaatgcattaaaatatgctcttacatgtcatcctcatgtaaattcgttgaaactctgtcattgttaaatatcaccaccaacaaaactatagataaatatacacatattgtgtgtgtgcgcgtgtgtgtgtgtgtgtgtgtgtgtgtgtgtgtgtgtgtgtgtgtgtgtcttaaacagaaacattctccagggggcctcccagaaaatgtaatctattttcttcagtcaatttgggaaatcctgtcacagggaaatgaagtctgcgctgtggattcccttcatgctgagctcaaaagtgctggctcttcttattctgagttccctgaagggtgttcccacacagagaactgggtcccacattatgcaaattgtgttctctcgcacaagacgaatatgcagcatgttgccagcaggatcaagctagaattccctatgctccctttagaaaaaattaaatacgaaaaggattactttctagagatgctttattttcagatacagctcaatctttttgatttggaacttgctctgttatttttgtttctttatcttcttcccaagtaatattttaggggcctaaacatcattagatgcagtgtctactgtagcttctagttctatctttctgttagtaattgtatcacattgctgtactctgatacatatgttgatgacagggaaattgaaatatttgttttatctttgtgctgctgagagagttgctttttatttatttattttttgtcatgtggttgtaaatgtatgccattcttttttaaaggtagggtatatcattttgagtatgtgtcttagcctaaaataaaagtattgattatgcttggtgcaggctaagcagtaggaatagaaacaagaaatgtgttaactgccaagtccagtcccctgcattttaaatatggtttccgcatgcagaaatcagatctcatgagggtcactgcgtgcaatagcatttgcccagggtgagtcccgggaacaatttaaggcttgttactgggtacgttgttctctcctctcccttcttccttctgattctccagttgcttggcttccaggcctcccctttggtggctttattctctgacttacagatgttggtgttctcctcttcccatccttgactctttgttctgaacccaaagtctggtaagagacacagttcactcagcccctaccctaagggatctcctgtgcctaggccaggccactgtatgtcttagccatctttggaaagaggacttggataaaaaccaaaagcgattatgaatctatatcagtacctcctaattaaactgctctgtttatttcaatgtaaaaaaatttgaacttcaaatatttcagtacaaataattatctgcaagtatttattcyataatttgttactgagagcctactaaaatagtaatatagagcacaatatagcaattattatcctataaaataatagctatatctatacaataacaatagtgatgatatttgtacaatccactctgtctagcactgttctaagcactttacctgtattagctcatttaattatcccaataaccttttataagcaaatattattaaaataaggacactgatatacagagagtttaagaatctgcccaaagtcactcaggtggtagatagaaaagataagattggagcatagttagtatgactcattagcttacatttttaactgttttattatyactgcttttatgtgccagacattttttcataatatggtctgacaccttttctaacaagaagttataaacacattatgatgtaatgaaaaacttttagggaattgttacctaggaaataaactgtatttcagtgcaattattgagaagtataatttcaaacataatctgtttcctttaaagatttttgagttaaaattaaaataatagaaartttgtcaagaaaaagtttgatattatattatgggtattaattttttttatatttattacatttaacatttaagctttaagttttaaaagccatgacaaacgttgttaacccaactaagaagttttgaactaagatgagtaaatttttgaaaaaatgacagctccagtcaagctcagatttaaagaaagaagttaatggagatttaaatcagacaaatgaagtcatccattytaagtttatcctaattttttaaaaagttaatttaatttttgtgcagtgtaaactagagtctaatatgaaattgatttttttgaagatccataggtttagaagtagtcaataaaatactcaggtcatctaatttgaattctggtaaacgaatatcacaacggtgatttgacttgaggtgtatcttcctctatttttatttcaggaagtaactttcatactcctttgctatccaaataagatacttaatgtgtcagataattccaccttctggagacagataaaaggtacttgactgagatgtaagttcccatttccaatgctaaaggcacctgttctctgggggatcttttcttcaatatgatgatagttatttcttttgtggtcctaatgattgcaatatggtacttgatattgtgctacaagagatttaatgtcggatacaagccatttgattgaaggtacagtgtgggctacaaggacgcagaatagaaactgtcagagtaataattctgccaaaaaattagacagtttaaaatgatgtttatgaacaaaaatgtactttaaccacttatcactatttctagtgctgagagaagcagtcaagttttttgtttgcttgtttgttttccaagcctgtgactttgaaagactaagaaaatcttccgtagaaagctaaggtttggaatgtaaattgtaaacaataaggaaaaactggtaatgaaaggaaaatgtcattcatcatcagggcagggataaaggatagttgaagtgagaatgtgtttctggcataagaaagatggagaagaaaaagaaggacgtaaaagagactgatgatacaatgagtaaatctctgggctttattcagaacacctgggtcctggatctgacaaccaatacctgtgttaaaacttcctaatctctcctagtctgycccctcatctgtcagattacatgatttctcttgaatccttcaagttaattatggggtttacaattctggttttartatgattgatttttctgaatgataaggtaatyttacataaaatgcatagagattccttattggtattttatcacaggctggcatttatgagaatattattttcctcctggtgccatcagtgcttccatgttctaggtgcaggcatcttcgcggtcrtaagtgccagtgttctcctgaaatwagcatctcatctgaatctgttaaccagattgtataagtggagagaaatataatcctttttcrtgttgattttaaaaataaaccaggaaaattcaaggttaccatgttttgcaaatattagggctcaygcgaatcacctggaaagccaagaaaagtacagattccttggatcaccatctagatattttagttcagtgggtctaatgggaggcccragaatcaacagtttgtaagggtcaccctccctcacttctgccggttattctaaagttactatttcaactgtggacaatcacacaacaagcattgctgcaatgstatctgggggagacggtgataacgttagaccaaggtgatggtaacagagttggtgaaaatcagtaaatggactactcaggcattgaaactaaatatttggattttctaactgttctaccactaagctgaagtttacagaagtttgaaagcagaccagcatacttcttcacttaagcaacaactcagaacttctggaatagggactggtcatctctgtgggctggcatcacctctcctacctatccatacaggataaatatgtatatatgaaagttctttaatcaaggaaagaaagataaatgctatgtattcctcagtaagcattttcaagatcatcaaagtcttatccactctacataagatagtgttctgatatcatatctttcaggagcattttcaaatgagcctcttctacaaaggtggtttyacctgccctcctctgtgccagcaggcttctcttattgatgtgtcctgagttgtgtttccgtctgtccttagctttccaagagcacccaggcataaaagcatccgagcaacccacctcatgcttccatgaactgttcatcttcttgcaggatctataattctagcaaaacaaggtggaacaatgttattttcctcttgaaatttattcctctcttcgttgctcaagtttagggtatagaaatacaactgctctgttttatcagtatggtacctatcatccttcagagtctttctaatcttccctaagagtaacacacccaaagacatacatgtccctcacctgtaagtacacactcatggagtattgcgtgaattcattgcccatccctagcacctgtcctgtctctgagtaacacctttacatgccgattctcataaaaatgttcactatttactcagacattggcagggcttcctattcctcctcccccaggttttatgtttatttgttttgttgttgtttgctaccaggcagtgcatgtgcttaatcaaataaactgagctctagtggccatcactggccatcaacatccattgcaggcagaccaagggccttggcagcatttgagggttgctcatcctggggaagagcctttcattctccctgggagcactaaggcaaagctataccaagttcatctagttacacacaggtgcccctttaagaatggaaattattttattctttatcttttattcttcatctctctgaacaggttggtttctttatcataaaaagtatattaaacttgagatgattattaatgtctccaattattataacaatctatgacactatgcatgtttttctgcacaaacaatatctaacactttttggggatatatatacacatagacacacatatataattctcatatgtatgtgtatgtttcattggaattatgcattctcctcaaattatatatacatttatcccacgattatgagtgtttctgtttatattaataaaatgttaaataacagttttacatttgcacatactttaaagctttacttgtcatgctttaacaatatttctttttttaatcaagcttttctgtgacttctttcacattagagttcagttggatatatctgccaggttgaaatggctattatcctttcttggtatcttggccaagataatttatagtattaataaagcaagtatgatacttcagctaattttccccctaatgctaatttcaacatccagcattcgtgtaattcccatgacattgaatattgatgcacagaatgtaattggttatgtccaagaatgccattatctacttagggtcactaactggaaaggaaaagaatttgagaaacaaatacagctagtaaactgcatttaactagttataaatcatcttttggacaacagaaattatggaatatccaatttttttatttgttaggttgaagctagataacagaaataaattactttgatactatccagattccagtgacattttatggaatataaagagagacattggagtggatagtgaaaaagatactgagagcctaagaaaaagaagaggaaaaaaaataaatataaaggaaagaagataatagaacagcagtagtcagatgctttggcagcattgtggaaagaaaagagaaaagaagagaaaggagagaggatgggaggatgaaaaaggaaggaaatgaagaaaacccatcacaagaagagaaagggagaccttgttttctgcctactccaccatgttcctggaatccacctgactcctgattctaactttctacgtggtgtagaaaaacaaaaccatccctcttaaagctcagcccagtttcctaccataccaaaattaccttatctgctctagccccttggacacattcacctatttccccttcccaaaagtcctcttctagagtgatggctgtgtttgcttcatgtgaatttcaggcaaaacaaagaacaaacaaacaagaaaaccgctatgatcatagttaacttccagaggatttcactggtgacagtgagaatgagtggaaagggatgtcagcagtgtctaaaatctaccgcagttatccgaatgaggatactgaaaacttgaattaagaaagaaagctaaataaggcttgaaaactacgaaacatttgtcattgcgttttcttggcttgtttttggataatgtgcgtgtgtgtatgtgtgctgtgggggcaggggttctgtgtgatctgaatgcctttaggtgaggcatgcactccactactgtggccacatggtaaccactccttaattttagaaaggaagacacaacacacacrggctccctttgtttctgtacatatgttgactttgtttatgtgccttgcagacactagtgtctgcaacttctgaattaaaggggtggaaaaaatcagagatatttaaaagtgttttctgaggaactgtggaaagaacttcatggttgtctgggtatggagacagcagagtcacagctcatctggtaagactggcttagaactaggtaagctgtgatgcttttcactaagaaaataaagcccagaagcaggacagggtgggtggatggagtaagatgctgcatttggttagggacctgcttagtttgcccacaggacatccaagtggattatagtcatggaatgactattggatgatgatgaagctcattgatcctagaaggatcacatctcagggctgtcttgggaaagctgtgcmgatagaatcaattctgtgacagatggtaattgtttttctattcttcctgcatgtgagacaaagatgaatatgctgggtcagtgacatcagcataaagttagatattacaaagaagtttattaaataacatgaggtcttgagaaatctttctcacatattttgattcataagtatatagaatctacatgctcaattttggatactggataatagagcagaatactagctgaattaaattcaaaacttgtgtttctacaaaattgatgctaataatatatgaagggaatatcagggcttcagatcctctcatagtggttcacaaacatcaatatttataagacttattgaaatgattttgaaaatgacctgatctcagatattaacaaaacagaatccaagactccaattaagtggtttcaacatgcctcaagaatcataattttgagggctaggcacagtggctcatgcctataatcccagtgctttgggaggctgagatggggagataacttgagcccaggagttccaggctgcagtgagttgcgatcacaccactgcactccagcctgggcaacagagtgagactccatttctaaaaawcaaaaaaggaatcataattttgaatatatatcccaggcatgtctagtgctggtgaccaaggtstaaactactttcccacaaatcagacttttcaactgcctgcttttatatctaccattgattattgtcattactattattataatttataaattcctagttcagggcttgaactaggagtaagcagaatgacatgaccatacatagagctcaccttttccattaaccagatgagttggcctttggggagtgcatagagaaaacttctggttgtggtcrctcctcttwgtctgtgggaagaaaaggacaagaaatgtctcctcgagcaccaagatggtatagagaaagacaagacttckgctgagacttcagaaaatgaaataagaaatgatagaaasaaagcaagacattaaattttcaaccaataatggctggtttgcaatcttgaaaaagagatgtagtctgcaccacgtaaagctcaaaggagaaatcagcctgagaccatcgacaacagggctggcaggcgcctgctgagttgaagggcatgacaagagcatcctattggagcaggttgtcaatgtcaaccaacctggattgtttcagaggtggttgctttttagattaaaaaaaaacaataaaaatagataaaactgtatttaataaatcgcttcctttccctagccttctgttttctctgaagcttcattttgtctgtatctaagcagagatttccagacaagttccatttctgggttagaggagatgtccttctccttccagaggtgatcagcagttacatcaaggtgctcagtatgagacagaagtggctcgtcctccatgtccagtgtggacagtgggttgttcccatatgggcccatcataacacgtatttcctaactacaaccaaaaccatacgacctacttaacaaatatcaaacacacaaactactaacaaaagggtttgcaagaaatatgtggaaaaccattcaactcaatattcataacttaaatatatgctgaggagtagagctcttggtatcaaagtgtatattaatgaattcatttatttgctctttcagcaaatatttattgtactccttccattgtcagctattgtacaacatgtgcgaagacttcaaagataagttaaaaattgtggtttaaaattgaaaaagaaaaaataacaaaaacctgaaagtccaatagacaacagttaagttaaccattgaaggacattttgactagatgaattctaagagttctatcttttctcagaatctgtgattccatgaaaatatttgtcccatttcctcaagtagtgacagctatgtagggagtttttaatctgtacttcttgattaattattgttaaggtgaaaccaattttcacagtacattttattaatttattyctcgagtggcttcatgttcatgaaatgtactgtgcacatcacttgtcttttttccccrctgaaaaaattcagtgtcagcaaagaagatatgtcaatttctcaagttaaaattgcagaaaagtacttatttacacgctgctttgctgaaagagcatgataaatccacagacacagaggcagatgttcaacggctgcattctaatatggccatatttgcattaatgaagtgagtggtaatgtcgtctttaacttaagagagaatctcaggggagaaaaaataaaaccctaatttttagtaaatgttgccaccacttaaacttgaacgttttaaagcaagagcattaataattataattagaaaaagagctttgytatttctacatgttcataaaatgacacaaaatactttggttttatattttctttcagcgtcaaagaagaaagtcataaacatcactgcagtttgcatttttatcctgatttcctctgggggttaaaaactatataaactactgtaaatagtaacaacatttatattgatcaaaatgtttcaaattttggttagctatatttgtgaatggtacatggtaggtggtagatggtgaaaataatttttatatgtaaggagtttcaaagatgatctaaaacatgaaggcctaaaacaatagatgaaacactatttcaaaatgtattctctctttgttttcactctccatgttacaaaaatggcaacaaattacgtaaatgccaaggaagccaatatatcatatggtaaatgacaaatcaactgtaacattgaaacaacaattaatagctattatagctattaaaatttgaagcaaaattgtgcatctttaaaaattatacacacatgtgagaggactcatgactgaaatctcaatataccatctatccaagttgagttattttccttttttttttttttaagataattattcttcttcctacttctgggagggacagtgtatgggaggtacctgtcaggcactgtgagaaccctgggctctgaacagatatggggtatttctctcagtatcctcaatgcagctccaataactaatcccatttcttaatcactttggaattaataagaaaaataatttattttagaaattcacaaaaatatgtaaaacaacttttttctttttttccagaggaataactaaaacaattcttattgaaaagccaaactatacatttttcttcacaagttgtatactaaaaattggcaaaataactccctcagtgataactttcattgttttttcttttttatgttgtttgtttctatggattttatatagttttaaagctataagctattgaaacaatagtgtgcatttatttgactgaaaatattggccacatttttatggtaatatgacctgtccaccagaattgatctaacacattctagagcttagagaaaaatagtgatgacaaagatagacgcagatgcagtcttgtgggacctaagagtttctacagatgtgagttccatgckcactacattttaagtttgacttcactacattatggaaagacatattgtgctctgtgctatttagggtttcactaaatgttggttgttggtgttcagataactcatccagcctggaaggcaatttcattgaaagggtgcacaatgttcttttcagcagaaacatattagatctctgaggggttttgtccagggttagaccttggttttaagatttgaccactccactatattaaataaagagagatgagtcacatgttaataarcatgtcccagcccatacaaaagcaccataattggttgctatttgctgttctaattgaggtagagactgaatgggaataacgtattttttgtgaggcttaggaataactagatttttgttctctgacaaggtggaggtattttatttgggcattcatcctggctcctatctattatttagcagaaatcattatgtgggcaaaaaagaaacatcattctactttactattaagctgacactagtgtctaatggtactaacccaataaattggtgaatattggtttattccatgagaaaagcatctgttgatgttatgaaataaattaactgtgtgtgcccttcatgaggaaacaatgacaaagagttgatacttaatgactccccgttaatgtaaacatctccaatgaactcatctgcctttcmactatggaccttttataatactgtttctattacctataccgtagaccacgtgcaaaagagatgcctgtcacagcaaattattttctatggtgggcaatactgtgttatggttcaaaagtatcggattcctagctgtatttcagacatagctttgaagaaatcaatgtctttcttgcttataggtaatatagaataaaattgtaacatgatgatatattacctttgagagttgtatagttattgtgttataagaaacaactgttttattagaagtcagaagcatagaaggtaaaatgcttacaatgcaaagatgcaaatttatttgcaagtgccttctttgtaatcaaaatgtgctcatattcttacggttgtgttaaatggtaaaataatggtaacaaaattatgcaactctggaagaagtcatagcctcgaccacattattatttaaatattgccatttaacatttcacttcctgttttataatcataaattgttatcaacagaggtaatataatttttgtattaaaattatcagtagtaattattgaataaaattcttcctcttggtatatagtaatagatattgccagtcgaataactctacctcccatttaatggtagccactatgcctaaattctacactatttttcaaaaatatcaattagaaatctatatttctagcaatattaataacagaaatcaacttttaaaccattcaaaagttgtctagacaatttttacctagagaggaagtaagaggcattcttttaatgtccatggagaaataaactctaacttgaaatcttgtattaaaataataaaaattattaagaaattttttccacagatgccataaatggtttagctattttcctaatgtagtttgagtcatttgaaagatggttttacagagttagcaaagccaaatggatactcaggagaagtagcagtgagactttatttaatttaaaattacattgtacaagaaggcttgcacactgaagtggatagacagaagaattgggcaagagttcccctgtgttcttaaaaaaaaaaaaaaaacttgtaggaatttgaatgcagacaaaggtatgattaatttttatgcatcatccatgcaataacaacaacaaccataaaaagaaaaccatgtcagcaatatgcggttgtttaaatgcaaagtatgttaaattacactctggttctctgagccacgaaagccagtctttattttactttatgcttcatggtcagttcttcaagccaattaaaaatccctcagacttttcaaaccatgaactatcaggtccaaaatatgatgcaattttaacttttttataaataataacttcattatgtttctaatagtgattaggaaatactgttgaatatggcacatagcaggacttaatttcaattatcagatattccagccattttctgaacaagaaagagactggcccaggggtctgctgaaacttttcatatctggcaaataattagtgtatactaatttatacagtggtagaatgttaaaatgaacttaaccattctgttcaatgtctaattacattttctattgatgtcagtgttttacctagaagcatttggtactttaaaatagttttgacatttaaaaagtgatatatttcattcttgattatgtgaaatggtgacagtaagaacagcaagttgaagatgaagacacataaagcccaggttgtgcaaaagtaggaaacccaaagcccagagtcactgttaatgtattaagaaattattatcattaatgtcacgtcaaagtgagtttgttaaggataagtctataacctgaagggttgaatgcagaatgcgtgggtgtgataccactagagaaaagtaaaatgagtttcttaaatgtgttgtgtgtgtgtgtgcatttgtgtacaattattatataatcatgaactaataagacaaagtctttcctacacaatgggaagggtacacacataaaatttggtattctgatatgtactcataggtatttttctctttgttatagttaagggattttcctgcacactcatttgtggaggctatgaaaataaaatccatccttagggctattgtgtaagatctataattcacaacttctgatatttttaactcttcaaaggcaaatgacttctggaattcatttcttaggttacagagtaggattgataggtggacaggtatcatgggaggagaaaatgcccagctcaaaagattgaatgagagttggcaataggaccagcacttatttaagcatatgggcctctgagtgaccttgagaattctgaatgactttttacaacatgatgatgacatttgaaatgctttccaagaaatgcataaaacactccattatgtttcgtttaatcttcagatattgtgattacattttgacagaatggtggcaattaattatactaggtcagcaaacatcaccatgtccatcatatacacatgaggaacaagtcagaatttcaacagctctgcagtaagcctggtgtgtttagtgtgagcagcagtattctcctctctctgacagttcttctaataccatagagcaatctcagtgatgaaacatcagtttagtagggaatgaatgagtgttgtttctattctcttatatactttgggatcactcttagaaatcttaggaagactaaaattatgataacagcaataagcatttatawttatgcataaatgcatatacatacttgttataatctcaaataaagaaaagattccatcmaaacacatgattcttctaaattgtacgcacacagtttgagtacctgtaagatatctgcaaatggagttaaatgtaataatttctaayattgtgtttgcctgcgttaggaacatatctcaacagtactgcaatgtagaatagatagtttaaatgagcatttttatctcatcatataatagtgattcagcaaatatgatggttgtgcagagatgtttgagactgaaatcaaaatagagccgtcaatgcatgtaataattttgaggtcacataatgaatttgaaataaaattaatagagaatccttttcttttgatgaggagttaaaatatatataatgaatacttgagtatcagtctgtaattttttttattccccaaagtgattagtagtgagggctataatgtgtgggaatattcaaaatatttatatggccatgcatggtggctcacacctgtaatcccagtgctttgggaggccgaggcaggaggatcacttgaggataggagcttcagatcagcctcggcaatatagtgagamcctgtctctacaaaaaataaaattttaaaatattatccaggtgtggtagtgtgcacctgtagtcctagctatttgggaggctgaggaggatcataggagcacagcacttggaggtgacaatgagccatgatcatgccactgcaccccagtctgggagacatagcaaggccctgtctctaactaaaaaaattgaaaataaaaataaataaataatacactgaagtatttttgtgcagatttatcagatatgtatattattattgctttcactatgaagagagaatttgttggtaataggttagtgtcaaagttgcttctttcagtgactgtcagtccctttccttgccactcccaaaggggtgatgaggtcagatacttccccatgaaccagaatagacagtggggtgacagaaaggttgtcttggaaatagaataagagaaacaaggtggcgggccaagattgggtatcctacatacctcccatagttattttgatctttttatgtgatcattctacacacwctcaggtgatcacaagactgggcaaccatctctctcattgtgtctcttatacacctgcatcaagcaaggtgttcctaagtccttaatattctaaataaatagcactttccaagtatctgcctatttctgtaggattccctcaaggaaattattaatttccttaccatagtcattaattcagcagacattgatttagggtggaatttgcttcaattgctggtatttaaatagtgacctaaatgaaattgttagttttctgtgaatataatcaaggacaccaagttctctggcatttaaaatatttcaattattatccactaagcaagacatctatttgcatatcgtgttgggaaacataggtatctggtatcatgggtccttgtcctgggaaaggtggatcaggtagggaaagaataaggagttttgacatcaagtattcttcttatgtgtcattaggtctgttgtggatctctgagtcctgattttctgtcctgacaaagacatttcctttaagagagtgtcataaaactttaaagaaaggatgtatttaaaagcacttaccccaaaatccacactcaagtgttatgactgtgcagacagccccacatacgcaaatggtgttactgtttcacactgtcttgtcattgacttttgtcagcaagtaacttgggattgtttttttcctccttcaagaaaaggataaaatagkgttatgtataagaaaaaccccatattcttcagtatagaaggttgtttgaaaattctaccattagaaatattgtcatgcttgtgggtaattaggaattatgatatgtattaatgtcttattggaaggattacaatgatatgaataaagttgaagtacatagacccacgttttcttgacgtcagcttttctttgaacactcatgtgtttcggtggctggcatttcagaattgcagtgatattgatagatatggcaaccagcctgtgatgtaattattttagtaaaataaaaacacctcagtagcataagtgtaatttcaaatgttactttatttttgcttctaatcttccactgggaaagtcttttctacgctagcagattatccaaagaaaagcagaatctgttccttgagagccccagccctaggcacggctgacctgactgagcctctgattccaccacctacaagctgtgtgaccataggaggctacttcccttagtggatagtaattgaaatatttgaaatgccagagggcttggtgtccttgattatattcataggcaactaacaatttcatttaggtcactatttaaataccagcaaatgccttggttttctttggttttaaatgatggcttttcaattgtgactattgaatgagttaaaagattaaagtactcagaatgatgccttacacttagcaagggctcttaaaatgttagtagtgatgaagacgacgaggaggaggagagaaaggcgagctaggaaaggggatgagaagaagccagaggcataggttgaagtccctcgcttttgaatcgccttgtttaaacctcccttaaatccattgcagtagaatattacttgataattttatattatttccttgtccagattgtacattgcttaaatgcaagtgactggttgtaggagtttgctaggactgcggtaacaaagtaccgcaaacctggtggcgtaaccaacagaaatggatcatctcagttgtcaaggtcagaagcccgagatcgaggtgtcagcactcttggttccttctgagggctcagggggagaaatctgacccatacttctcccatgctgagtttgctggcaatcttaggcatcccttgactggtagaagcaccatcctgaccttgctgtcatgatcacatggcagatcccacagaactaggtaaatccgcctgtgtgcctgtctctgtctctgtgttcattgtccctctttataaagacaccagacatattggattagggcccactctaatagctcattttaacttaattaaaatgagtgctaagtgtcaagcacggctctgagtactgtcatgtttcaactcactttaaagactctacctctgaacatagttacattcattcatagctactagcagttaggagtttgatgtcttttggggaaacacagttcaatccataatgcgcatcttatttaacttcctatccctcataaatgatatgtaacaccttctgcatctcagagactcaaaaacatgttgaaagaaatgactgaataaatgaaactgttttggttagaaagttgcaagtaaaatatgaagaagggaaaattattctcatgacttctagcatttcagattgagcaaaaatctattgggcaatagttctggatatagaatatatatacacactctatatatcttctctctmtatatatgtattatatgtatattctatatatattctatatatattctattctctatatagaatatatagagaatgtatatatccatttctatatatatagaatatatatgctatatatagaattatataatatataattctagaattctatatatagaatatataattctatatatataatttataagataatttctataatatatatatatatatatatatatatatatatatatatatatgcctttagagacagagtctcgccctgtttcccaggctggagtgtagtggcacgatctcagctcactgcaacctccacctcctaggttagaatgattctcctatctcagcctcccgaggagctgggacaacaggcgcctgccactatgcccggctatttttttttttttttttttttttttgtatttttagtagaggcagggtttcaccatgttggccaggctggtctcgaactcctgacctcaagtgatccacccaccttagcctcccaaagtgctgggattataggtgtgagccagcgtgcctggccagaacacttaaatattatatccacttgagttagaatttattttgcttacattgcatttggataatggattatttgacccttcctcttcttcctgccttcctctccctctctcatatttgcttcttataaatctcatactttttttctttattaaggaaccacatttataaaaaattctaacttgtgtgtttaatttggaatggcctacagatctcagagctttggtggtagccttgtcccacatcttcctttcatgatggtggatatcccagaggagctgaatgagtctcccaagttcactcagttaattagggggagagctggagtttgacctggtgctcatgactcccaggaggaacattttcaggaacttaattgcctctcaacaatgcaggatcaggcatggagttctataccatccataaaggaaagcttggccaaaatacacctaaactatgctcagccatgtatctctctctcatccatttcttttttggatctaggtttatcttgtttaataatcatgtttcctcatatttgtctagatttggtcgcatacgtaagtcatacattttatgtaaatatcattaacgtattcattgaaagatagtatggattctaagtataaacatccggcatcttctacatcagtgcccctgtgcctagagaaggaaagtgtggagaagcttgagttggagaccttcctactttttgtgcacaagcggctgcccatgtttatgaaaattaatggtagacaactagggagttaatgtagtaaaacaaaaatgttcctccatttaaataaaattgtaagcaaacacctcctgattttgttatttgtaagcatttggtttccggtcgcttacggtgattttgtgtcccttccagtcctcagaaaacccccttttcccactctaaatgctgaacatatgtcaggagtcagcagaaactactcaaagctgcaatttgttaaaagtatagatgtgtgaatagatttttccacacacagagacagaaaaattctaactagtggcacatgtcacattcaaataatcagcactacaaaaatgtcctagtttaaaatacaggctggaagaactgagcaaggaaggaagagaggaaaggaggtcagaagatacaaaaaatgagcgagaaagtaaaagaaaaatacaagtccaatacactttttttcatttataccaacattttaattttttcaggtttgcaaagtaaagaaactattaacattcagaagattttttttgtatgagtttctttaaattccaaacagacttttatttttttatttttatatatcttcaaacttacagaaaagttgtaaaaatactgagaataacttctatacccttcatcaagggtcagtaattgtttaatgttttgccacgtttacaaatacttttctctccttgtcttcccctctctctttgggtttatattagtactattttctcaaaccatttgagaattagtttgactattattccagcccagagtgactttcatggttatagtctctctttttctgttatccggtggctggaaaaattacctatagttcctggatttaccaatcatctctaaaacatataacaaatctaaacctcattctcgctgaaggaatgtgtctcccttggcagtcactcatttcttttgcctcctcctttctcttgtttttgatactaaattattacattacacttttttaggtttttggagcttgacattttattaaatagaaatgcaatggaaagacaactggagtaggagtctatagagttatgttgtaattctgatggtatataagattactcttatgttctaattttttttatttcctctttgttcaacctttgggtctctaagaatccatgtattcagtagtatgaaaggtaaaatgcatatcttgacagggttgatgaaaagataaaatggcataatataaatttatgcatattaaatatgcttcatttccttgatttttaaaaaaatataatcctaagcctttcaagaggtataaaatggttgcctccttaaatgaaatatgttaagtttagaatattaatgtagttttctaactgtctaaaccattttaaaatttcttcataaagatgagagttccctgcttgcgttgacaaatagacctgctttcctaccacatttaatactggttgtttccattactctactaaatgcaaggtagactacattttaatcataattttctttctctcagatgtttgtactttacatgctctgttaaacgtttcctgtgattggaaaatgtcttaatgtttttaataggctttaaatttcattggatttcttcagtctgagatcaactgtattctgctttttattatatgggactacattaamgagattcttcttaaggcaaagcctatgatattcttcaataactgtagatttgaagatgtattaacaagaattggagtttctctgaaagggttaaatgtttatttcattcatttcacagagtatggtatgaagtcttcaacagaaacttgrtttccatcaatcaccccaatacttggctaattatcatgtttttgtctatacagacatgcttaatcacaaacatgcacacgatcatgttcataacaaaaagaaagatgcagttgtcttatatttaacattcactagtttactgtctattacatttgttcccatttctgattcagagataaaagagctaagttatacttaatgttagcacctaaaattatcctatagctcatataagagaggcagacagagttgacacagattgagagtctcagtgggctatagctaggagggtgttgataggcattcagctgccttcaatcagaggcagtgatcactgacagtgaccccaggcatataaaactacagtttctttgtaaagatctccagagacagggatagttttactaactttctcmacccagatgagtgtttcttctttatttctaacctaaattctagtactgttttctagggaggtcattttcttttgttctgtctcaaagttggctaggtagaagtgttgaattttagaatggaaaggaacatcataggtcgaatgttttaacttcttcaattgaggtatgaaaaatctgagggttagaaaggatgaggaatttatcgaggacccgcttgaaaaggcagaagagaattcagatttattttccattatactgcatgacttcttctcccaattaattgactatgaaaaatccatctgccagacttggctcctctaagcccttctgtcttcccacataattcttttgtaatgctaattttcattctccactgaatgaactcaatttcgcatacacttttaaagccatgaacttacacttacctggaggcctttagagaggacttggccaggactaaaaacattgatataataaattctgaaacagccactctggctatcttagtatgtagacgtaagttatcatgtagtcatcccatcagggagaaatctgaattttaagatcaacrttggctgtgctgaggtcatcctatgtgcccactcttttcattctccatcttagccacagcatcactgaagaaatcaaggagattaaatttcaacagagaagaggggaacatttaaragtcggcaaaaatgcagtgaaatgagggtgtagtcaatatagactgcacacattccattccagagagtcagtttatgtaactggaaaatgtctgcatttttagtagctcttaatatgctgacatgctaccaagtaattcacaaatttttctggttttctgagtttcataaaggctgatgattttttttttaaaaaaagatggagtaatttttttaatgtagtattccagttaacaaagtgatatgcccataggaaaaaatcacctggagctttgtggtcaaaacatgttttcttttccttttttaaaagatgtttaactccgttcatttcattgatagacattagtatttctttatctgaagcctccactaattattactagttttaaaacttaaactacaatgttaggtatcatggtagcactattaataaattgtatacatttggcaaatacgttagactcaatttctatgaaagtaactgtccactggactttgagtgaacaatgtggcaaaatattggaaatatatagttgcatgttggccagattattggcacttcgaccagatatgttcactatacatatgactatagttatatgcactgagccctgccaccacctaccccctgcaaaggaaagtcatgactcttttctctggaattcaaagctttctgtcaacataatctatgaagccattcattccagtcccactgcccctaatcccactgcatctcaacacaaagaatgacttttcctgttcttgaaacactcctagcatgttacagtacctcatttacgcctctggtgccattctttatttgcttataagcatttgtttacaagtctaagattatctcctgactacccttttatctagtcaccttctctttctgtctcatacttcattttattgtttctgtctctctcagcatgccttcactgtcatatctctgtgttttcctgtctccatgttgtgctttcaccaatagtcccaagtcataatcagtttctgccattgggtattttcaagttaatcattcacctttacatttgcctttgtaaatggccatattagaagtctgttcttttccatgccagcagaaattctccctacccagctgttataattagaggaattgctccccgagttttcatatcagatcagaactgttwtttgttgttttgcaaggtctgcacacataaagagtttttaagcaaaacatttatggtctaggattagaaatgcttcgacatgcaaacgtagactgtgatagctgttgtgacaatttttgaaaaacagcaaatttctaaatatcacctaaaatttaatttttcaggaaattttgcttcaccgatgaaggcgtactgtattattgtctattttctgagttgctgacattacctgacgtttgcaaagtactaacaagggcatggcatggtgatttgtatcttgtaggacaagtccttccaggctgagagttcacatctaaaacagatcttgggaatttattattattctaccaagtaccagagacagtcagctgaaatgaaacattttctggacttaaacccgtccctgtaaattcctacgatgtcaggggacacgggagtgttagttgctggcatttgcagtgtagtcttctagactctgcaccataactctttgctcctagttaaatgttttggatttgccaaggtatgcgtgttcaagcacacacaggtacccccacagaaatttttcctaagcaaatagctgtatgtgatatagggagattatatttttcctgaacgtcaatggaaatgtacactatgtatgtaatgattatattttatcactgaatatttgggaaatataaaatgggaaaagtgcactgcccatgctaagtccagagtatcatatattataaaatcggtggttctgttctgcaagggatgagagggtaaaaagaaaataaaaagaagctcagccatactgtaagagagctgtaaaatagaattaaatatggttaaataaaatgctaaattctgtaattatatggttattatgataaacgggctttaaatatatgttcttcattagccagggcttcaaagctgaaagatttctatggaaggtgatgctcttatgcacagtcttgaagtcagtttcaaggaatggtgtcttgtgaggttgagagtgcaacaaacatgttttcaaacagtgatctctgtataagtagtataatctcaaaaatcactgattatactacttttccatgtatctggtcttcctggttttagtaaatcccccaattgttagcaatacaaagatgtatttttcatgattttaagactgttgcattttagaggcttcagtttgtgtcctgatatttgtggcaataaatagaagacacacacacaaaaaggctttttgtagttgaaagggcttatatctttgaaactaactctgtcctttaacacatttcatttaaataatcactttctatcttgtccacagaaggtctttacaatatgacactatggattaattttaggtctcctattagggttctttctttctcacaacaatttaaaaatgaaagatatagataactaacagtatttgttctatttgtaggtctcatgttcttactgtaaatcccacagagtttgacagagctctctttacatgcatttcactgtctttcaatatgctcacctccctgtctccccaagccacaattcatggattcactgtcaggaaaatttctattcattgaccatagattaggagaaagtccacgttcactgatccccctgaagcagatgtagttattatttcttcctagtccctatatctagttacgtaatccttgtgttccttatgatatcataaggatttgtttatgttgccatctttttcctataactagagttaactactcaagttaagtatatatttcaattttgaaagtagcatcatattatgcataagttactcaaagtcaaccatacatatggacttgaaatacttacgaataaatggtggcagaacatctgagcatgtgcccagagtgagcatcaatgggaggcattggcctgccccccactgtcagactcagctctgtggatcccttatgctataagcatctctacacagtgactacactttgctgtacagtagatgtagcaatatgaaattgtaatacacatcgccccctaaatgcatgtctcctacttcttctgaaatacagtgaggtaggggcaggggttgattggtttaatgctagaggaaaaaytagatctgttacctgtgttaaaatgatacattaatcttcaaaaaattcataggtttaagaagtgctcaagaatacttttgatacatttaacttctgccttgcttgctaattttagaactyggtcacccctaattagagatgcaactgtattatacacccagccacactacaggtgcttaatacatatttgttgttgaaagcctcaatcgtgtgtatgtttccgtatagacgaacagtcgttaggatgatcgtttgtccgagtttggccaggacacttctgcttcacacaagttgttccagtgtaaatattaatagcaccctcttttatcctcaaaggtgtcccagcttggaggataaattatatagtcaccctagttatagtgatatttgaagtaatttttgtaagtaatttggggattggcatgcatgatgtaatagaaacaaacaatgcttcaggcaaaagactaaaaccatgatgaaacatgcttagtgatgctccttgctctccgagtcatgctggtcagatctgctggcctcacgtctgttctctccctctcctcaactgtcttctttcctgttactattactatttgcactaaaataagactctttctacagtccttttgttttctcagagtagtttgaacattcctacccaggcgtccagtagcacataccctttggcttcctgaacatagtcctcacatgtattcaccaatcctcttccttttctgggtctgaatttgacctgttgaagccataagcactcctgcccttgtgggcttctgtgttgaagaggatctttatttttccatttgccatttgtaaaactaatattgtacaggtaataacaccgacaagtgaagcttgaccttataaaaaggactgctaatgtgctgaagggaggaaagtcctagatgggttattaaggtaaagagagcagaggaaaagagaagaggcacaaagatgaaatgaggatgtgatagcaacctctgacgcctgttttctgagggcagagaagaatactggaaaaaggacaaaagaaatttggcaccatatggagcttaattgctttttttctrttacctgtatctaaaatacttcagcaaagattagctataagcctaaaaccacaccaaatgagcaataaattctatagctcagtgaccatgaatagatcataacgttgccaaagaaaatttaaaatattttaaaactgaatacatttaattatatgcaaatgagtcatatcctgcagggtaattaggtggttcacataaatgattatactgagtgagtattcttttcacgtgcagaaaaggtgagctcctggggactgctatagaaaaggtgggaggggtgaggaatgctgaaagaagcagaaagtcttgcatttgtaattcagggacacagatgatcaaaacactgggccagcagaaaatctgaggcatgattcaaagagaacactgacaacaagacagtttgtgtgtcctacagaaagacgagtcctaggaacctggccaccaagcaactactataaggtcaagcattgatttcctagtgactgttaccattccgatgttcaatcaatgctggcaactgctttctacctctgaacacttttcttgctagtcttaggttttatgacttctgaratatgagactgaatttgtttgagtttactataatgggattttgcattatgtatgctcagtagtaaataatatgtatgcttaatagtaaattattttgggaaaatgtctattattgctacaatttaacttaggctaactcaaagtttctttgacttgctaagcagtttagatactggaaaaaaaatcagcacagatctttgacctggaacccagtataagagtatatagagattacttttttcagttcaatcggtggccagttgggtgatttcctggtaaaccactatccccttatgccatgtttacagtgtattcggggtggataacataatgcaatgagaaaaaaataataaagtraggaatttaaatagctttttaatttttatctccttattgtatatgccacttaagttttttttaaatcaaaggagaactactaccattgaaagaagtattaattttcatcccaaataccaaggggacaccaaacttggacttccctgatttcataggttccttacaggaaaacataattaatccattatatttaccaaggaggacttttccacttaagctccacacttgagattgtaaatttcccacacttgacagcgtaaactcctcattacaaggagacctagaggataattgccccgataatggcatctttgtaccagtttatgtagacataaaaygtttaaaactactgaactcagttagactatttattatccattgtaaaaacacatattcttgattttctctaaatataaataggtttgaatagttaagattatgataagaaaaaagcatgccattttaggggaaagggctctgttatgtgtgcatgctgacctatgtgttgcaacaatttggttgatatacatgcacaaaatagtacatttacaacactgcatgaatgatttaaatgtaggtagcaatgcctttgacttcaatccatgatttcttacagtattatttcaataccattcttctgaataccttttaactatcaatttataaatatgagtcttgtagctatcaaagttatataatagagccagtcaaatttctataaattatatattaataattatattagtgaataagagttattgtatatgcatcactgagggaaataaaataacagacactaaatatatctgttttaagtaactgagaaataagaaaaagttgtcttcaaataataaaataagctatgagaaattagggattggtttttcataacgtattttaaatggggggaaataacaaatataaaatggccacaataatttctgtgaatttcatagaagaatagggcagaataactgaaaactagtttataatttaaaacaaatttagaatccttttaaaataaacatactcagtattttctttataacagcatatttgaaatatcatcaggtgtccactttacattggaattaattgaactggtatttacatttccaagtagttatttctcatttgccaagaagagattgaggcttggttttccttcaataatatcttcattgggcattaaatcacaagtatttattaaactgctggagttaaagggacacaaaaacagatcagccattcttcccgagtgaaattgattttattttctcctagctcggttctcctagctcagagagtaggttctagccttatttctgyaggcagaaagatccttggagtgaagatagacttctaatttggttttcaaagcatagagcatacattacattttcttcattttgagtctgtacacatgatgtgatgatcgtcaaaatgatgtaccgttaacctatggctttctttaatattccattaactataattcaatttcagcaacaaaaagagcagttgggaaaacaccatagacataatcaataaggaaactctgtatttgaattacgatacctcattttccatgatgtggttataatgcattgcatgcctgtatcaaaacatcycctgtactccataaatatatacatctactatttacccacaaaaattacaaatcaaaaaatacatatatatgttttctgaggctatcctaaacctcccttccagttttctgtggcctgtattaagccaggagcactggtattactttttcatgagagtcataattggcccaaacccaatctgtctttctatttctaaatgtcgccttcaagtactaaattctatttttccttaaagttaaaatccaagacttttctcaggatcacatttgtatgtctataaattagacttcacatgggccatgattgctagaaggaatcaaagagaccctaactttgcattcaacttaaaattaataaaaggttttgaatagagtatattaaaattgcatgtttcatcagacatggaacagtgcggtgaaatgggtgttaaaattattaggttctagaaattagtagagacacaccatttgtattatcacatctttcatgttaatttaaagaaggagagttcagccttgactacaccttgggtgacttttaaattatattgatgcctatgaatctaatataatggtttgggaaagggtctgggcatctgtgtcaataattttgaaacctcgcttgatatttgtaagagataccctggcttcctctacttatagctctaaaagcagacaaaaacgtgtctgaaaagaagtggaaaatacaagcttctgcctcattgattactgctgtccattggaatttttgcttggcacaaattgtttatcaactttttcattatttaggagttttaattaggtataacttatttgcattagttgcttctcttgaagaacctttgttttttcctgagttagctgcctagttcaaggtcatattacagcaatgtttatttacatgaggattttgttttcggtctacttgacacagtgccagaacttcttgcttatttatgttagatccttataagaacaggagggtaaaaagtacatttactttagaagagttcttatgaaggttatgtgattaccaagtgaccaaaattccttgcataagcactcatttctaccagcaattctctttcaaatataaattttaatatttggatagtgactcccatgcatattttggctttaggatgaatcactgtgcctggagcaaaatctttgtcaaggatggagccaagcatcccaaagagtggctgggaatcacaggggagcccgctgtctccatgtcacctcttaggggaataacaggacatcacagaacgaaaccgagggctgcaggaagttgcagggtcacagatgagactttttaaaaatatatatatatgaacagggttaagaagaagtccctattgaggactgtatatgtcaaggttctctagagggataaaactaataggacaggtgtatacataaaggggagtttagaaatattaagcaatattgactcatatgatcacaaggtgaggtcccacaataggccttctgcaagctgaggagcaaggaagccagtccgaatcccaaagctgaagaacttggagtccgatattctagggcaggaagcatccagcaccatgggagaaggacacaggccggaagactaagccagtctagtctctccacgttcttctgcctgcttttattctggctgcactggccactgattagatagtgcccacccagattgagggtgggtctgcattcccagtccactgactcaaatgttaatctcttttggcaacaccctcacagacacacccaggagcactactttgcatccttcaatccaatcaagttgacacaatattaaccatcgcaaggacaatcagaatatatttcaggataaattgaaaattgtgaaagtgattatcgttagattattttaaggaagtttgacttaggagtttgttagccatggccccaggtatataggttgagggacctcagagtttataaagttgtctttcttaaaagaagaatttctcaaagatcaatataaaagcctttaaaacatcattgttgttagatatacgtttcatatacaaatgccctaagggcatttgtgatgatagccatcatttattcagcacattacgcaacaagcttgattgtaaggttttccacacattctctcattttattctcacaacaaaccttatcttttcaagagtctgagacttaaggtagcaattccctagagttcacacaagtaataactggcatagcagagctcacatttaaactcagatacacctacatttttttagttaggccagaagtggcaaatcggacagataatgagaaaataactagagaatattaaaatgtagatagccattctaacaaaacatgaccaagatggcacacaaatacacacacacaaacacacatacacacacacacacatatagtaccagctcagtcacacttgaaaaattcaaaataaaaatattagcaactaactccagtgtttcattagataatgaacacgacatgcctaagtaggatttattcttcacgtagtttagcccaacattatactaaaaacatgaaggagaaagttcctctcattatattcatagatgctaaaagaaagtctaataaacttcagctatcaattctaattaaaaaattgtgggtgaattgaaatatgagctctataaacatgaactatttatacaaaaatcatcattacatattacattaactataaaatgcaaattccagtggcatcaaaatggtgaactaattaggcatgatttctcttctgccagctctcaaaaatctcttgctggttctacttaatgcaataggacaataaaataaaataatcataaatactagaaattaaagttttaattgtatatgatactgtcatacacttggaaaagatcaaatccttaacaataactaggaactaataaggtatatgaatacaagataaatacgtgcaaaatatgtattttttataatttagtttgccaaacaagttagatatacgaggatgaatttataaatcagccttattattcttcttctactccacttccagttggctctacaaactaattactgactccttcggttgttacctcaggtaggtcctcactttttgtgcttgttcagtcacaaaaacttcctgacatttaaaattctggtccagtatagcactaaattccaaattcttattgcaactaaaacatctttatttatctaatttgggcctatctagttattgctgagaaacctgtaataactagttgctattttggagggaggaaaatgagagcatacagtcaggtagaatcttatttgtcttagagcagtcataagagccttttgttcttggcagatgcacatttaccagcttgttctcttgttctctccagttccctcactggagacttcaaattgctcagtcttttacaagcaaagtgctaataccacagtcatgttctgacttactgtcagtcacctcagattagagtaattactgcctgttttagaaacatatcactgcaccaggtcactattctgctgcttatcactattatggattctgcatctggtctatgcaaaccccccatttttaaaagtacaactggctcccaacacagccctctctctcttttgcattgtacttccaggcagcctgtagcctttagatttcttccagcaacagtcagaccccattgctgtggctgtttaatatccaggaacatatcttaagctttctcaagttttcttgaaatcttgtttcctgcttgactttaaagtaagggaggcacatccacttattcccatgatggcaggagtgggtagccgcaagcacagtgccctaaccattctctccagagacctccatcttgccagtgtctccactttactcacagagcttattgtgtatttgagcagagctggtttctcagaccctccacatgtcctgtttaggggggttagcactgcacgttaggacttgggaccacgctgtgcctattttacccttgatattcggctacagctaaaatcatatcaaaaaaagtcatatcgattaccctgctatattggcaataacaagatatagtcgaccaataaaattggaaaaatataagagcaagacactgcaaacggcatataaacatattcagggaaawgaaaactaaaacaacaataagataacttgatttttgtccttgaggtaggcaaaaattagcaattgaaaaaatgtgcaactgtccagtttcatcaagtttgtgagaaattggatattgaaaaagggaaatataaatcaatctctctctttccctctctctctctctatttcagtctctctctcacacacacacccacatacacaacsttgaaaggctgtgcagaagcagcactattactttatcttcaaaggttatttccaactccaatgtatcaatctaaagagtaaatttgaaaccttgttttgaaataataagagaagttgaatgtagatttatcataaatgattttaaatgcagtgctatcctttgtcatgatttacaaattctttctcttatttccagatatccataggccatcatagttaacctctgtttctccctgtgaaccaacaacaaatatgttatgtctagtccatgtgtggcctgtaaatataagtaatatttacagaatttgctttgacttggttaagattagtaagaaacttatggtaccagaacatcttaaccagaatacttaggaccctaacactgtattcctcatttataactcttgtgctggttaaatatgaactctcattcatatacatttatttgttgtttatcaccattgacatctaggaggttttgagtgactaagtaccttcaccaatctgtttcccaacctttttttctggattgttctgtaacggaaaggaagaattatgtcccaaatgattgtcctgttgagaatggagatttaaatgtattcagttctttttccaggtctccctttgaaatcctgttttagaatgatactcagccttcttatttcctgttgaaaataataacacatactacctgccacttagcacatataagtgggtgtttggaagaatcttttgactgaatttaatgaaactgctgaattaagtaaaagcttgtatctttttctcaggtagtgactctctgtagctatggaccaccacatatttgccatccctttgctgatggtttgatttggaatgtgtcatttcgtttgtgaaatgagacatagtcaaggtacccatgtgctcaagtgcttagattacaacaatgttttgatgcaaatgtgcaaagtactcagagatcaacactatggtctaataacaggccatagcaaaatagagcaaatgaatcctgtgaaatcagagagaatgcatcaaataaagatgtactacctaaagtgcaaaatctactaggagcactttgacatttcagttcaagttctacagtgtttcacattttttcartctctattgtagtctcacttggaggtgattgcttgatcactagaggaatatgatattattcgtttcagaaatgaagcagctatggtgttctcttgtgaatagcactagatatgaattaggattatgatcttgtttgtgtagaatgtttcattacatttcagatatttgtgtcaggatataacaaagtgcattcatcagcttaggaggtttgctaacttcagcattcaacgtaagtttagttgccccaagtctacaattaaacagcaagacacaacgacaggctttgaattttaatggaaattggcaagatgctgaatagcaatgaaaccagtggggatgaagaattacttgcaaatttgaactgtgtgcaaactagccaacatcaagcaaatagtctttatgatttctatatatgtatgtacatacatatatacacacatatgcatatgtatacacacacctatctgtctgtatatatgtatatacacacagagcagtatttctatatagtcctttaaaaaatgtaggcatcttgtgtctttgcacaacttgaaagggattgtcttctcattgtctagttataaattaaacttgtagaccttatttttttgtctgaagaacaagaaccctatttcctcaactccgtatccccaagcattgaatagtttatgcccataacaactattcagtcaacgctgttgaaaatatgtcttaactgagaatccactccttttccttcacaagctcaaaagcacatacaaaagagcaatgaggctgataaatctgacttttcagaggcatttatcagacagaaacttcccattctgaaaagtatttgtgtatcagaatagttcagactcatggctacactgatcctttaaaagcaaataagctcttaatgccatacctgtttagaaaggtgcagaatggggtatgcactgcatggagagaccctacctcctacccaccctggcctgacatgagtgataggaaaaagtggaaaccttctcagccctgggctacccatgctagacctctgattccagggcggtgaactactgcttttcctcgtgtgtggtttctttctggtgtgatgtcaaagagatccggcaaacaaaagtaaattcatttacagacaattgactagaatttgtgagaaaaccacagaagaatggcaaccctggtagttctttttaaacatatagattccaaactctttcatgaataactcaattgcttctttttatcttaattttgtgatataaactcatcccacactactcctaaaacctttctcgagaattcttatgtctttctatctcattactcttcatttaaaagttcatgtccttttcactcttcaatatcattatcatggagcagtggtcccactgccagggtacatgaaagcggggtagggagggataatttcagtctcagctgctaccttcattctacttgcttttacttccactccgttcttgggttctctcaattcttggggttgaaaatgccaaccatgctgcaggtcatcgtgtcttgtctcctcctctatcaagtccagctgatctctacaatttcttcagaagtgaccaactcaagcttcttcttcctagatttaatgacgttccttccctttaaatatctgagttccccaccttttcaatacttccagtgtgagtttcctgtggctgcggtaaccaattaccacaaaattcatggcttaaaacagcagacactgatgctcacacattgatgcttctccaggccagaggtcagagatcagtttcagtctgttcaaatcaagctgctagctgggccgtgctctctctggagcacttagagaataatctcttcctttcctttcctggtttccggtggtttccagcatcccttggcctgtggacacatcactcaatctctgcctctgtggtcacagtgccttctcttctgcgtatatcggatctccctctgcctttcttacgaggagacatatgtgatggaacttaatctttacccagatgataaaggataatctcccaatgccaagatccttaacttaattgtatctgcaaaacttttttttctaataacgtaatctttactggttccagggattaagacctgatatatttggtggccattattcattctactttaaatcccaatcacacactatcacgcccaatattggcagcttatttctaccaatccttctccatcagcactgacatgctctctgtttctctgcaaccttagattttactctagcacagaacagttgtgcctatttgagcttgacagcagaatgcattgataattggtcttattttaagccaggaattgatctatcaactttctagctcattgacaggtgaattgaggcaaagatctatgcagagtctggtacagtagaaaagtaaatgcttactaaatgagtgaataatgaattctcaaatttagaaaattcttgagacaacaaagccattttgtctctcctggggaaattcactttccaatggtctaggattgcaattcggtctcagagctacagaatcttcctgaatgtatgttgcagtgtttttgaatccagagttactgctagtgcctgggttttccacaacaggaaatattcatgaagcgtatgatagaagatgaaattgaatggaatatcctataactctctgatgaaaattcaatagtaactaacaggttgggtatggtggctcatgcctataatttcagcactttgggaggccaaggtgggaggattgtttgaggccaggagtgcaagaccagcctggccaacgtaaataaataaataaataaataaataaataaataaataaatagtaactaacatatgtaatacttattagacgtctggtacttttctaagtgcctgacatgtttcatttcattctcaaaaaatcatatgggatggtagggtaggcaaaataatgtctcccaccaaaatgttcacattggaaaggcaaaatgtaccctattactgttaccttacatggcaaaagagatacagcatatgtaattaaattaacgaccttgagatgagattagcctgaattatgcaggtggaccagatataatcacaagattacttaaaagtagaagagagaagcagaagaggatcggagtgatgaaatggtatttggctgccatttctggctttagagatgaagagaggagccacaagccaaggaatgcaggcagcctctagagctggaaaggtgaaaaggtagattctctccctagagccaccaaaatggaacataagtctgccaacaccttgattttagccagtgagacccttgatagacttctcatctgcaaaactgtaagatgaaattgtgttgctttaggcccctaagcttatgttacaatgctaacaggagttaatataggaaaaatttgaaaatttagaaatttcctaaaaattaggaaaatgagtcacagagagagaaagtgacttacttaggatcaaagggctagaaggtggtagaagcagagttcaaatacacgaaattcgcctcttgaggtaatgttctcaacctcacgttaatttgcatctcagcccatgtacaaccggtaactaaatttatttcctgaatttagtccttcttgtctcatactggaaacatttgctgcagctgtaaaattccagcctgccagggacctgtacttcccagggcacttggcaaatgatagaacatctggtgctgctgacataaactctgtgcttttccttctttctatccttcatcacaacaatttctctattatcactgcctcctctcccaggcccaggataactgtaagagcctcttccaagatgatgatgatgacgtggagaaaaaaatcaaatggttgctactagacttctctagagctacaagtatgctttcccaggtttctgctgcagccactgtttcatttaaagcactgcaactctattcagtaggcagggatggttcctgttacatacattttacatgcaagataactaatacttcaggagattcagtcgcctgcctaaggtctcccagggagtaagtggtgggaataatggccatccctattctcacccagtgcctgtgccacaatgaaaaggacaaaggttttgaagcctatgattctaagtcataatacccagaaacatcacttaaaaattgtgagcctcattttcagaacctgaaaaatggaggtgaagagcccacctcatatatttgctatgaggactaaacagaatagtgggctgaaaagtttgcctcactgtgaaaattactggaatgctaatagagttttgaaatcttaacccctagtgaatcaagagtctactgtgagtccctgatggggtcattcaaccaaggcagttatttctgaaattcttccaactctrgcagatcctggtatttactttagccctgggtcatcagttttcctaatgaaccacattttttttttatgatgacgatgctggaaatgggttttaaatagggtaaattcttatttgttctcaatacctccggaatagctgaagagtgaacactttaaagactgattggcartgctgactggctagtgtattcttaggtggtacaaaagcagtataattcactactttttaaccactattaaaactcctgttttcaggctttcaatgtttgtgatttatacaatttttattctcttattatggttgcttcttctttgtaaattaaactcaggagaaacctgtaataacacattatgatactgcacagaactgatttcacacagattcaaagctaatattaccctgctctttgacatctgcatctttaaaggtgcttcttccacagggatgtctaataaccagaatagctgtgagctagctggtttctttcccaactttatgtatgctttctgtaaagacttttggatgagaataatattattccttgactttgctttttctttattcctggatgtcagtgcttacctgcaattagatctatctcccagcccagggataaatagcaaaaacttgaatttggaaacaccagaaacacagcagttacagaccccgaggggcagaaaccacaaatgaatttccctgacctttactttgtttgctatcagcagtctctaacacctagtatgatattggtaatgagtttctagtgagaagacaggaaaggtgtgagggaactacggtggaactagttctctttgccttccattcctgagtacatatataaaaataaatgcaaccacagcacatcagtagacttttaaaaatacatgtcccttcttttttaaagcaagagatatttttatctcaacccagcatggataatcggaataaaattagagcatgtatggaattgaattaacctgtggattaaactcatccatttgggagatcatggttattactgatttaatctaaacatcagtgctagccgtgtgsatatgtggaactcagtgctgtatgaatgsgaagaatacaggatgccttttcagtcttcaatttggaaacttcatcatgataacactgattatcaggtaaactcaaacagtacaagacatgctttctctcatcttgcaaaaaaaaaaaaaagtcttttatttttaaagtatttgaaatagttctatcaattgtttgacaattaatgattatcatktggtcatagaaacagttaccagggacgagtatgttcattttaagtgacttggaggcaggatccagtgtgcatattcaattctcgatgagcagtcttacagaaatgattttcctgcactttgcttgacttagtcatgtagacaaaacttattggcattttggacatattggcgtctgcarattgacttgtaataggtagttcaactattgcattacaagaactgcaaatcatctattcgtggctgttgttctttttaaaagagtcagaacaatatctgtatgtgatatatgtgtgtgtgtatgcatatttaagatatatatgtgtgttttatttgtaatgtataaattatttatttgaatgacttgggagattaaagtagtagatttcataataattcagacatgattttgaaatttatatcctgacatgcctaaagtgagcataccagtataccacacttttttctttctttttttttttttttagaaattagccacatttgatttgaagacgatttgcttaaattcacctctaatgatttaggttaatgactctgagtacttgaagatgtcttatggtaataaagatctatgttggcatgattcaattaatgaaactaaagtgaaactctgtgctttggttttacttaagttagcagtaattattaatgtaatgtttcataattgtggtttccatgaatagtctgaatctcatagacaatctgggttataaaaaaagcctaggttaaaaaatgttgttttcattgtcaaatatttctttataataaaccacaaaaataattgaagtaatgaattttagcacatactttcacaggtattttatatatatcttatgaatagccttactctttcttgaagtaaataagtataaaaagcatttataaagaaatgtataaaaaataaatcttagatggttttaaataaggatgatacactatactttaaaatacaaatataaaaactcacatttattttggaataccaaacaactggaacagttggaggttgatataacattttattatccttacactacttaacaagttaatatttggcaatatactacctctggtaactattttgtcaataacaccaagctatgtgcattgtaaatataaagaaggttatttacaccaagctatctgcattttaaatgtaaaggttattttctagtgctatacaaaatccattttaaaattatgacatctactgtctaaacattaactctctaaaagtttgcatttaaaaatgaaatttctatgtatgattatattatgtattaacaaaaatagaaatttctttctcttctagctggaagctgtcatgttcttaagaatgtaaattaccataaaagtgtatccttttatttcctacaaagtaagatttactgttttaataaatgttcacaagattatgttacctctgtacctatagtgtctttatctagtagttattgctgtgactaccgaggcaattggttatttcataagctaaatattttgaagtcctacatgtcagaaaagccacagtgagcactactctgcattgctcaattcaattctcaatacattagaattatacatattgtaaaaatatttgcagacgtctgttaaataaaaattccatacttaatttttaaatgtaagctaaatttagagtaatttaaaatttttagtgatatcaattatccagctcatttatctggcatcaaattatgtacaccattttaggtacaactactaattaatagattttactatataagaatataagacatttctatttattttaattagaaacaaatctaagatggtgctgtgtactttccattccacatactacatttttacgaaaagcaaattgagagctttgggatatgggaagtttgaggtgatgaattctctgaagtcaatattaattgaccaatacaatttgagatttaactgggatagctatttcattggttatttgtgtctgatcggtctactcaaaatttgattaatgtcaatgtgrgtatttagtgataggttgagacaagtgaatcaaattatcctcagactcataaatttctgtagaatgtgcctcaggataaagctttattgctaggtgtttctgtgtatcggggacggggggaggttagtgaaatggtatttaaatatggaaacattgagagaatggtagaaaaaagactaaaagatgaatatatttatggctgcatgttttaacggtgagaaagaaaattctcgtttttgaaatgcatmatttctattctacttcccttccaaaggcaatagaggcttaaaatgatagataaaagttacacagatatgcatttgtatataaactgaattataatttggtaaacaggatgtgtcttacaaatatatgataaaaacattgcataacagattgacatggtcttataaaccaatgttagaggactccttgtattatcttttagggatatatgtgatttgattcttattttcaaaaactttatatcaggaaatatcaaattcaacccccttacaatcctcatgggatacttctaatgttatttatgtcttgggtggaactgtctcaagttaagtgcatgaccaccttacaaatagcttgagacacttgaatctcaatgtattttaatagcccctgccccatctactttaggttttgtaaataatggataaatatttatttagattttattttttatttgatacataatgcattctaatgatatttacacctcaaaatctgattcagtatgcatgctttatatctgagtggacttttctgtaacgctaactatagtgatgagtattataccatactatctggtaagataggaggtatcacagtctattctagatttcttaataatcggcaaagattgaaaatgtagagataaaattaatggtattttcttatagccctcctatttcaagaatagcactttagtaaaagttacagactcaggattgtgttgaaatccatgagtaataggaagaaacaaaccatttcttctcttagtatactctcaagaatctttacttctgatgccagatgtgattttcttcacacacttcaactctccattggatacmaacgggagtcctatgattcaattcaattcagacactatctgcctggagttagtgtcagatctcacaggttaagggttcagtcccacaagactccctcccactttagatgctaattggaagtcctggcctctggaactgctgaccgaccagctgtaaattgtggcttcccacctcttcctcaggttccatcagttgctagagtggtttacagaactcagggaaatgctttactaccaatggccgatttattacaaaggacatatgaaaggatacaaatgaaagccaaatgaagagatacataaggtgaggttcagaaggcatccaagtgcaggagcttctgtccctgtggagctggggcagctaccctcctggcaaggggatgtattyagcaacccggaagctctccaaaccttgtccttttaagttttcatggaggcttcatttagtaggcatgattgattaaaatyattggtgatcaacttaaccttcagcccctctcctcagttggaggttaggaatgaggccgaaagctggaatcctcaaatcacgtggtcggttcctctggcaaccagctcccatcctaagactattcaggaggtttcagccatcagtcatctcaaatgcacataaaaagacattattttgtagatttcaagggttttaggagctgtgtgccaggaagcctggactaagaccaaatattttttaatcaaaaatcatatctcaattcttcattttagttttaataccaaatatttatttaccttagatgaaaatggcatagtaatttaaaaaatcaaacaaaaatagagacatcatctcaagaaaggagagaaaacgaagaagtaatcartgcagagtctatggctgagcaagctggtgaaaaaacttacagaagaagtgtgattaacaagcwcagagaaccccaagaatggtaagcgtgcacgcgcgcacacacacaaagtaaatataagcccatcatattcaaacggttgaaaaccaagcaaataacaatgtctaaaggcarccaaaaaattgcaaggaatgaacaataaaatttaagctgaccttctagtagaaagtatgaatcctgaagaaaaaaagaaagtaatcattaaagtgttaaaaaaaagaagtcagtctataattctataacaagcaaaagcatccctcacaatttaattttaagtactttggacaaataatatctgagtgaattcttcactagcaactcactacaaggtatactattaggaaattgttcaaaataaaataaattcatcatcaaatgtaagcatataacagaacatagaattatgtagaataccagatattttaaatgtgtgcataaatattataattgattattgattaagaaaaataacagtaacaatgccatataggatttttaatatatttctgaaaattatwtatactaaatatagatactattttatatatataaaagatatatgtacatataatatgtatctttatagatactatacatagtatatcttgtataagatatctttataaatatataatgataggctgggtgcagtggctcacgcctgtaatcccagcagtttgggaggccgaggcaggtggatcacctcaggtcgggagttcgagaccagcctgaccaacatggagaaaccccgtctctactaaaaatacaaagttagctgggcatagtggtgcatgcctgtaatcccagctactggggaggctgaggcaggagaatcgcttgaacctgggaggcggtggttgtggtgagccgagatcgcgccattgcactccagcctgggcaacaagagcaaaactccatctcaaaacaaacaaatatataaagatatatgtgtatatatgaatatatacaaaatatatattatatatacaaaacatgtatttataatatatataaaatatactattttttgtatgtatatacatatacagagagagagagagtagaataatagcacgaagaacagctcctttgaaaacaatctgtcaattcctcaattaaacatagaattgccatatgacccagcaattcaactcctagacttttacccaaagaaatgcaaacataaatccacacaaatacttgtattcaaacgtttatagcagctttactcataatagccaaaaggtaaaaacaacacaaatatccatgaaaggatgaatgtatacacaaaattagcatattcatacaatggaatatcatctagccataaaaaggaatgaaattttggcatatgctacattatactaagtgaaataatcctgcacagaaacccaaatatcatatgttgtcacacatgtgtgggagcttaaaaaaaaatctaatgtgggtggaaagtagaatgatggttaccagtggctgggaaagatagttgtggacagaaggatgaagagagattagttaatagatacaaaaatgtagttaagtagtgggatttagacctagttttcagtatcacaatatggtgactatacttaaaataatttattgtatactttaaaataactagaagagtggatttgaaatgttcccaacacaaagaaatgatgaatgtttgaggtcatgaatattccaattggccctgatttgatcgttacacaatgcatgctcatatcaaaatatcatatgtactccataaatatgtacaaacatgccatagtcatgaattggaagactcaatactgttaagatgttatatctcttcaaattaatctaaagatttattaggatccatgtcaraatcccagcaggtttttttttttttggtagaaatttacaagctgattttaaaatttatatggaaatgtcaatgttattgaagaaacaatttgaagtactcacactaacagatctcaagatttactaagagccratgtcacaataagacagtttgtgcttttggtacaagtataggaaaatttaatattggaatagactagtatattttcctgaattatggtaaagtctccactgcaattcagtgggtgtggaatggccttttccataaaaaggtgcttaatcaatagcatatctatttcagaaagaagggagtgggagccataatccctaccacctattatatgtacatacagatttgaagtaggaacttaaatgcaaaaagtaaggcaaagaaaaggtttctaaaagacaacacaaatgactatctcaatgatcagagagtagacacagttttcctacagtatgttaaaagcactattcacttaaaaaaataagtgatcaactgaactttcttaaaattcagaactgttccttacaagacagcattatgagagtgaaaagatgatatctgcagttcttatatctgacaaagaactcatgcccagaatatttaaagtattcttatgaaacaagaaacaagactgacaaattacttaaaaatgggcaaataaattgaaacagcacttcacaaaagaagatacacagatagccaagaaatttatgaaaaggtgctcagcatcattactcattaaaataccacaaactgataccattagactcccaccagaattgctaaaattaacatggctgagaatactgaatgctggtagtgttgtagaacagaaagaactctcatatacggctattggcatgtcagttgctataaccatttgggaaaacattttggcaaaatctactaacgttaaacatatttacacattcaaacatagcatgtccactcctgggtatatagtcaagagagacaaatgtttctactaaaagttcatgtacaaataatcttaataacagcattatgaataatggcccccaaaccggaacaaatgaaatttccatcagtagtagaatggataaataaattacaacatattcataacacagaatactacacagcagtgaaagtaacacactattgatacacacaagaactcagatggatctcacagacataaaarggagaaaaagaaaccagacacaaaagaataaatgctgcacgatcaatatgtgtgaaatttttaaaaagagcaaaatttgggccgggcgcagtggctcacgcctgtaatcccagcactttgggaggccgaggcgggtggatcacgaggtcaggagatcgagaacatcctggctgacacggtgaaaccctgtctctactaaaaatacaaaaaattagcccggcgtggtggcgggcgcctgtagtcccagctacttgggaggctgaggcaggagaatggcgtgaaccccggggggcggagcctgcagtgagccgagatcgcgccactgcactccagcctgggcgacagcgagactctgtctcaaaaaaaaaaaaagcaaaatctaatcttctatgatagaagtcagaatagtagttacctctcgggggagactgtggactaaaaagaagcacaagtgaatctccagtgctaaaaatgttctatttattgatctggtatctgtgtgtgtggtgtgtgtgtgtgtgtggtgtgtgtgtgtgtgtggtgtgtgtgtgtactgtagctgtagctataagcttaatacttgggcagtttaatatgtgtaagttatacttcactaaagcagaaaaaagggggtataatcatagcctaagaaagcactttcaaagtagcttttcacaattccccttgcatagccatagatactatctacataaatgaatatatatgtaattgtattttgataagcttttatatgagaaacatgatattgctttaattcaaattaactttccttcttaaatgttaattatgactttgctgcacacgttcaacccagaaacacaacctgaatgtaaaggctagtcttcatcttggatatgttcattttagtctgatttcacaattttaattttgttatcagccaacgtttattttattttaatctgttttccatgattcttaattgcaaaattattaaaattatataggactaatctgttcactattggtgatatgcataaagaaatcttgctttaagtagcatatctgctgaaaaactgtttttttttctttatacaatctcattacagaacacagcatcatttattgccataatatgttttgtcaaacatcagaaacatttggttcattgatatattgctgccactgtttctctgacattttatatcctttggggccaatgagcaagtcccataggcttgtcccttgataactttatatcggtgtaattaattctcatcttaaatctttttacctgctgtcagccaagaaatarctaggaaagctgattttccaaaagcttgtggatcttagatgagaaaaatgatgagtataatgttgaggctcatgtaccatccttttttctaattacacagcctgttctctgaaatatctttccgtcgcatccatcagggatgccctcaacatcagagggagaagtgcatggctgtgcaaaagtgaggatttaaagtcccaagacagaagacaccaggacatgttttctctcttatcataagacatgtayttgatttatcatgtatcttcaaaactattctaaaawtccatattataataactttgggaatgaatgagtatcattgctagaaaataggagataccttcttgtctgatgctggaaataaaactaagctgacgattgctgatgcagttattttgaagtaacttgaaagattcaatttcacatcctcaaattttaagtacaaaattacgccatataattcatttttatttacttgtaatttaagtttacttttacatcactgataggtagaatataatggaagatagctatccccttactaaagtgcccatttctctcctattcacattgagtctgtgaacccaattttggggcaagatkccccactgctaaccgggttatcacaggatctctggattaattcatgccacattctgggactttcagttgagtatattttatttttcataagagaaataactgtcttatgaagaaaataatcttggctgtttttctctcctttcccttcttttcttgctgcccttctttagatgatttaatttgtcacaaattaatttttaagacctcagttaatttaagtgttctgaggtattagtgacttctctaagctccctgagctttagtttactctactgtaaatttgggataaacaatccctaccttgtaagcttgttacaatgattgactgggtacaaagcactgggtatacagtaaatgctcaataagtggctgctgtcagttttgcctttttaaatttgtaactgctcaagaggacccagattgtaacctggggggtaagcttcacaataagggaacagaagaaataatgaaaggggtaatttttgaccaggagtaatggatgagtaatgcatagatgaacgaatgttgggaaaaataggaaaactggaaatcctattactaaaatcattttaggtgggcttagctctgcatagggattattgccattttaaaggttcacgttctgcttcctttggtgaaatagacctttgtttatcttaagttagttaagttgtgttactctctgaaagcttataaaccattttggtatcattagaaagataatttattgggaaacattactggcaggttgtaattctgcttaagatacctattaatatctattaatagagttctccgaaccatccaaatgctaaagcatatagttgtattaccccccaaaaccacaagaatttctaatttatgttatggttgtgcaggtaatccccattggtttcagtctggcttcagttgactatagcacatatatacctatttttcaatggtctttcacaattataagaaagctggagaattagcagaagctaggagggaggatgctacccaaaatatcctacatggcacagggaggacctgttttggcagcatccaagctcaagtcctttggaagggccaaaactgatagcaaaatgtatagtatggttgataatgatttctttatcagaatttctgagtttgagtttggtctagaaatattcccacctaaagaagtttcaagaaaataacaagagaagcaaaaatgaatctttcactcctgacagtatgacacagaatattcttagtggattcaagcttcactgagcttctgaaggtttcacgtgtctgcaggtatttctccctctgttagaacatctccaagtcatggtttgtgtcttagtcaccttgaccttccaagagtcttgcatacagtttcagatgtatagtaagcacttagatgcatcttgactgactgaataactgagagagtgaagaaaaatgagatggcatacaatttgtttagattgcttctgttgtacacaatcgtacgtggtaactaatatttttacaatctctatttttctcttgttttcatcatcagaaccatacttgacaatcctctatgagacaaaagggtagaaatgtttctcagactgttactaatgctaggaaaattycattcattttctctgttttgtataaactcatgcagcagccagatcctagtggcaccctgagtgctgttgaggtccggagaagaaaggcagtgtcacttagcagagcgccttcacccagaacaccagaggctgaatgtaacctctttatttctccaacttttcaccagttaaagggaaaaagtgaattaaagtgaaaaataraagattagttgaagtaccttttcaaagactatattgcaaaaccaagtaatagcattagagatgatgaaattgtgtacctgcaggtatattggacagaaaggaaaaaatgcaatttgactgtgctttgcttttctgaataatctgccacctttttttaaatttgaagataagtctcaaaaaagtaatcagtgtttacattttagagcaaattttgtatttaaggtttatccagggttttattttatgctgtttcaggtatttaaagattctttgttaattaattgtaagacaaacttcacatgtttgtattaaagagaaaaaaaaaggaaaaagagggaatcatttcttaagcaatgattatataaaataaagaagatgtagcctgagctttgctagtattctgatgctcactgagaaaccaggcccygtgatcctgggagatgataacagtagattcacttatgtacctttttggaaattacttaagttctcagaacaatccaacaagtgtgctctgttagtcctttcacaaaattatttaaagaggagaggaagaggcaggtgaggtgtggcctgaaaagtttcttttgaaagaagaaaaaattattttacttagctttcaaaacctgcctgaaatgaataaaaaattaatcaaaattgaattttttaaacttgggcttagcaaagtaacaagtatgcttaacattacaatagagaaaatttcccactggtaacagtgataatccttctgctgtagaaataaagtgataattattttaaaatttactttcatatggttttattttctgataaaaataaatattatgaayaatattttagatatctccttcagttaacctagaattttataatcagatacctatatgatagaattaaacttatgcatgagggcataagagctttaataaagatttagaatagcatattttttattaaaatatgcaaaagtcatgataagatgagctgaactttttgtatccagtccaagtaaattactgcttaagatgtataattttttcagatctctgtagctgtagggcttttcatataattttgttttattaaatcacagatcaaaacagtgacccaggtaattatatttcagggaataagttgctattttcttatttgttagccaattgtataatttcacttttaggtgaatttttaatccttctctttcaccatgttggcgggggagggagagcaagaagttccaaaagtcagagagataaacattaaataatacatttaaccctgatatctccctttagatttcgggtaagccaaattttttttttttttttgagacggagtctctctctgttccccaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggatacaggcgtgagccaccgcgcccggccaagccaactttttaatagccttcacaatgatgccaaaaatgatcaaagttttaatttgactgttaattcagatgaaattccccttgtctctagctaagagggcttattccttctcttgcttatacccatcacccacctgtcagcactacactcctcagtttcttcctcatatcattcttgacttttgcctaatcaggcactcagaaccaccgagtttcttcttgataaagtgcttargagaaatctacatggggtgggggrgtattatctcaatgggctacaccatcctcttccagctgcaactagttagcaccttgggtgagctaaggaggagatcccttttaagtcattgaagggagtcaccactagtgctggtgactgtgataagatacgatgaagccctcacttagcttcatttatattgccttttgccaaagtaactccaatccgcccttctcccttctcttgttttcagtgcttcttaaaatataaggtttagggcagcctgaagtacctggtagctgcagcttcatgaaagaattccaggcaggcatcagtgacctgttggagggtctctgtgattagccctttggaggtgccatattgcccaggtgataagcattctttaaagacccaatacttgaccactctgagtaagcctttcatcttaacattacctctttcrtgcctttcctcctctgcctgtcatttgtttcccaggcttaatcactcactccaccctccacttcactcctcccacaccagtccagttatggtaatttaccaaaaacatggatgcttactgtagactsccatcttttctttctttccaccagctcagatatcagtatccagttctagtaggaacgtcattcttcctctaaccctcttgtggaattgcagaacaacattctttcttccacttgatagcatgaggctccctctgcgcatgcatagatacccaccttgttggtacacatgttgccagaatgaccatcaggggtactaataagtctctttgagtcttttattgttattgtttggttttattttatttacaggttacttgtaaatctgactgcyaattaatacttttcaaaactatcgtggaaatagaaagacttatatgaaaatgtttatggctctattattcatagtaagcccaacactggaaacaacccaaatagccatcacttgatgaatggataaataaaatgtggcatatctgtagaataaaatgcttactcactgatccctgtaggtttacctcaaaaacattatgctgggtgaaagaagccaagcatgaaacactaaatattatatgattccatttatatgaagtttccacaaaagacacaattacagactcagaaaccatgtcagcagtcacttgggggtagggatgaaagtgaggattggctacaaagaggcaaaagggaatttttaagaatgatgaaagtgttctaaaactgaattgtggttatgattgcatgattgtctaactttattaaaactcattgaattttacccttaaaaggtaaattttatggcgtaaaattagaaagctgttaaatattgtgaagatacatttttaaggtcacataactgcttttgcataattttatttcacatgtttttcagttacattctctttcttcctacagtctttcacccccatgccaacattttttttcagctccagtgttctttggacaaggtttcttaaacctgaatgtgcacgtgaatcacctggggatctagttaaaatgggattctgattcagtagttgtgggatgggaactgagattctgcatttctaaccaactctcaggtgatgcagatgcttctgttctggaaaccatgctttttgtagcaaatatttagttgtctgtctacttgctgagcctgtaagaataacttgatttcccctctaaataagtggaaacatccataacttcatccaacagcttacaacatggaaataaactgtttaatgaatgaattctttagttatgtcaatactaggtcctttgccctttaaaatgtttgttgctgctttctaccactttcagtggtcatttacattaagcctgatgattgttttggttcctcgaatcccctgtcaaaggtatgctgttattatggttttaggaacaagtatctctgcgaacagagtgttctgaagaaggagtttacctacattaacttccattagaggtaatgcaattcaaatacctgatgcctttattttaattttaaatacatctgtttctggaacactttgtactgggccaatttgaaatactatttattcctgctcatacactgtttgaggttcaaatagcaagggcattgtaaatggtgactgtctgcatctgtttgtgctactataacaaaatacctgagactggataatagatgaagaacggaaatttactttttgccattctaggggctgggaagttcaagatcaagccactggcatttggtgtctggtgaaggcttcttgctgcatcatctaatggtagagtgggtcaaaagtgccaaacagacaaacgctgtgttctcacatggcagaagagtggggagagccaacccacccgctcaagcccttttactagagccccatttctatccatgagggctcagtcctcagtaacctcctcctaaagcccccaccttttaaaaytatcacattggtcattaagtttcaacatgggaactttggaggacacactcagaccatagcagtgagttggagagaaggcatggcctggtggaaaggacactcgtttaaaattcaggagatctggatgcaggtaagggttctttgggtacctccatgtgctaccataaggatgtcaccaactctcaccacctgtacacaaggaatggttttgccatgaacttcacctctttggcagtctgcttaagtctttgacttcaacatttaaagaaagcattttgaaatgcacaaaagtataggattgctaaggaaagcaattatattgaaagagagttttagctgggcatggtggctcacgcctctaatcccagcactttgggaggcygaggcaggtggatcacctgaggtcaggagttcgagaccaccctggccaacatggtgaaaccccatctctaccaaaaatgcaaaaaktagctgggtgtggtggcatgtgcctgtaatcccagctactcaggaggctgaggcaggagaattgcttgaaccaggctgggaggcagaggttgcagtgggctgagatagcgccattgcactccaaccttggtgacaacagcaaaactccgtaaaaaaaaaaaaaaaaaaaaaaaaaaaaatatatatatatatatatatatatatatatatatatatatatagytttaaaaatataaaaaaatagtgatatatgtgctttttgaaattaacacattaaataaaatctagtggccaatctaagtggtgatgatcataaatattttgagatctctgcaacaactaaatataaaagatctataaagtttatggataacaaaatgttaggttttgacaatatcactgtcatttgctgcttatgtctatagttgaaagaaatgctgaggtttaatatgatattagagaacatgaagatgtattatttaccaccttagtttgcatttcctctgtaccctattcattcacaacttgggagtctatggtcctcagaacatctgcaccaaaaattctctaaagtctaaaatttatcaattaactgatgattcgagtaacaaaatttccaatcctgtaatatctttaaataatttagaatgctatcacatagcttcctgtgaatgactctaatggggaagaatgacatcttttcatctcttttttaatagatgaatgaacttagatataatttgaagtgcttagcagaagtcttctaactgtthagtgataaatcttttgaaatcagatatgacagtttctgggagtctttttcacatcatccttcaatttagggaattaaataataaaatttacttgttcatctttcactgtgtaatttaagctttacaaaattacttgttagagaccttccaactttatacatacaagataaacttaaatatttaggctagtcctttcctgttagagatgaaccagtgaggctcattcaaacagcagtttgctaccactacacacctattagagtggtcaaaatctaggacactgttaatgtcaaacgctggggagcaacaggaaccctcagtcattgctggttgggatgtaaaattttacagcaatttgaaagacarcttggcagtttctttcaaaactagacataatcttgccacacaatcaatccagcaatcatgtcccttggcctctatgcaaaggaattgaaaacatatgtgtacacataaaaaatgcacacagatgtttatagcagctttattcataattcccaaaacatggaagcaaccaacatgcactttagtatgagcatagataaataactggcacacccaaacaatggggtattattcagcactaaaaggaagtgagttatcaagccacaaaaagacatggaagaatgttagaagtctcttactaattgaaataagccaatctgaaaaggctacatactgtatgatttcactatatgacattctggaaagagcacaatgatagagacaggaaaaagatccatggttgccaggggttatgaggagggagaaataaattggtggagcacagaggatttttcacttcagtgaaaatattctgtgtgatagtataatagtggatatatgtcattatacattttcccaaacccatggaatgtgcagcaccaagagtgaaccctaatgtaagggatagactttggctgattataatttgtcagtgcagtttcatagattgtagcaaacgcaccactccaatggggaatgtcgataatgcgggggccggggggggcggatatgtgtgttttggagcaggatgcatatggaaaatcttcatacctttctctcagtttggctgtgacctaaaactgctctaaaaattaagtgtgtgtttttttaaataagtgaaaccagtaaagattaagtgtcatacccaagttaggacccatgcttttccatttttttccctacagcatcttacggaaaggacaggaatccgaaatttctttgaaaatccaagacagtcagaaatatttgaaaaagcagaatattttggaaactaaataaaggccttcctgtctgtagaaatggattgtgaatcagcctaaagaaagagctcccttgagggttggttattgatgtcaaaaatgtcctatcaggtttagaatgcaaagatgaggctgtaagacagagactgcacaaaggcaagataagagagggcttaagtgatgtggaagactggcaaggacagggtcatccagtcctgcatgtcagcgaagcaggaggtctctaagmagcatgacatgtagcagtgatatggtcgtcagcattagattgcccactaagcaggcttcatctaatgcatcaaatagagtataatgtgaattatggtattatcctcatgatgtaaatggtgggaaggatggaactatgactattctattatttttaatttaaactttattttaactgtaagtaaattcaaacaaaccgttataaaacacaatactatgcacagttgcctgcatagatcataaaaataaatacataaataaataaaaaccagaatgctgagtgagtactggtggtgaaaactgcagggctaaaacttgctcaacagcgaactagaaaacactatggcttaatgaacatggcccacccctcctactaatggttttgtcaacttttggacctagaaattctaatatgtacatttgggtagtaatgatgaagtgggagttttgacattatgtcttagtacaattgtatacaactgactaaaagctactaatctgtaaatactataggaacacacagatgattaagctgtggattctgttttcaagatcttaagtagttaggtcaaaatcttgattcaaatccagactcttccagttcactagctaattatctagttgtgtgaccttggggggtctcttcctctataagatgtgaattataatggaaaaaaaaccttatagggtggttgtgagaataaaattaatttattggatagctggctctgtttgctgggttgacatctatcaatcaaccccataacccatttagacatgagttaatctacacagcattcagaaactgcaaaatttaggagtcctatacaaccccatttcatgctctgttatattataatcctttaatcagttatgcactctaactagatcttttgccctagatccagagtgggaaaatgtgatgagcttgttgttgcttttctatatgtctctttacctgttkaagtctgccagcttgtgtcctctcaattggtaatagtccactgtgcacatttgtaggataattaatacaactgtttactgaagcagcaaaatggagtcccatttaactattgtgagttttgctgtttttagattttatgataaactcttcatagcctgcacctgggagagcctggcagtgtgatagcatctacagataggacatgagactattgactgtcaccatagttattggccattggtaaaaaggcataaggttaaagatttttaatcatgtgttctgaaaacaaaaataatattctagaatccaagttaagttctttttctctacataaagtaatttttctgagtatgtacatgtttatcaacttatctttacatattatkttattgtaaaacataaaacgggaaaatttttgcttgaattgtgaaaaaataagttttgctgtcacactcttaatataggacacatattaaagtgagatagtactggatcaattccccaatttatcaaaagccaagaactcccggagatttgaaagcatgcattcaaatgttgtctgcatcctgggaactaattagagtggaagagagtaaaatgaattcaacagcggtgtatccaggagctgcacaygaggacttatatttcccacatgatataggaagttgtaaattacattatgcactaaattactatattttatgattgttttctatattaatagtaaagtatttcaaagtaacataatttamagatatttctgttttatatctagacaytgccaacctcattcaatatatgcttaaagtctttacctgaaaaaaatgtctgaagtaataggttagctcaatctcttatcttctgggactcctatctctcagtattcayttccaataaatagcaggtgtgttgtagaatcatggctatccaacaagagaggccaagttatagctaccacgtcatattttcattactaatagctcattttagttttgttagcaaaagctgttttgtcattccttggattgaaggtgaagacagtatttcttataatttatttaaaaatcacaaattcactattgtaatttttaaagatatgacaaacattaattcagttttaaaattgagcataatataatttgtattagattgaaattaattaatgcacatttcatttctaaataatgattagcaaatggagaatggtataggtaaagaagcacagaaagaagatgggagaaagaaaagaaaagatgaaaaggataacagaaggaatagggatgagagatagagaaagctatctctcagaaggatatttagtagattcacagatgcatgtaagttacaataaatgggtttatcttctttaattaacactgcaaatcacttgagctatgagtttctatttgctacttttttggaaatattcattagttttctcattccataaacatatattgtacctcctrgacacaaaccacagagctaaactctgtgtgggataacaatatatagtatatttcttgcttattagctattatttgcatctcttcaactgctccaacctttcaaccaytgcattatccactcagacacaaataatttctggtgtctaccagtattatgcagaataatatcatttctgtactatataaaacccttttgagggcctgagaatccagcattcttcttacttcaatgacatgttattatagaagttattaaatgtaaaattgtaagctcaaatcattaaaatatctctttgacgtggcagcatgtaacagtcttcccaaccatcctctatttaaatctgcacttccagccacctcctttccactcactcctttgtttcgaagtgatatagattaagtatacctttcctgttatagaaattggatatactcagtaattattttccctggcctaagggtcagggaattgtacctacctagagcatatatatattttattctttccaaattataaaatgctaggtgagaaaaatgatgctttaattaagagctcaacacagcaaaatgcacatataatccaaaaaagagtccacttaatagaaggacgtaaatgaatacatatatcatattgctttgataccttttagctttcagagagaatatttaaggtgagtagtcttcatccaattccaggaaacattataatgttatggggccattgagccctttctactttagtagaaaattctactcagcagaattagcagcttgaggagcattgatgagtttgtggatttgctcaagaaataagttaaagtactgatgcaactctaattcttttcartgatcaaaatgggaatgagtagtgattatgtccagaaactgatagataaaaraatataatttatgctcagcattggtggctagtccactaagagtgatgtgctgtctggagtgaactaaaagaataaggttatagtcaatacttttcttcattgtattcttgttttctttcttgcaccatccctgccccttttctttttcttataatcttctccgcttccttttgtttttaaatttagtgtgctatgttatgctggatagaagtccgcagtgaaagttataaggagattttattccagagaaatgaaaaaaagtcactctgagtaggtattaamtctagttatgttgaattcggaagctctatcactgtgagggaaccccaggattcttttcaggaacaatagtctttactccccaaacatgacatcattaggtcccttttatttcaagttgggcctaaatttggtgatgctattaataatactgttaatgttagaaagaaaaatccagctagttttatttttaatactttgatacaggcaaattaaataacattttcaggatactatagcacaatttcataaagtactgtgctccagtacctaaatgattctattaaactagattattttaaagctgtgtccctttttcataaaatataatttgtcattgactcttacatttatcaaatatttcaatgcctaataaatcccagatgctaagatgattttttaattactttttgttcatattttggaatgaaaacaaaaaaaaaatttttctcaatgtacatatacatatatttttcttccttttttttttttttttcttcttagacggagtcttgctctgtcacccaggctggtgtggagtgacacaatcttggctcactgtaacctccaccttccagattcaagcaattctcctgcttcagcctcctgagtagctgggattacaggcacacatcaccatgccttgttaattttgtatttttagtagagactgggtttcatcacgttggccaggctggtcttgaactcctgaccttgtgatccacccacctagggttcccaaagtgctgggattacaggagtgagccactgctcccggccatatttttcattaatgcttttacatattaaatatttacataccaatgtgacacatgaattttatatgtatatacattatatattttcatatacatatattacgtatatgtatgttccatatacaataatgaaactgataaatatatgtatatgtatatacatttttatacatatctatacatttatatacctaaattgaatatacatatgtcatataatatgcactaataaaaactgatgaatttgccttgtttcaggaaaattttttagaactccatttgggcttttgttttttgatatatttttattgaagtgttttttgacttgggtggtattgaagttggcatcatacatagtaacagcttcatagaataacattgaagttaacctgcttgtgggaaggggggtggtcagaatgttatatttattgtacactggttgtctgtgcaattttgataatgttagtcactcaaaattgttcttaaaaagaatattatatagccatatttcagattagcagagactggaagctattgcttgcatacaaatctttaacttctctgtaggaaaacgccactacatgtttggtgcccttaatggcctttcattggcccccagaattaactgtctgaatttgtgtgtctgacattggataaaatgtttatatttcttacctgggagaagctcagaaacacagcaataaaagtgaatttcaaagcctttggaaccaaattacagctgtctatagcttttatatttcttatattttaaaaatacaaaccaccattaatagaaatttctataacattttagacataatgatttacctatgataaatatctttgtagacctccacacagtttcttttgtattttcaaccttgttttcaagatcttctcaacaaggcaaccactaagagagctgtttttacttactgtagctgagtgtttctcaaccctatcaggcttcaaatacactttatacagcaaacatytgagactgtccctttgctaatttcacatgaaattcatagataatatcacctgcttatagtcataagttttaaactgtaatgtaataccttactataatataaagaaaatattgtaggagatactgtcaaatttaaaatatatgtatttcagcatgtgacttctcaagcatatccatacaacaaggcacaatgatgccgtatgcttgcatcttaggtagaatcattatgaatccaacagttacaaatgcagtttgatgtaggtgtgttgcattgggtatccaggcaccattaatgagggaaccatcaaagatawaattttcttaaatgcgaaacaattcttggtaactgtcaagtaaaacaaaagataatctttctttggtttacatggtagttgcatttttgtaagagctagtatatggaatatacattagtgtatgtatatatgtatgtgtgtgtgtatatatatatatatgtattttgtatgtataaaatacagttacaacttaaatctagataatttaaatgtgccttcccacatcagcatatgtgtgtatgtgtgcttgtgtatgtctaatggagttgtgatttaagtgcagatgcttataagtaggtttttcatctacctgagtgtcccatgaggcatggaaaatctgtgcagcatgcaggataactcccttcttgtgtgggggactatcttcttgtgtgtaggagtgtctgtgagttttgtatgctaaataccagcagtacttacctttacacaccaacaaatttccagaattcytttgggatgcattgtgatccctcttcattaccattgctgtagtttttttgtttctccatttcattccatcactttctatctactctgggacccactttaatgtggtgtccactctccttacacatccagcccaaactaaaagaactgtattgaaaccgttctcactaaggtctctaagtactgcaagttgttaaatgctcatcgcatctaactttgaagtaaccgtagacatagattccccatctggaccacctcagtgatctccatggtaacacatccttcccatgctccttcttattctctggctttttttttttctaagtaatctttaaatattgtggttccttcgaacttgatcttatgccctttccagcctcacacacctattcctatgcctaaaattttcaactaaatgcaaatagcttctatatatttccagcttaaattcctcttccgagctccaaacttgtatattaattcaactgcctactcagaagttccataaccatgtctcacatgcatctgaaatgcaatatgtctgagattgaattcgtgtccttccgcccaaaacctggcttcctccagtgtttgctggctcaataaatgcagcaacatctgtccaattcctcatgccagaagcctaggtgccatccaggacacatctacaggatcatatagtcaatctgttactaagttctatatagtctaccatttattttttaaaatgcattactgcttatttaactttactgtttattaacttcagcattctaaacatacaattactgtttattaacttcagcattctaaacatacaaaaaaacaatattgccaattatgtttaagcacagaggttcttgaactttgattgatgcagtggctcttccctttgctgacaatgaacagttctgcagtttgtttaagaccaaagtttcagctgggtatgatagcttatgcctgtaatcccagcactttgggaggctaaggcaggaggattgcttgaacctgggagttcaagacaagccttggcaacatagtgagacccccaattccataattttttttttaattagctgagtgtagtgacgtgcagctgtggtcccagttgcttgggaggctgaggtggaatgatcccttgatcctgggaggttgaggctgcaatgaactgtgatcatgctcctgcactccagcctgggtgacagagaaggaccttgtctcaaaaaaaaaaaaaaaaaagtttcaaaatgacagcacttaactaaaaaaaatccaaacaattttcacgccagctgaccccctttgtccagagcaaagaatggcagcagaatgctatctgactatatacagaaacaagacaactaaagctaaatgggggcccattgcagtggcagcaggtccagcctcacagtgcatgcactgagctccagtttctccaaaaggcctcttctcccacagcctcaacacgaagccaggggcctcaaaagtttgtctctattttgttctttttacaaaagatatgtatgtacacctgacacctcaggatttctagcccatagccaaatagtaaacatcaccttacacatgtttttaaatgccagaaacatcttttaaatgccttatcatgcaaacagcaaagtgcacagtgtgaagaaaacacaagattgcctttttatttttaaaaatgtttggaaatacatataattttgatacagtttcaggatgctccagacacccatggccacttgacataaaccactgacaatttctagaccactttgaaaaactacaatatgattctgatcagattttgtcattaaacctagtgagggcagtagacacttctcaaatagatgtgtcagttacagcactctcctcctctaaagtattcacaaagagacagataaaacagtttttttttcatcytcctcctccccttcctctttgtcctccatgttttcttcatcttcctcttccacctttttccaggcaactttagtggggtgctttgagccatcaaactctcctttacacttactgtcagcaacgtccttctcatacctctctttcagcttctctgccttagtgatgtcagtctgctttgtcctgtcacttaagttattccacatctcacccagctttttgccacggatgccaggatttgcagatttgaccttgaagtggacttctgaacagaacggaaagaattcagatggtggccttcttgggacatcttctcgcctccctgagytggtcataatcgttcatttccccatccgaacctactttttctgcctttgccattttatcagatttatacttatctttcctagacactgtctttcacctgtcggagcacatcttgaaaaattctgctaaattgacagggacctctgggtttttctttttatgttcttctctgcacatctgcacaaagagagcacaagcagacatcttaccctttggtttcttggtgtcacctttagccatcctgactgtactgttttgctaatctgggcagtgtagggcatgatgccttggcttagtgctctccagcattgagctagctgcctccctgagaggcccctctctacmaattaaatagctcttacgtccatcagatattctccatttccatttcaccatcaacactgaactctgccaaagtcatcctcagttcttgctggagcttgtgtttcaaactaattcttaaccaacctgttttctcagatgctcccacttctttctattaccacttctaaatagatcagtcagaactagcttctgaaaaccctcaaatctcagcacatgggtctgcaagaaatgatccctgggccaaatctgaacaatcacctatttctgtaaataaagttttattagagcacagctgcacactttttaaagtaatattttctatggctgctttcacattacaacagcagagtgaggagttgcaagagacttgatactccaaagcccaaaatctatactgtctctttagaaaaaaaaawaaaattgtcaacatctgcattgagcatatactgaatatgcagtaaatatataattaattgttttagatcatattttccaaacgcagcatagctctccttatagaccctaagactctatatggttcctcatagctttccttgtagacaaagaccttgtgttttcagaacttgtgttctgttcaggtttcaatcacgtgaagaaaagaattattcatttagcatcaataacagcagatgccaaaatagcgatttgagatagctttcaagtttgtgctctttgagagccagcttcgaggtagctgtccctcactcagacacctgcttgcgggcacccagttttgatattccttttaaagagaatgtctgagcattatctcacgttttctaaaacagtttaacagtccctcctccaggcagattcattattaagtgcataatsatatgaaggttcaggatggcctgaaatctggacgatcacctatttctgtaaataaagttctgttagagcacagctgcacactttttaaagtaatattttctatgacttttgattatggttgtgaaagtttccctgctaaggtgtgaactctgtatccaaaactccctagaacaaggtgaaaatgttctccgtaaagctgagctgcacttcctcagactgtcttgccatctgtctccttcaacaaaatatgccaatcaaaagtgtctggacacacagaacataggaattgttgatacatttaatttcaatttttgaagtagatacctattttatagatggaaacttttattgcattatagttagaagaagcattatgatcggttgctgtttttgaataattgaggacaagatttttagattcgtgcaaacagcaaatggataagtcccttttggtttgacacacttcatgtttattataatatccactgttattactattattttatatgaatattatcacattattacacatgtaacttatgactatcatattttgcagttaaatttgaagaatagatgtcaattctcatttgtttttatattttatatttccgtatcatttgtaaggacatgaaatagtctttgaaatataaattactttaggtaacttgaggttaccctgttctaaaaccatttaagtgacaaaggggagggtagtcccacaggaaagtgaaataaattttcagctgacacacaacccataatgattttcagatactcaatttttattcgagacactctttctgtctgcaaattctaaaatgctaactcattaaaataaagggccattttttttatgtctctatggagacgtgtctgtggagaagtaggtagggaacattccttaaaaatcgacattccttctatgtaaagtttacttaaaaggcaattcatttgtctgcactaagtctgataaaatccatatacaatcttctatacatgttatcatgcaaccctccttgtaatttccatgaaatcattactgtggacaattctgaagactatttttcggtgtccttttccccttgagttgttcattttgagcatttttataaagtccttagttcctaatgttcatttgtatcactgtccttccattgatctttttgctttgggtagtcttccaattatcctaagaatagtagactttgggaaggaagtgggaagggtctgccgggtagagcagaatcaacgatcttcaatccagacagtgagaaacagtaatgactattgcagactaatacgtgcatactatatatttatcaatttcccccaaatgatcggctgctcactgtttctgtcattgccacgcattatttaaattgacctaacgccatgttttgctgccttaaatcctttatttccagcactaaactatgcaaagagatcttctgctgtggcaaatcacctcagcagggcacttgcctacactgcttgcaggctcccctctgcttaccaagagaacagcagctgagtctggaaaagagtgaagacaggcttctgagatatcacatcaatgtcacacgaaggcactgatgtgacttctctatcctttgggctcatatatcctatgaaacttcaggtttgaaagacaaaatgagtatcagagagaacagcatgaatttgaaataagaaagatcagacagggagaaaaaaagtctccaacctcccattcccaaatggacttcaggtaaagaaaaagccaaattatgctgagacttgagtagatgttgaacaattgtgtacactcatgttgcataaaaaattcgctggaagtcattcgtatgcagcaaatagttattttgtgtttaccgtatatgtatgaggcaatctttaccttagattaactcattgagaaatgattaatgctctaattatttatacatctgccgagtagcagaatactgtatagttttaggaaacaacactttaaaactgcagttagctcagaattttgcaaatgtcatgccaaggtcgttgatgaagctgactttctcactgcttacgccagcctgcacagtcataagtttagtgtatacacacaaacactcacaaatacacatttcacttccttaatcctacatttcagtgacttaaataagcacatatctaaacagccttcccttagacacaggcaaatgcaacccatgattccacacagcccttaaaatggcaactygcaagatgtacacaattttaaaattgtattagcctattcatagcaagattcttcattaacctatgtgcatattcaatgttgaccacatgccccccaaccccacccaccaaaagaccagttagagatctgagatgtggaagagtgctattcagtttagatatttttttctcatctattactttctagatgaactgtcatgagttaaaatgtcaataaggacacctgtttatgatcaacataattgagctattttaatctcaaactacttcatcgttaagatagttttcagctcagaggctgagataaagacccagccagttttctaggacacacatcattaattagacaacaaattcttacctccttscttgttggttttacttacaggacaggaaacatctctatggaattaaattgctcactacatgctcctaatatgttttgtttttatgcttactccagggaaaactgtgagacatgttgagaccaggatttgttgttttcttttgatagaaaaacatagcaattcaagtcagcttttttcttttattagaatgcaaagttccttaagatcaaatacaaaaaaacagagtcatttaaaagtactgaaaggatataaaagggaagacattttaaactacagcttatcgaagaacagcgagtaacgttagcaagtactttcgtaactttcaaatcttaccatttactgataaatatcatgagttttccaaattctttgttgttgtctttatgtctttgaacaaaagactgctttttgaaacaacttcaagacaatgattattgaacaaatgattatttggttttttgaaggttcctaatttccaagctaacattttcttattgactctaaccatctctgtttctactgaggttgaacacacacacacacacacacacacacacacacacacacacacacacacatatcaattcatgacattctctttagttagtgcctaaggttgcaaatcttcattttctttggtcagataatacattttcataatgaacaaatggagtgcaactctcaaagccagtacctaacactggaaagcaaaggctgaaatcaaagcttggtcagcctgctaatatgatgcgctctctgtcgactaatcaccttccaataaatatttgttctgttaacttctactgtggctcctccctcatgcccaaccctaccatttatatactgtagatattttatgagaaaattgacccctgtttatgtgcgtcattccagtcaccmacaaacacacctttataaaggacgcacaattacatgtgacaaattaattggtcatttcattttgtgtccagaaagtactctttgaggaaccatagggcaagagctgtcctagccaccctgtctataaagataaataaacttaacccgtatactccagcatcctgctacctagaaggaaaaaccagaagcataaacaattaaaagtgatgtagcatagaatatgttgtaattcaagaaaaatgcattcagtaagtttacaaagaaacaacaactgtgtttgcacacacactgtctcatgttgtaaggtgggtattataattctaattttaaatatgagaaaaagaagacttgcgagaatatttcccaagctgataggcagtggagttgggtgctgggtctggcttttgtaattccagccccaagccctgcaccacagagaagayagttatcccgtggaggtcaggatttggaaatacttggccaaggaggccctgattaatctggacatagaaagtagagcaatagcttgaatgaccttgcaggaggggacagcaatcaggatatttttgtctgctagggctgccgtaacaatgtactaccaaccggggggcttaaagcacagaaatgtatttttttcacagttttggaggctggaattctgaaatcaaggtgccggcaggattgtttcttctgaggcctctctccttcactcatagctggctgtcatctcttgtgtcttttcatagtcattcctctctgaatgcctatgtacaaatctcctctttttataaggataccaatactattggattagggcctatcttcatgatcgtatttgtctttaattgcccctttaagaccctgtcttcaaatacagttgtactctgaagtggtaggggtatggacttcaatatatgaatttggggggaatataatttatcccataactgatggtaagaggccacaaaaacaaaatatgggggcataaggaccccccagtgcatgctcaggctcaacattatagcaaagtagacacagaacagtatggaaggtgagcaccaagatataaagggtcaggggaggcaggatcagagtggagagatctggaaggctacagcaaggtgttttatcgaaggcgttattgcaggttcttgctagagtgatcattgagaatttaaagaaatgaattttagtaatgggtttagtatatattaaatcatgttcatataacttaaaaatattaattttaagctatttactgaagaaaaacatgaccactcagtggaactttatattttacgatttctaaaaatattataggttatttttctaggaactgctgttaattttggccattactgccatatactttggacatatataaagtgttttttggtaagtatctgagattacatttaatatctacatgtagcacactttacacaagctaaattctatcgtatttggcattttttcctcaattcagctgtattttcagagaaaacacacaagattacagagctatttctatgcttaatagaatactgtctaatgatttctgcatgtagcaaaatccaactttttggattaacatggctacatggtaatcacccactaaatatttacaacatgaatttatctgtgactcacttgatgtaccgtgattgtgtgygcatcctaagacgtgattcctgtactatggttgagtaattgtcatggcaggtttgcccctctagtgttggcttctcgttttgctttgtgctgcttttctctgctatccaggctgccattgctatttttattttctacttctgatggttcaggaayatgaaggcaagataaaaagaaagtatgtgttgccttactgccactattctatgatatgagtcaggggtatggaaaagctgaatttttaaggagacagcaaacctcacagattcaggggatttaatttcccctcctcatatcccagaaggtctaagttactagttacsttaaacaaaagaaataattaaacaatggagaagatgctatagaaaagtttcccttttcttttctttttaaatatacttcttatatgcagtcctaaaaggactttctctcttcttatagcttaacaatcaaacaacagcttagggcagcatttggcaaactgtaactgctggttaaatctggcctgtcccctatttctataaataaagctttattggaatgcagccacactcattcatgtgaatgcrtattgtctgtgactgctttggcaaaatagtggtggagttgagtaattaatacaagcgcttttcagccttagagcctaaattatttactatctggccaactcactttttggtttaaggtaatgaaattttaatttgcacacaataatgtacatgttttaatatgtgacaataaaggttttgctgcatttatgcagtacatttttgaaattaaaaataaacttgtaatagaaatatagttctaaagagtttcaccatcttgtagatttttcaataattttttcatataaagtcaatacrtctttatagaataaaatattttagaatctagtttataggaaatagcataaacatctgtttcgataaacttcccctaataaagacataccttgaacacgagctattgttttgcatttgccaacttttccatttcrtaattgtattaaattgctagagatggctttgtaatcaaagacattagaatattcagttgaatatagcatgggtttcagggacacatttttgttgttgtagtggtttttgtttttaattctctgctgctaggtagcactaaatccccaagggactcaaagatgagaaacaggaaaaaaatttcmagctgtgaactgctgctaaagcakagaagccctgtctgtgatattagttcgtgtatcaaaatgcttgcsatttggccctagaaaaagggaccgctggcagtgttgtacataagtggtcctgcttggtttgcccatgtggtatttatctcagtcccttctgatcagggccagaaagtctacccaacaggaatattctatattgagtagcacctgactactgaccaaatcagatgttttcctttggtagatttaataaccgtagagaaagagagctgactgcaaagtgctaggaatgactagagactgagagagagcacagatgcttacagagagcctcagtagttactggcrggaaagagaaccgggggagagagacagtgagcaagaaaaggaggagagacaaagatggagaggaaataaagtaaaaacagatraagcaaaaaaagaaattgagtcagaagaatgacagaatgaatatggtcagaagccaactgcacccatttatgaggacataactgcttgaattgctgatgtgacattggaagtttgtgtgtgtgtgatgcagtggcattccaattctccctgaaggtatttacctatctcccatatatttccatgtatctgcaagaagccttatcacctatgacagagctacaaacatcagagtctcactaatatatatatagctaattgattattttcaaaataaaatgtgaagggaataaatcacacaacagccctatttatggtttagcaaatgatctcaaactcacatatttagggggtcaggtgcgtcaatgagtgaatcagtttgggtgtaggaagtgatgggtcaggttgagggacagaagaggctgtgcactgctggtgggactgtgaatkagtgctgccattatggaaaattgtatggaggttcctcaaataactaaaaatagaattgccatatgatccagcaatcccttttctgggtatttacctaaaagattcgaaatcattatgtccaagagatgtctgcactcccatgttgattgtggcactatgtgcaatagccaacttatggaatcagtcgaagtgtccatcaacacataaatagataaagacaatgtggtacatacatatacacaatgaaatactattcagccttacaaagggaagaagttctgtcatttgcaataacatgaatggaattggagaacattatgctaagtgaaataagccaaacacagacaaataccacacattctcatacagaaaagttttccttttcttataacttatatgtggaatgtaaaacacttttattctcacttatatgtggaatgtaaaacaattgcactcatgaaaacagagggtagatggtggttaccagaggctggggggtggaaggaatggggaaatgataatcaaaggatacaaagcctcagttagataggataaataattttgagtattttttatagatctgttgcacagtgtagtgaatacagctaataactgagtaatgtacatctccatatcactaagagagtaaatctgaaatgtttttgttgcaagaaaatgtcaaatatttgaggtgatggataagttaattagcttgatttaataattccacattgtattcagaaatcataacattgctttgtacttcatatatatatataactataatttgtcagtatacaaaaaaagccaatcaaattttttaaaaaatgaaaataggcaggttctactcagctccaactgattgttccatcaaggactatagggccccttgctaaatcttctgatttttcaagagaagctagaaatcacagctttatgtgaattctcctcatttttaaatgtagagttaattggttaaaacaacaaaaatgatggcatgaggggcaaagaaaatacttgtgcacaagatttgttttatgatgttggatttacaactaacaacaatttatrtttttcacagccctcttgcaatggcagtctatttggggcataaatcaataacccttttctatgatttttttcctccacgaaaatggccttgattctagttcatcttgtgaaatgagatttcactgtgttgttcagagttttcatttttgctggaggcttgcaaggcccataccctcaagataggcagtgatgagttgtgacatgtatcctgtgcatcagttgtcaacctgagtgacactaaaatgaagagctgtcattttgtaccagaaatgtcttagctttatttcctgttgtttcagcaatccaaagcaatggtggtgtttgggtgtggaccacrgctcttttcctcaaatctaaggatttcatctgamaataggaaaatagctacagttcactgtagttgttaatctttataccactcttgccaattttgtttttctttcttcacttattctacttgcattttccttaaactctacactgttaagaaggtagtctcttgtttggatattatttcctgttaacaattatagrtctttttattgtaatcatttagatttacatatattttctcacttgtcacaaaggccaaataaggcttcagtaataatttctatttatgttcattgggtagtacatttcattgcatcattctctagggaaagttagtactgtgttaatttcaggktctaatgccaatatataaacacatccagcttgtcatttgatatccagggaacattacttttcaagtgggttctccaaatgaatgggtttgactcagtcatctcatttccttaatgctcacaaatttttagacacatttttacactgtgggtttcagtgaacatttgcacattttactcaaagttggtcagaagagttaaaattaacaataatgggtggaaatggggtaggaaggtcaaaggtcatcttgagtgatcttggtttttagaaatctgccagtctgctgtgccttagcagttgcagaaggccatgattgactctctccctaataataatctccttgcttrtaaggaagtattggagaaaggagttgaaagtaatattagcaagaagcctttactaatgagtaggtatgcttgtaaagtccttcacttgaaacatttgtcaaatgactgtcctttgtcgactactatattttgagaaattccagaggaaataaggtgagacttcagaacttacaaaaaaatgtaatgtaaaggttaggagtggtgagtgtagaaatgggagaataaaactgtcagctcattaaggctagaaaatccagcatacaatgcttcacaccccaaaatattcatgccgcctatatttcatgccggttacagcaccttacagtacattttcatttgagcctcacaacaaccctttgaagtaggaagtgccatccgcagagtatactcagaagggacacacatttgagaggttttgtgtttattcaaggccacccagctgtaaaggggaagagacagagcacaggacttccttgcccaccaagtgttcctttacagccacttacaaaaagagctaatgcttgygtgttagcaaatatgtttcatcaacattttgcaaattctttacttcatctgacttattgatagaacaaaagaaaacacagcatgcactttcaaatgcaagcacctatatctttggcacaaatatcgataccaaattcacgttatagttggtacayataaaaacaaatataatgaattgcaaggttctgcagatttacggctaattactcttttctacttcttcatctatatttatcataatgtgatccaagatcaagttgcatcaaaatcaccaggatccttacataaaatactcattctccaacataagcccagaactatttaaccaayacctttatggtggactcaggtataaggcattaaaaattttccaaaaagggacaatgaggcatgctgaagtgtgaagaatgcacctagctttatggaaattggtgtttaacgtctaggtggtgtatttattttaacaatgtacacttaatgatgggacacacatagatagttaaaagcaaataaatagtacccaatgggtagttttttgcctttgcaccttccctccttcccatcacacaatatacccatgtaacaaacctgcacatgtacccactgaatctaaacaaaagttaaaaaaaaaaaaagaaaatgaatagagccagctagtaaatctaccccaatcctagttctcttcactcaaatgtagttgactatgctctagacattattaggaacagcttagttcttaaatgtttacggcagttactcttattggatataattacataaaagatggaatgccttgattactaattttaaaaaaggtagagtggataaaagagagtaaaaagaagttactattttaaaaaataaagcttggtaaaaatgagatttgggagaaattaatagaaaatgaaaaaaaaaaccaaaatactagaattagaacctcacctagggaacaaactgaaatgattataagatttgatgatagagatgggacccagaggtagaatctgaagtcttaatatcagaaaggcattgaacatctggttgaagaccaaaagcaaggagaagaagcctctttcagtatacattatttgcaatgaagaaaaaaataagaataatgtaagggcattattattaataataatatgaataataatgtaaagtcatttaaatattaagaggagattctgaaaattgaggcataatagaagctttttaataaaaagtccttattaatatatataaatgttattggaatttttaatttaatatacttttttatcttagaaaactaatactatctataaaaagtttcatatatttgttttaaaattcgtcttctcaccccagtttacctcgggtagtcctgagatcctttgaattttactggaaccttttaaagttggagaacmcatgaacctcaggtgcatgacagcttaygctttacattttgaagtgatccaaatgattagagaagaatttagaaacttacatgaatcaactttatgatggtcagagaatctgtgaaatatgtttcaaaaagaggatctaatttagcagagcgtaaggggcatgattttccaggtgagtcacaaattatgttttgggctgggaaatgaagaccaaatctcacaggactaacctggagatcagaaactggggcatgaaggcacctatgaatctctgaaaagttgataayattaggtacttgctgacctgttgagraagaaagaacccctaatggttccagaatcacaagcctggagacacaaaagagaatataagtggtgggaagcatggaaatagggaaaatgatgtcttaagaaagagagctccattccagacattaattctagatactgaaaaatttgaatggaaaagttcttacacatgttcaagtacaccacagtgaaagagaaatagaagctctaaaatcagagacatctgtgagtcaccctggctaataaatccctgaagaaagatttggaaaaccaaatcatgggtcgttctgttgaaggaaagaagataatcttataataaatgtacagagtatagactatttatctatctctgtctctctctctctctctctstctctctctctctctctctctctctctctatatatatatatatatatatatatatatatatatatatagtcaaaaaaggcacaaataacattaaagaattaggatttctcttaaatcaggaagaatcctgggaaaaaagggcaaagaaatatccaaaatcctaacaagtagggctgttgatgcttccagaactgaaaagaaaattcttctggttaatatcacaaacacaaactagagaattgcatagaaaatacactttgagaaatccagttaaatgcctgtctctcctcccccttgtatctagttttgaacttgatcacattcaaagtaagcaaggaaggcaagcatgtaatgtcsaagtcacattaaaggaatcgaatttgtctctcttacaacaacatgcttccggttcataataaattaatccagcattctatctcaaaactgcctctttttattatactagcagatatttcagggttttcctcagtgcttacacacatgtataagtttcccatagggaggatgctaattacagtccccagaattaattttcctatgtacagtcctcattatcatttaattgctctaatctgacagagacagcctggacagggaaatcagaaagcagacatttcaacaatctcaaagtagctgggtggttatcccatatcactgggtcaccctgccctggastacctgcactctataccatgctagcagaactgccctatgatttcaggaaaaaaaaagtggaggagggggcagggggcaggggtggtggctcacgcctgtcatcccagactttgggaggctgaggcaggtggatcacctgctgtcaggactttgagaccagcctgaccaacatggcaaaaccctgtctctactaaaaaatacaaaaattagctgggcgtagtgccacaagcctgtaatcccagctactcgggaggctgaggccggagaatcacttgaacctgggaggcggaggttgcagtgaggtgaaatcctgccactgcaccctagcctgggcaataagagctaaactctgtctcaaaataaatacataaattaaaaggtaattgaaaacagcctggcatttctgtgtggtttaagcttttcagtggacagagatgagtaacaaggtgaaaagaaacaccaaacccaagcacagtcccacacattgctggggtaacagcagaagagactggaaagatgcttacataccactatggatgggtgggggcttggaggcaccgggtaggaggacagaaaagaagacaggatgcttgctacccagaaagaaatgcagctgacatgctctgaggagaggcagtcagtcatcagaaagcacagggagtttctcctgagaaccatgtagggttatgcgttgaggaaactgagctgcttgcagacacaatcctttttttccaggggtttgtaactcagtggaaaaacagatcagtaaagttagatttaaaatacagtataaggaacactctaataaaggtaagtggagagagttatgcgatccataggaatggaaactagctggttttaaaggataaaacagcggttcatccattcattcatatgacaataatcataaaaatggacagtgacagctattcaatatgctagatggtactttacagctttcaaaacacattcattagagcttaactttattacaacactatttgaaatcagggaaagtattattggcttagctttatgatatactcttggacagtgtgttgaaggatacattattgtgacatggatgatgtcacattttctgaattatagcctagtgtttttttcacattgcttattatatattttgaatgagcacctggaaataaagagcagaattagccttggattctgcattttagataatacatagcaaagtggaattgggaagacaagacagattgtatgttagaaggtgggacaggattaaatagcgacatgatgtgagtcatcagtgttgacctccctggcttgtgtgttcagaaaatccagtgtggagacagttggttcttttcaagtttcttaaaaggcacaacaccatccaacttccaccagcctatataaatgctatgtggcttaattgtcagcaacaataagagaatacacaagaatcagatgaactggaaaaagaaaagctttatgggttgaattctgcctccttcccccaaatttttgagggtatgttggagtcctaacccccaatatgattgcctttgaagataaggcttttaaggaggtaatgaaatcaaaatgatgtaattagggtgggccctaatccaatttgattggtgtccttacacaaagaggaaattaggacacagacatgtacagagggaagacctgtgaggatacaggggaggatggccaagaagaagaggagaaggcttaggagggaacaaccttgccaacacttagacttccgtagaccttagactttcttagaccttagacttttttagactgtgaggaaatacatttctgttgtttaactccccgtcctccacccctccaaccatggtattttgttatggcagccctagaaaactaatacaaaaagyattttctcttcatcatcaagaatcatcagaaatctctaagcaaataattaagtctttccctatgtaaaaattcctgttctcagagaaatgggagaaaacaaaacataataggtagttcatgatgacagacagacttagtgaagatgagttctcttagaattctgggaggtgaggttgaaggtgtggtctaatctgtgagctggtgtcttactgccaacacatcagaccagcagtgggcactttggtggtggttgtgagcagccagcgctgtttgttggttatagagaaagggtgacatccagtggctggttctatcagccaagctcctggacactgactcagggtgcatgccagatggcagagaagggtcttcaggaacatggatgaatcttatgtccagttcagttcctggcaggtgacaatgaaacttgggcaaaatgcagtgatcactctatgtcctaaaacatagggagtggggtccatgcattgttattaaaacattgagaatacactgatagcaaagagaagcactataaattaacttaatcttcaatacaccttacacttgattctctctatcccgtagaaaagactcaaaaatgatttatgaaaggaggaaaaaaaccctctgaacacatataatactatagagccagctactttgataatagaatacggttacaatatataaggtatcctactttaaagatagatattgataatagwtaatagataaatagatagataggtgatagayagataatgtagtttagtttaaacttaaagtttaacttgtagtacccagttagtaatatcaagaatggcttaaaatgacacagctgcaaaccctacatacatcaagttgcccagctcttagataatattgttttactttatattatctactttaatattgtttttctttatttattaatatagaaaataatattgttttctaatagcttttgctttgttttggtttgggtttttttttttttaatctttgggagaagctaggctttgaaactgtggatatttaaatagagtctgtcatgatcagctggggttgctaaccctcaccgcaaatattctttacaaagcagaagggatgctccctgcctttgaataatttacatatctatatataatttttaaaatattaaaactaaagatataccaatgtcacatccatgtatgcattatatgtacatttggaagacatgtgcttttttgtggcagatgtaatgactgcacttctcattctactcaaatagagtacctaggagacaatgtgagaccctgaacacattttagcagatctggggttggttgtttcctcttcatgtggaacagtataaataaagctagaagtgatcctgagaactatgcatgaaatagatgtctggggcccctttcatgacctcactagcctattgttaaagccaccttagcatctgatacttcccccttgccacacttgatcccatagattgcgtatgcagtgatatgagtgctgcaccaaagcaaagatcaagtctaattcattcaacagtgtatgtctattgtcttaaacagttcaagacacacagcaggtgtttmataaacacatgctgaccctggaaagccatgagtaaaattgacaagtgggacaagagaaagattagataagaatgggaaaatagctgggaaatgggaagattatattcattatatgttaccattcaaacattgaaaaggttaaataatcttcagaatgacatcaattaaactttacataagactaaagtctaaagggaagaaagggtaatattagaaagtaaacaagaaatttgctccctggagcacaaatatgttaatggtttctcctggaattgagcaatgtggcaacccaatcagaaatggcttcatgaaggtgggtcataagtggagccttgtgggatctgaataaattgagagaagaagaaactatattccccaaaatgatcagaatgtagaaaattttctggcagcaaaaatgagtagggcatatttaaaagacttctctgaactagaggatattaaagaataatagaagttaagatcagaaggtctattgggaccacattgtagatagctacttctaagctatgatgttcaaactttgaactgtgagcagtgacttgttgaaagaactttaaggaatatcaatttggcactaatgtacaggataagttagaggaatcaggaaacaaagagatcaatcaagaagctgctgcagggctacagtaaccaaaacagcatggctttggtacaaaaacagacacacagaccgatggaacaaaatagtgaactcagaaataagactgcacacttacaactatctgatctttgacaaacctaacaacaacaacaaaaaagcaatggggaaaggattcattccctagtcagtcaatggtgctgggataactcactagccatatgcagaagattaaaactgggcccttttcttgcaccatatacaaaaattaactcaagatggattaaggacttaaatgtaaaatgcaaaactgtgaaaaccaaagaagacaacctaggcaacaccatttagggcaatgtcaacaaaggcaaagattttcatgacaaagatgccaaaagcagttgcaacaaaagcaaagattgacaaataggatctaattaaacttaagagcttctgcacagcaaaagaaactattaacagagtaaacaggcaacctagacaatgggagataatttttgtaaactatacattcaacagaggtctaatatctagcagctataaggaacttaaaaaatttaccaaaaaaaaacctcaacgccattaaaaagtgggcaaaggatatggacagatactttttttttttttttgagacagagtctcgctctgtcaccaggctggagtgcagtggtgcaatctcagctcactgcaatctccgcctcctgggttcaagcgattctcctgcctcaacctcctgagtagctgggattatgggcatgtgccaccacacccagctaatttttgtatttttagtagaaacagggttttcccatgttgtccaggatggtcttgatctcctgaccttgtgatccacccgcctcagcctcccaaagtgctaggattacaggcttgagccaccgcgcccggccaacacttttaaaaagaaggcatacatgcaccaacaatcatatgaaaaaaaggctcaacatcactgatcattagagaaatgcaaatcaaaaccacaatgagataccatctaataccagtcagagtggctattactaaaaagtaaaaaataacagatgctggcaaggttgtggagaaaaaggaatgcttatacactgttggtgggagtgtaaattagttcaatcattgtggaagacagagtgacaattcctcaaagacctaaagacagaaatgccatttgactcagcaatcccattaccacagggattacaaattgttctactataaagacacatgcaggtgtatattcattgcagcactattcacaatagcaaagacatggaatcaacctaaatgcccatctatgatagactggttaaagaaatatggtacatatacaccatagaataccatgcagccataaaaaagaatgagatcatgtcctttgcaggaacatggatggagctggaggccattatcctcagcaaactaatacaggaaaggaaaaccaaataccacatgttctcacttattaagtagttgccaaatgatgagaactcatggacacacagaggggaagaacggacactgaggtctttcagagggtgaagggtaggaggagggagaggatcaggaaaaataattaatgggtactaggcttaattaatacctggtgatgaaataatccgtgcaacaaatccccatgatacaggtgacctatgtaacaaacctgcacatgtacctgtgaactcaaaagtaaaatacaaaataaaaccacaaaaaagcagctattgtagcaatcgaggtgtgaatgcacatggatttgaaatatgatattggcagtgaaaatagtaaatttgatgtaagtgcaatatatagacataatttaaggaagaatgaataggatataacaattatttggctaagtaattaaatatggctaacgcttagtgtctgggaaggaaaatttaggacaaggagccagttggggacatagagtaatactgactttgaggacataacgaaaaaaactcaaagtgagaatattcagtagacattaggagacaggactggaattcaaactgaaggtcagtcatagaaatgcaaaattaaggttatgaagtcatcaaaaagaatgagatctccatagaccaaaaagracatgtactgaattttaagggatacctttattcaagggaagttggaaaggagagccagagaaaaatgaaagcatagtaggctttattgattcaattgctggtttggctctttgcttatataaacattcatttaattatttatcttatcccagctgctgaatcaattacctagtaatattaaccacttaactaaaaatcaacaagtctgtaaactctctaagcttctttaaaaactattttacatctgtgttatgtggagacaaaagtatcaaatttggaatctaaaacccagggcttaaatgctggcagtcacttcctaagtgtatatctttagattggacaagtttagattgggcaatttaaattctaaaatcagaggcttcagctctaaaatgagaatgaaagatactccatattttttaataattaaatgagataatacagttaaaggaactacgtcagccctctgctatataccatgctagtccctgactctttcctgcttttttagaaaatgcaacaattgaaagtctactattcgatatatgtatgacactcatgtattcatttagtctttgagtttctatcgtgatcaggcacagctctgatgctgagaatacggtagaaaaaaagacaacatccagtcttcctgaggccagagactagtggaacaaagcctagtggaagaaacagtgaactgaaaatacatagaaattcaggcagtgataaactctttgaagtaaaatagagcagaataagagaawggcaagatcagtttgggaaggctctatttcagatgtagcactcaagggacatacaacttaactgaaatgagtgagtgagagagagagagagacaaagacaaagagagagcagggggagcatgctatggcaagacgcttggggagggaaagcatgtggggtggacagcaagtgtaagaaccgtgaggtggccatgagtagcaagcgcgaggatcattaggaagatggacatgtgtggctgatgaggcacgcgcacgaaatagaggcagagttgtcagcagtgggaaggccatgcaggtgcatgggctgtgggaagacactggagctcttagagcaaggagccgtctgcttcggaggaacgttagagttcctaaattcagttaatgaaatgcttgttaaacccctgcattgtgcttctccgtgcccctgatctccccttccccatagcctgtgtatcagtgctgtgtgatgagttctgttctgggtgaactgcacaaagacccttcaaagtttgaagggagtgggaaaaatcagttttaaaggtttaataagggtttcttaaagaaaaataataaagacatgtcaagtgcaccacccctttccccacctgacttcaaacaaagagaaaatcccaccatgtgtcattatacactgtcatttagacaaagacactgaccatgacaagtcaacagtggagatttggacttcatgttgaagaataaaagtagcaaagactttaagttgtagattggcatctttagattgacattggcatagtgacttcattttttaaatgctgccagaatttcttagaaaaaaaagttagagcatatggtgattcacaagtgcctggtggaaaattataaaatcagcagcagtatttctggctgctgagatcctgtgaaccacaactaccttcaaaagatagagggtagcaaaggaagcaagggtgcctttctaactccacacagtttgtagtattttacaacttgtttccctttagcaagtactggcagttctatcaatccaacaagtggggaaccttattaataattatttattttagccatatctcaactttaaatagtaaatattgtaccaccaccagtgtatcctttccagatacccaaactgatgctcagggatattaagtgaattgcccagtgccagtcagttaagaagtagctgaatcaaaatccgaatgtgcgaccatcaggtttcagagtctatgcccttgatactttaccatagaaccacagagaagggaggtttttcaaggcatgatacttgctgaaaataaaaagatacaactttaaatttgtccaagaaaaaattactaaagaaacacatagcccatgcagtttctctaagagattctacatgacattattgtttgctagaaagtagggtgctagttgttgcttttgtaaatataatagtcaaatcatgttaccattaggacacattaaaaatgtcgaattaccttgggaccttatatgaacatattaagataataatgatagtgttcagtgcaatattcagatcaatagtttaaacccaaaatatttataccttcagattagatgtatgcaaatgcattgattcatgtgtcttttatctgttgtttacatttggagaaatatttgagaaatatttcaaaatggaatttatataaatttaaacacataatggttttatgtaaaaatattgctaaattacattttccccttaattcttatttcttggaaacgtgccttagtcgctgaaatattcatacattaacacaatgaaagaagtgaaccttactaggctttgactatcaggtttgctgttggtttttgactattgtgaaactatagcctgatttctaaatcaggaagaaacgtgtattgttgttaatatggacacatgacatatttgtctgcctgacttttgatcccagctacaacctctggccttttcaaatgattctttaatatcacataaagggaggtgagataactaaagggggtgattccggactaggaggcaagggagggcagataacatggtgctttgaaatcttctgtgacttttcagtcacttatttcattaagtgatatatctcactagaagtgaggtagaacataacaaatccatgtttgctgggcatatgttatgacaacagagaaattcacagactggtcttacccggcaggggagatggcatgatcatgaaaatggtttttcscagggtgagcttacccattgcattctgatgtgctgatttccgtgatttccccaaatgtgggaaactcactcggctgcataattggtggtagtgggggctgtgttatgctctctccttgatgtcagttttttttttttctaaaagcaaacaaaaacaattggcttcagacattttgaacaaaacaagyagaagctgttttctttaagaaattacaagcagtgtctatctatagatacatacatagtcacacatgctcataaaaacacacaaccacagcaaaattcatgctgtaatctataaacactttttagaaamggggagaggttgtgtgggcctaaagagccaggtggggcagaacctaaaaggaccttgagaatgacaaacatttgaccatgggaagcaggacaggagaaggatgttacagccagtgaccatagcataggtaaaagcaaaacaggtaccaaggagcacactgtacagaccattcagcaaggagcccagcctgactgccaggaagaggctgcctgcaggaatggtgtggaagaccatcagctgcagactgaggcaaggcgatggaggtttaggcttgcttcaataggtgagctacttayacaaggagaaccatgatgaaccatgatggaagtggtgttgcaacattcacatggtgtgggttgtactgggaagagatggacaatagkgtggcttagcgatggcaacgggcatctttagatgagaagaatgtacrtgagatttcgaaaaaaatgatcaacagaattgaactgtattgagcactaagctagtataggcagacagttccaactgggtaaaataacattataaccacttcttaagtaaataatttggcagccggactttcctttgcctcaytgactgaagcaagcatcccagacatttgatttaccaggcactctcacgaagtacctcaaggatgtgcttccgagcatatgttttatcacagtttcattacagtgtgcatatagattcttcccctctgggttttattttattttattttgagatggagtcttgctcttgtcacccaggctggagtgcaatggtgcgatctcggctcactgcaacctccacctcctgggttcaagcgattctcctaccctagcctcccgactagctggaattacaggtgcctctcaccatgcccaactaattttttcgcatttttaatagagatggggtttcaccatgttggtcaggctggtctcaaactcctgacctcgggtgatccacccgcctcggcattttggggtttaaaggaagtttaaaatctctctctaaccttgagattaaattaatgttattttagattcaaaactttctcctgcacatagcagataattaatgtaattgaaagagatttgattcccagatgttgatgcatctgtgatcccaaaggcttccctcggggagtcattctcatttgcagttagagacacaatggaaggacagcctcaaagcaggcaaacagtgtcagttaaattcagatgtcaaacctgggttttggtgacagccctggaactctcacatcagcttctgaattttgcaaattatgatattaccaagactgctcaacaaaggctggcatcttaataaaaggccattcttaattgctcttcctccgttactcactagtgacagaatacaaccttcttataacaaaagaagtttgcactgactcccatccagagaaatctaggtagaataggggctacaaaacaatggtactcagggccaggaatttagaagttagatgaaaagttaagacaaatactaaatacctgccaaaggccccactgtctaataccatcccctttgagatgactatttcaacatatgaattttgggggaataaagcagtcagatgatagtactatacaaagcttgaaaaggtacaacacttcgccttttgaaacatctataactagaagccaaataacaaaggtctttgggagttgattaggtcatgagggtgacacctgcatgaatgggattaacaacttcattttaaaaaaggcctgagagacaacccttgccctttccaccctgtgaagacacaaaaagaaggcattgactatgaaatggaaaccctcaccaaaaactgaatttgccagggccttgaacttgaacttcccagcctccagaactgtgagaaataaatttctgttgtttagaagccacccagttcatggtattttgaatgtacaaagaataccgaatgtactaagacagtattgcacataaattaccaggagacacagaagagtagctatagaacatgcttcatgcgaccagatctcagcaatgagatgtgctgtggaagaaccatgsgttttgttctgcagctgggattttcttatgctcttcttgcctttcagtgactctagctggagctgtggtcttctccattttgaaggagacaccctcgaaggctgccttttgccagctgagatctgacactgatttgtataaattgagaggggatttagtctattgtcccagaactgaggatggagtccctgaatggcaagcttcagatgaaaatacagtctgatgattatccatgtgtgccctgtacgctgccttgagaaatgcatcctaatgatgatggcttcaagttaaggtggtcatcataacaccaggtaattttcattttggcgtttcacggaacatctacctttccagaggacagttctaaattttaatagcttcacgttctggctgattagctgacaaatgaagttaaataaccagctttcactcagagagatgatgcagaaagaaagctgccctctgatatccccactgataataatgtgaagtgtggaaggcctcagatgtcttttctggatacctatgtgtaatkttcatctatattaatggaactcgtaagcgcaccacgtgaataagaaaatgaatctgtagaaggtagtccctgttgactaggctggttttgaatttcagaaagttgtgtaacgcttccatgaatttttctttatcttggaaaaacattgccatgcaatgtattttataattactttcagaaatacagcgtttctaattgagaagtttgtgaacgtggcctgaacattctagctcatgtgcgtaattgatagcaatgaattattttacaaggtaaagatgtttcccccttggctcaataactattaatatcaaatgaaagcacacactggcatcagggggaacacagcctcctcacccttccaatttcatttcacattacctgccaacttccaggaaatcctttaggcatcattacactttttccctaggccccctatcctcccttaagacctccactctgctatactaacctgcacagggacagggaaataactctaagtgcatctcttttctttcctaagatatgttgcttaaatgtaagggaaagctacttggcaactctaacacacacacacacactcaccccagaaattctcggctcttcacaagagtgtgttttctccttatggaagagttgatgtggttccatttataaaaatagcagctatttaaatgggaaaagctttttctcatatcatctgtgggccaaatgtttttctaaaaacatacattctctttttctagcagagaagacaaattctaaatggattcaaggttcatcaaattgctaagttttctttgggttaatgcatttgacaaccaagttcacagaagtgccaaaatgaaaataagtaaattaagaactgttctatctaatttctttattagaacacacatttttgtgtgtttttcatgtgtrtgcattatatttataaactgatgtgattaatatataaactgtgttaatctgcaattatttttatttcctacatagaattttatatggtgatttttaggaagttggaacacatagtccatataaattgtttcttaagctctgctttctctacttcagggaagcaaaaagagaagttcatatctcttctttccaatccttttttttttttttttttgagatggagtttcattcgtgttgcccaggctggagggcaatggcacaatctcggctcactggctaatttttgtatttttagtagagacacggtttcaccatgttggccagtctggttttgaactcctgacctcatgtgatcctcctgcctcagcctcccaaagtgctgggattacaggcatgagccaccgtgcctggccctttccaatcctttttaagctcatgtattcatcaccaccttcataagttccaatttctctagcttatattcagctgaatatgaccttgaaattcaaagattcactctttatccaatgcaagattctgtctatcatgcatattcactgctgtttaaacatttccactagtgatgacatcagactatgcaggggatggggtggtgtaggggttgtggtaggcagggcttctaaaccagcaagactaccttcattcctytggccgtattaaatacctataagagctaacgaaagcattgagattgctatggatgaattggttcaagattagttcattatccctgtccgcctctagcaccaaggctgctctaggctttaagcctcccagtgaaagactctggatctcgactggtttccaagggtagasagaaaattacaggatacattctaattattaatattacagatgttgtccttacattgagacacatctgcctggacagtggtcaccatctgctcctctggaactacatacaaaaatgggtccaatcccttaaataaaatagttcttcaaatatttggagacagctctgttctgctaatcttagctttttcagactgagttgtatcaaattctctaagtattattggtagcatttctcaatgacagtagcaattgcttatgttaccacagcactttggagtttccaaaacactttcacaactgtaggttcttaattttataaatgagaaaactggggctcagagaggataagttacattaccttaataattgatttaacaagtactaatggagtgtctactgtatgcttggcacagcgcaaaatcctaggatataggagataatacatcaagaatggtgccccccttctagctcttatgatctagtatgggaggaatacatttttaaaaattacagatgatacccagataatactcacacctggttgggactttagcccaagtcttctgtctctaaaccaaattaacagaccattaacttcagtacagcagacactgcacttggattcatgaaacccacttaagctagtctttctgcaactagctgtcctggtacaagctcttcttaagatgtaccttcttcattccataactaaatgtgtgaggagtctgtgcatgtgtggttaactcagaggagaactctacactgatttctataaaattgtattttgccattttctttctacctctctaagttgccaaccttcttttgaactcttattttatcatttctcacacattagatcttcctctcagtttctgtccatctgcaagttttatgaaattgtgttcacctatatcactgacaagaaaaaaaaaatgcccacaagtgcttggtgtgaaagaaagagcacacatttgtcattagtcgcagattagatttcctattagctaagtgaccttgggcagataacatcctctcccagagcaactgattactcatctgtgaaatgaggaaatcaggctggagaatttctgagggatttccctgcattaaaagttttataattcaatatgttttaaaatgcgaggctgagttttaaaattctttccttctgagtgtggagagaagaaaatgcagaatatgtctactgatatttactgataggcatcacctcctgcttcactaaaggaaggaaatacatcagcaaacattggtgcaaaattcatacaacaggggccacttaagcagaatagctaccacacctttccttaatcaaaaacaatggcttcatgaagtccctgatagtccatttgctatctatatattttttatgtttagaaatcaacagagtaaattgattataaataactaagccaaataaatgattaaaaatagttcataatttggagtcttcagtgagtcctctttttctgctctgtgtaggaaaattatctttgattctataagtggtagccttcaaatgcttcttccaaacatttgcctaataaaagagaatccttattttctaaccttaacagaacgccagaaattattttagtctttgaacttgaagaatttgtgggatcttctttcttaacattgcttcattgccacataatgtatctgtttaattcagccttatttgggttgcaatatgtgctataatttattcctgtcgttttaaacttaccaattagagtgaattcaaatttaattaatagaaaatttcgcccacatttaactagagataaatgagaagtaattatagaaaccaaagcttttctagcctgagagaaaagaaaataaagagagcacccaacccaagacataattaatcatctcttctacatggaaagtctgtcctgatactatagtttaaagacagactgtctaaaatgcatgtctatgtaaaggcatgttgcaactattttatttttccattcagagacgatttgctattaattatatgaaaccccgtggtggcttaattagcaggcaacaatggattggcttttagattgtgcagttagaaaattctggcacttttcagcttttaactttaaagctagaatttatttttgtctttgaacttgagttatttgtgggttcttcttttttaatattgcttcattgtcacataatgtatatgtgacataacataactatagccaaattttctctggtctaggaagcctccccaatgtcctcctgaacacaataattcatgtcttatttcaacaatgccttttctttcctgtgaatgtgaatggctgttgtatttgaatatattacttatgtattttattgaaatgtatcaagagcagacagaaaataacatctgtttgacaacattgttttatacatgtatatgggctggaaaggtggtacaagtacttaacttgagagtttgtctaaactctcaaatttaagagaaaaattttaatccctctcctttaaagtatgtatatttttatttcaaaaatcattaaaatgtgtttcaaaaaaaaggaatctaaaaccaagtatgcagaatccctagaattccacacaactcaagttgaaaaaacttcggaaagttttacctaaaaatgttttcagcccatttcctgaattcatagatcagaaaatcaggctgtaatttatctatgggccagattaatattcaatattacaacaaccctgattgagtaagcatccagatgtgtatttgcctgaagtctaaaatttactacaagtataattttattgaagctgtcaatgccatatttaaagtgttcattttagttgtgtgcacagacttactactcaacaaaattgggccacatgagtgataataatctactaatgctttaatcctgatttttagcctagccataatgaggagaaatcttttctcaggtcaatacttgggtgggggggcatttttcacattgacgattaaagccttgtaacatgttaaattaacctttcatcatgtgtctcattagcctcaatgtatttgccaaagctttcttctactctctttgtggatgtagagatagaatgctaccacactgctaatgaaatacggtgccaagtggagctaacactgtaggggcttgaatctttccatgggaaagaatatgaagatccatgctgatttgcaccaaacatccttctgcactacagcccccatgctaagatatttaagcattaagcatcctctacaatatcttagatcaattaactcaacattgattttactagattgaaaatattcacacagttttaatttaatttagtatagtttaatataatttaatatagtttaatataattttaaatctgtgtgttttgtttgtttaatatagttttaaatctgtgcattttgttactatttgttgtatatttcctcaataagttagttccttgatagttctatgtcattctttgatttaaataatgttcctagaacactgcagtagatatttgagtactatygattaggttgtttakaaatgcagtgtgttctgtccatttgctccaaattaacaattttttgaaaagcatcaggtttagtatcttactattatgctaacccattttagcttttgtagtttcttacttggtatttttcactatgcactttaacaggaattactcattgatatataattgacatttctttcttgttctgtagttacagaaatgtcatacaagaaaagaaaacaattagatgactgttttgtcttattaataatttaagtactttcaaccctgagctgagataataggactaatactagtatttcaggctattcttttttagtgcaatatttattttattaatcattaaatgaaatttaacctgtcattcattatccaaatgtttgttttaatgaatcccacttataaaacagtatttaatatttcagttaaaatgtttgtgttttgtagtctcactaatatatacaataaygaggtaaagataaaaatatatagcaaacatgagggaattactaacagcattaatgtaacagcacacattagcccacaatgaatggtttgtacaaaaattacagttagacccaaacaattcataagtgattcttccgttatgaatgcaggaaaatccacaggaataaaatcttgatataaatgtacttaaaaaaagacttttatgtttttacagcactcttagatgctcagaaaaagtgagatgaaggcacagagattccccttatgccccttgcccccacatgcagagtctctcctgttaccaacatcccccaccagagtggtgcatttgtgacaattgatgaacctacatgacgcatcattagcacccaaagtccatcatttacattagggtttatccttggtgttatacattctgtgggtttggacaaatatatgatgacatgtatccatgattatagtatcatacagagtattttcactgccctaaaaatcttctgtgctctgcctgttcattcttttccccaccccagttcctggcaaccactgatctttttactgtttccattgttttgccttttacagtatgtcatgcagttggaatcatgtggtatgtaggcttttaagattggctcctttcacttagtaatacacacgtaagtttattccatgtctgttcatggattgatagctcatttccttttagagatgaataayacttcattgcctggatgttccacagtttacctatccatttgcctactgaaggccatcttggttgctttcaagttttggcaaattatgaatgcagctgccatagatatttgcatgcaggttttcgtgtagacagaagtttttagcattttagggtacatatcaaggagtatgactggtggatcatgtagtaagacaatgtttagttgttatgagaaaccatcaaactgtcttctaaagtggttgtaccattttttttttattcccaccagcagtgaatgagagtttctgttgtctaatactttcttgtcagtatttgattgtgtaagttttctggatttgagcattccaaataggcgtgcagtggttgttttgatgtgcatttccctgatgacatataatgtggaacatcttttcatatgtttatgtgccatctgtatatcttctttggcaacttatctgttaaggtctttggtccatttttaaatcaacttgcattgttttttattactgggctttaagagatatttgtatatttaaaatcagatatttctattgcaaaaaaaaccttcctcycagtctgtggyttctcttcacataatgttgacagtcatttgcaaagcagaaatttttaattttagtgaagtccagtttattaattatttcttccctgaatcatgcctttggtgtcatatatgaaagtcatagcacaacctaagttcatctagattttctcataggttaccttctaggatttttataattttgcattttacatttatttacgtgatccattttaagttaatgttatgaaggacgtatgatctatgtttggatttatgttttgcatgtggacgttccagttgtcccagtaccgttagttgaaaagactactttttctttattgtattgcttttgttcctttgtcaaaggtcagttgactgtatttatgtgggtctatttctttgctctttcctgtgctccattgatctatctgtctattccttcaccaatacttcactgtcttggttatggtaactgtatagtgagtcttgaggttgggtagtgctagtcctctcactctttttctccttcaatattgtggtggatattcttggacctttgcctctccgtgtaaactttagtatcagtgtgtcaaaatccaccaactaagtcactgggattttgattgggattgaattgaatctatagatcaagttggaaataactgatatkctgacaatattgagtcttcctacccatgaagatggagtatctcttcattcatttggttcttctttgatttttccattagagccttacagttctcctcatatggaccttgaacatgttttgttagtaaatgtacttttaaacatattttcttcccactgttttatgtggacattcatcaagctttttttttgcttgattcagtcttttcagagtatgattttaaggtatgtattatttttaaaataatagatattttatcttatgtacagttagagatttccctgttgacactaaaatatttacatgttgttgatttttatgttttgcttttatgttcgttttagaaacaataatgcctactctaaattatgaaaacaatgaaatacaaatatgggcatcaaagaggaaaatgaagaagctatttcaagctgtcaagaatatactcttagctctgtattcaaaagtacttcatttgtataaaaaaattaaattcaaatccacactttaaaatttttaaaaaagtaattgtttctctcaaaatacgtatggtcaaatgaccatttttttccttctgtgtagttgcttattttagagagctttgtcccaacagggtagcagagagataatgattctactattgtctttaaattcttacccgcttctctgccagtcatcgaactactccctctactccaaaacttggtctgctctgctctaaatcaatgagatattgctatctgtctgatgcaggttacattccagtatcttatctttcccagtttgtattgcaataatattggggtaaaatattgcatgggtttacaaaagggattcagtaaaatacaagcacacatttagagcttgttcttggatttgatttgcattgtcagtttggtgccttcaggagtcatttcacattctttgcttccacatatcagcttttagtaaagctttgctctatatcggtagctttcaacctgtgctgcacttctgaaaccctagggagcttttaaaaaaagaatgatctcgtatcacaccagaccaattaaatcagaatctctggaggctggcactctggcatcagtacttaaaacagctccccaggagattctcaaaggcagcgatggtgacaaaccacagctctgtacaatagaacaggctgctcctttataattattaatcatagtgtatattaattcatcatcacatacgtggctagaaaaaaatttagaacaaaaagatatgtgatatgtraaggcctacgataattcagacttctttgaggagagcttttattttattgttattcttattttatctcttgtcaatataaattgagagaataaacagacaaacattacaaattagtgattaattgcatttaaagcctagttaagactatttaagactattatgcataatacaggaaaactacctktattatttatagtgggtgccttctgaaggatctgaaggagaatcagttctatgcctctctcctcattcccaggaggtgcctggcattccttggcttgtagacgcatcaccctaatctctacctctgccttcacatggtgtcccctgtgtgtgtgtttttgccccatgtgtctcctctttttatatggatgccagtcatgagatttaggcccaccctaaactactatgaccttatttaaagtaaacttaactaattacatctgcaaagaccacayttccacataaagtcatattcagagttccaggtagacatggatttttggaggacactcttcagcccagtactgcactcatattactcaacttctccactgcttttgatgctgttcaacactcttctgagaactccttcctcccatatcttctgtgtctattttgcctgttttgcycccttctgtcataatgcccctaacaacatattgcaagagtctgctaaataaatatctgcttcctcttattgtctgtgcaatcctggagggcagggagttgacttattcaggtctctatgtgaacaccaaccaatttttagctcatggaagcccgtagtaagaattggaaaaaaggaagagaggaagaaaaagagaaggttgtgacttctgcctccatggacatcatgaggaaacacacacgtgccttgacttgatggamctatrcaattcattttttaaaatattggcatttcatactcacatcaaatatcttgcacctgmatgatatcattccagctagtacagtttctggttataaaattgtagatgaggattaatgattattaagcccggttttccaaattattgaggctcacaattttgagaagtgtgatttccatagatttgtttaagaagtaaaaggctggccaggcacagtggctcatgcctgtaatcccagcactttgggaggccmaggtgggcagatcacctgaggtcaggrgtttgagaccagcctggccaacatggcaaaaccccgtctctactaaaagtacaaaaattagctgggtatggtggcaggtgcctgtaatcccagctactcaggaggctgagggcaggagaagcttgaacccaggtagcagaggttgcagtgagccgagatcgcaccactgtactccagcctgggcgacaaaagcgagactccgtctcaaaataaataaataaataaataaataaaataataataataataataaataaaaggcttctatatgcacagaggatttgtttcacatattgattctcttatgtggtcttcatttcacaactgtatgaatctgtagcatgaaatacatatttggcaagtaaagattctataaaggaaagagtaggaaggtataacgaaccaattctgagatttccctaagcaatcagttcacctgcttgcctccatggaggccatcattgtcttctagcacaatttgtgagagacagcaaggcatctttttaccactattaacctaatctatggcagtgttcccagggaccaatgttgtcagttgtagagtaatgccatttagaggctggatgggtttacagttgcagccaagcaagggtctgcattgaattgacccaaacagggaattttcaagtaatttctctatctttgtatgtgtgagttttttagtagtcmattcaattttcattagcttgtcaactctaatatctgacaactgaaatataaagtagggaggagaaagagcagaattaagagaaggaatatatgtgccagaggcagagtattatcattgtcctgatgtagtcatgatgacctaagtcatcctttgatattgctttcatataaaggttgtagaatatatgaaccaaatcaaaatgggacarggagagctscttgctcacaaaatgcctctgatctattgtgtgcataaagcatgactttatgacaaacacatagagactctagatgggggaagttacagtccttgagtgattttcgtattcaacccagtgggatcactatcatttagtggtatattaaaatgctaattctcatccaaggtcaaattcaactccatacaagctgttttaaaattcagaattggttgctttatgaaaagtamatttgagactatttggaaataaagactatttgaaaattttcyggcttccttaacttcagtacctcttgccattgtgtcacagcttgggtgtggtgggggaggtgcaatcttctgggtagagaccagraatcccactaagcctayatcgtatgggatagccctatgacaaagaatgacatggcccaaaaggccaatcatgccaagcttgagaaactgctcagaataagcagggagagtgaagaaacaagctgatgctcaaactagtgaatctcattttgttgttaatcgccccttttctgcaacacttgtgggttagggaaaataattctaaagcaagagcaaagacagagttgggagatcaccagtgaggttcaattttccrtcacattcactctgctccacacctcagataatcatgtgcttaactgcgmaacttgcttgacaattacagaacactttctcacccattactaccttgatcctcacaattctgtggggtagtaggagcagatgctgaaattgccatacgcaaatcagtgaactgaagcttagagacctccagcaggggcagagggtcagcggaaactatcccagggttcagccaacaagaaagtatattggaatcagagtattaaaataagaataataaaaccaactaaaatttaccgtgctttttatttccactcagtgccaacaattcttaacagtgtcagtgatggatccctgtgccccaggggacagacttcttactagcttctgccactttggtcagctgctgttctggggaggttaactttcttacttcaaattcacactagagaggaaaaggaaatgcatacatataggaccaaatttcactcctgatgtctccacacacaaagctccttcaccatgccagtctcaatctgctgctctggggaggttaagttttgtttgtttgtttgtttgttttttgagacagagtttcattcttgttgcccaggctggagtgcagtggtgcaatctcggctcactgcaacctccgcctcccaggttcaagccattctcctgcttcagcctcccaagtagctgggattacgggtgtgcatcaccacacctggctagtttttgtattttcactagagatggggtttcaccatgttggtcaggctggtctcaaactccttactctcaggtgatccacctgccttggcctcccaaagtgctgggattacaggcatgagtcaccatgcccagccaggaagttaagtttcttacctcaaattaacgctagagaggaaaaggaaatgcataaatacaggaccaaatttcactcctgatgtctccacacacaaagttccttcactatgcctgtctcaatcttgtcattaaagtggtatttccttattaggaaaaaaagaactaggtccttaaaatactgttcattccatcccatgggttgagtacattacatattgacagtggtacattccagccacctgagacaaccaatcttatgccaatcagtgctacagagagcaccccttgccttacagctggcctaaccacagctggggatgactgactggagaatgttgtgatctttgactttgtcacaggtaaaatggtgtttctaactgtaatcacaggtctctgtgctgtgcctttcacttcatcacactctattctctctaattccaaccctgccaaactcattaggccaaatttgcttacttctgtgcattctacacacttccaacaaaccctatgtttgcctttccttgtgatgataaagagaaatggcagttagtggtctgaaagatggcgtctgacctttttatgatggggctgaaggctggatgctggaggcagggtgtgtgtttggtgcagcactgatattccctatggcagtgtcagagcctgcctaaatacaacctactgactagcatgaaaatattcctctgggcaagagggaaaaatgtgacaccatgggaggtaggatttgacatgatacggatttggaaaaatgaaatgtgacaattgctaattccatacagttcaaggaaaactggcctatttcaggttcccagcaggtatttaatactgaagtgtaaagaaagrtggcaaacttacaattattttgattgaactatggttatctccattcaactaagggagcatttgcagcaatgccgatgggccagctattttggttttgccatattgtttcatttcttgacccacgttacataatcactcagaccaacaacaactgactgaattgttattatatttatatgtattacctaagtatatatttcctgttagtctttcaatggatagctcaaagcagatagagtgagaaggacaattatgcctttgcttgatttacttgaatataatgcccctgacaaaggtatttttgatataataaatgtgtgagtttcttgtttagaatcttaaactcggtccgaaggttgggattttgcacaatggggttagaagaattcactgaaacacttatccagctgaaggcatatattgccaatttcatatttgtgtcttgctatttcaaaatattgcattgccaggcaagatttactgcagcattctgtagcttaaccctctttcacataggcacacatccctccaagcttttccaaagcatgtttaacagtgctactagaaatcagacaaaatgctcctaccatttggattttggctttaccaagtttattaagtctctatcaatggagcaggctactcacggcacagcacagtacctcacatggttgctacacagatcatcaacctatactgtttagtattcagatatcaaaatcagcagaatcaaaaagggctggagttagctggttcctgtccaattctaactccctggcggcctctctcttagggactcttgtgttggtttgtgttcccagagatgggagcctttaattgtgattttaagccattagattatgaactgaataatggcagagaaatgcctacccaactgccattagtgaggacaagcgttgttttcttgataaattgtaatgtttaattttttaattgacaaatcataattgtatatattcatggagtacatagtgatgtttttatatatagtgtacagtgatcagatcaaggtaattagcctagccatcatctctaacatttattatttcttcgtgtagggaacattcaaatcctccttggtgctctttgaaactatatattattgttaactatagtcattgctgctaacttgaccaagaaacctaaataagcatttgtctatagtcgacctttctgcatgcctcagaacagtagaaggggacttgctgacagagacccacagtcacgtggggtccaagttttgaactttcccctgactggccaagtgacaggcagcagtcactgtggtctttaaaataccccaaaatacaacatagattgtggtataactttctcatctgagttttccaactagcaagaaaatctctawstatgtgtgtcattatgtctcatttttcctcatttttaggcagtatataagttaaagaatctggtttgtgttttctcctgcatattctgtgatttatttgaaggttcgcaaattatataaagctaaaagttatttttacatgtaaactacatagaatcacatagcattattttgttgttttactatgacaaatgtctctaatttaaggcattgggccttataacctttgttagtaaatggaattggagaagaagtgtgcctaattaatattttggtttgaaaagtaagattactgtattagaattttatccaaggattaaatttttaatagggkatttaggtgaagtaatactttttttttcatccttcaagagagtaattaattctacaaaatattaagcctgctgactttgaatatttttaaatgctttagatttattagacaaatgctcattgtctacctgttgtaggctactctaggacttacattccagtggaagaagacagatcataaacaaataagtttcaaaaatcagtgggtattgggaagagaaaaataaagtaatggaagcaagacggggaataccagggaggctggaaggaattaaagaaaatactatatcaggtgatcagcatgcaatagatgctcagtaagcacttgttaccatttgaatgagtacatggatggatgaggtggttggttaaggcaatttcagagtatcacatgccaaaagcagtttaagggatggggagccactgacggcttttgatcaagggaacagcatgaacagttctttgagcacgtgaaacactggaaagccattttcaaagtgcactttatgcttactttwcatcgattttgttgccactttaactctccctgcgacagtctttgtgactctgaaaattatcatgtgaataggcatcatttaacaataggtattgatagggtgaatattaagtcaccaaataagtgaaggtcttagacaaaagcctttttaatagagggtgaaagctagacaggaagcagtgaacgtagagtaagccccaaatagatatattttatttcccagactctaggaactgaaatgctttcaaagaatctgataggaatagtcttgcctttcattctcacgtactggttcatatttcactcaggtttgtttccatcaaaaatagttccatctaaggatactttgttaccctatgttgtatgaaaaagtggattttctctttagttgctagtactgtattctgtgcggaaaagaccattggagtcacccctattttttgcaggctcargggttggtattagatgaagaaacacaagatttctctgtcagttgggaaatcctttttcytcttaggagtttattaggttttttagctgccactaagtttagcttataagaagagagggaaacagcctctgaaacttccaggctgatcctttcatttatctaaattccatttctacctctgcagaaaagggctagataacaaatctgatcctcttttctctacagtaatagctcccacccaaagactattataaggctaaataggacaggatcttaaggactgagaagtgccatagagarcattgcctcctccctcttaattttacagctgagcaaactgaagcccaaaagattaagttattttcccaggagtcacatcagtaagaaggtcatatgtaaaattaaaataggtgagacagttattcattgaatgatgtgaacctgtctttccaacctagggatcagatgttaagaatcgtaacaatgggtcggaagggtaatgggcactcagagaatctgtatgaatcccaggcaaccaagctactatgggagagaagagaaatagcccagccagatacagtctgcatgggctgcaccactggccccacctccgctaactgcttattgcccactgatgcrttatgatctttagccatcctgatcactcttggattcatcactgcattctctactccatcccaggttccctaatacatgtacatatatatgtgcctcaccccctcaagattcagactcccagttgagagcatctcattggccacatgacatcatctacggttccctaattgctggggttagtggaaggggacagaaaagttagggataggctcttacctctcacctgtcttgtgactctacccaaatcaacgtgtgtttggatgcagaattgtcaaaatgacaatactcacgataactctgtgcagtagtagctctgttctgcacttgactcagaaagcagtcatagtcagagctctggcatgctctaaaccaagatttggttggaaatttgatctctcatggaaaaggtgcttttgttattgttgttttctcatggaagaagcaaccaaacatctgttgaatctttaagtcagattgtctcaaagcatgttggaaacaacacctacatcagaatcatctagggtgcttattagagcagatacctcatccctcaacccagaactgctgatttgaaattcatggggcccagatacaaatgcacactgaattgtgaggactgctgatctatactcagtcactacatatgttcctgtaggatgttacatcctttcatggactttttcgatttsttgccaaccacatagagaactagaaagttaggtcaagaaataagagaaartattaggtttagatttctgggtgccaagcaagccctgcaattatttagttattgtgtctttatggttactgtatctttattgttactaggtccacatagttaccatgttatgctctacaagggcagaagagtaaaatatattaagctactagcaagtgctcatcatactcacactgaaggaatttgctagcaaaagccatatttgcattctaacttggtgcagtgatttacaaagtgtggtccctagacaaacagcatcagcatcacctgggaacttgttagaaatgcaaactcgctcctactctgtccccagacttacattttaactagctttctgggtgattctgatgcatgctaaagttagaactgctgctctcagcttccatttccttgtctgaataaaacaatgataattgatccttcatagtttttctttagattattttctgttgtcattataaaactaagataatgtacaaaaaggcacttagttcaaggtaagtgttcaataaatagtaagcatattattgagcttatatttaatttacaaacactgctcttattttctaattgtttaacttcaagagaatccacaggttgcctacaatataagcagtcatgttagatgttttatatatataagttctaaatgggatgcagaagttctaaaattgtgatacttaaccaggaaaatggcagatttttattcttccattttagaaattaggaccaggctacttacttttctactgtcatttaaatccactttaaggtattcacaatgactttaacatgacattaataagcttagtgggtctttgaatttcttaatcccagtttcctggggctaaatacaataatctgtatctcttcatctttgacacgctgataaaaatccctgaacctggatttgcatttggttttcaaaatcaatcattttgctattcaaaggcaaggcaattgagtgaggtttgagattgaaatacatatcaaccccactagagggtgacctttatctaaatcagggtgcatataaagtaagggcatcttctgtagccatctcataaaattggattgtataactgtttactcaaggtgaaggagaggctgagaagtgattcttacatgaataattaataactttcaatttctaaataatctattagtcttgtgggaatatttaaaaccaagctattgcaaatttctcagtttgtattttaggataaaattccttattaataaattcagctctgaattttaaaattatctgcttcaattccaattcaaaatatattccccccttttctcccaaaagacacacacaactaaacatatgagaaaatagaaccccaaatttgtttcataaaaacaagcaaacaaaaggctataggactttgttaagttttatatggtgatttagaaataagacaaacatattctctagataccaaaggagaaaaagaaaatccaaatgttcacatagtaattagagagctcagtttaggtcaaccttaagaaattaatgttgaacaccatatttggtttatcttttatagttcagatttagaaagtaaaacatttgtgttataactcctctgctaaaatctctcggtttgatatcagagttcaatgttattcttaaaaccacctcaataaatatttttttgtagtacttaaaatttcaactcaaaatttgcaacactatgaatacaagtaatatttatgtattctgagcactttttatactaacttaattttttaaaatttgatctttaataattattgacagaaaaaatctgggctcaggatagtgccaattgtatgaaaatatgtagattcaactgttatttgcttcttttctaggacagttttttgtttgtttgtttgtttgttttttgtttttttgktggtggaggaaggagtcttgctctgtcacccaggctggagtgcagtggcacgatctcagctcatggcaacctccgcctcctggattcaagcagttctcctgcctcagcctccccagtagctgggattacaggcatgtgccaccgcacccggctaatttttgtatttttagyagagacggggtttcaccatgttggccaggatgatctcaatctcctgacctcgtgatccgcccacctcagcctcccaaagtgctgggattacaggcgtgagccaccgtgcctggctttaagactattttaaagagtgtttctagaacactgaatggttatcttacaaataaaaaaaacaactaaactcatgcaaaacaagactacggcaattaaacttggattctcaggtacaaatgactttcatttttatctacctctacaagccagaaaaatagcatattataaaaatgcatttctattaaaacacaaagaaaggttttatgtggcatgaattagtctaaaataaatttttaactttaatctaagttcataaggagatattaactttggaaaaaggtaagtctttgaaggatgggtggctttatcattattgtatttttgaaggaaggttgcagtctgaattgaaacctttcttccaagaaaattcagcctgctgtgctctcgtactaaaatagtatctgtaacaatggcatatgatttttatatagaattgggaagagctacactaataacttttacaatctctcttgttcatgtattatttacctgagaatagctactcctgtctttaagattaggtactttttccattaattaaaaaactcccattttaaaactatagaagacgttcttgaaaagtgtatgtgggttgagaataagcatatactcttatcactaacccagcctaaagctgacatggggctaaactttcctttgcaaattagagttgaaagagaaaaaatgcaattcaattacttcatgaggaagccactcagactttcccaccagttgcagactaatcagatgacaaatatgcctaattgtttgtcaactgataagatatgacagtcctgtccatgtggagaacagcaattcaggcagtttcttcaattctctctccagtttgagatcaaattaccccaatttttctgaattccttgaaaatttgatctgatttatttttagccaactcttttgatcattattttttatttactcattttttttggaagagacggggtattactctgtcacctggagtgcagcggtgtgatcatacctcactgcaaactgaaactccgaggtgcaagcaatcctcctgattcagcctcccaaagtgctgggattacaggcrtgaaacaccatgcctcgcctctggttcttcatgtgtaacgtaaagtttaagaggcaattgacagacataaagaaaattgggaaagaatatacaaggattaagagggtgggtagtgtgaagtgagaattattttattcttatgttatgcatctttgtgaaaaaacgtagctaacgtgagctattctaagtatttctagaatgtcttctctgcattcttttgaactaaactcaaaagtaattttaacccaaagtttgatatttccagacattgttatgattactatatcacatatagtaatgtttctgtagtatttgtttgtataagtttatatgtacatacttagatatttactccttcctgttttcttscaacaatgttgatatgccgtataagttcttaggcaaaaagatatgwcatttaacttccatttctgttaggaagtgtattctacttagcattttaaccctagtttacagttaaatgagaaccgagaactgattttttctccaagtttaataactgtcatcttcctcttcatcattattatgagtattttggattttcagattctccatttatagaatggaaatcacaggaactgttcaactatttttgttaagaaattattattatttttttctttttgttatggagtcttacttcgtcacccaggctggggtgcagtggtgtgatctcgggtcactgcaatctccgcctcccaggttcaagcaattctcccgcctcagcctcctaagtagctgggactacaggtgcatgccactacgctcggctgagttttgtatttttagtaaagatgaggttgcaccatgttggccaggctggtcttgaactcctgacctcaggcgatccacctgcttcaccctcccaaagtgctgggattacaggtgtgagccactgcacctggccatttgttattgttaaaatgaaggtatactctagtgatatggcttaaacacattagaaacactgacaaagatagagcaacagggaaagatactgtctgagcagagctctgtgataactcttggcaacaaagaagaagctggcttttctctacttttttattaaggcaggaggaaacacacatgggtggatggctcctttgtccataccatctgcactgaaacagtgaccatgcggcaccctggatcagcccctaggagccccagcagctgaggagcttcagggagccagagaaacagcctaggagacacctaatccaactccaaactaggaagatgacaacattcatcctcaaaacattcttaagagtaatctagctagcacgaaaaggcaaagaaatggctattccaggcacgcgggcatacgtggtctccagatttggccgctttcttactttgttttctattttgttttgtttttgtttttttcatgggcagtgttcaatggcctcatctggctactttcttcaaacataggtctccttgcctggcatttaaaggatgttttttgagcttttactcaataacgagtaccagaaactctcctacactgttgagataaacaaggaaattttttttttttttttgagacggagttttgctcttgttgcccaggctggagtgcaatggctccatctcagctcactgcaacctgcgtctcccgggttcaagtaattctcctgcttcagcctctgcagtagccgggattacaggcatgcgccaccacgcccagctgatttttatttttagtagagacggggtttctccatgttgatcaggctggtctccaattcctgacctcaggtgatgcgcctgcctcagcctcccaaagtgctgggattacaggcgtgagccatcgcgcctggccaacaaggaaattttaataagaaaaatattggtttaaattacattttcaatgacaacaataaaaatttgcaaaccacaaaatccaaaaaagcaaatcaatatttaggaacaaaatactttaagactttaagttgagaaggtggaactaaaatagaatttaggtcttcttttaccaccattcaaattacagaccgtgtgtgtgtgtgtgtgtgtgtgtgtgtgtctgtctgtgtgtgtctgtgtgtgtgtgtatttgatcatatataatatatggaatgtggtattactgaattgcatttgcatgtcatattttttaattgggtcataccattaaatatatatcacttatatatttaaaatgttgcaagagaaagataaatttaccttaattccaaaagaattccttcatcctcactaacagaacctgcttttattagggggtcatatgtcctaattctggaagttgatgtttggttaaaggctactaaacaattatcaaaccataattaaactgtgattaatacatttcactttttatatctgtcatagcagccccacttcgcttatccagtgattagtctaggtgtggttatgtgcccctggttctgaacattaagataaataatattttttagaaagctgctgagaaactattttctttttccaaaaagatagccattttttggccctgccctcttctagcctacttgggatgctgttctatgaaaatataatgtttggagctagagcaaccattatgtgcgagaacgtcatcaataacttagaatggcagaagggaaaaaatagagagaacatgagttcctgatgaactcagaggcactgatctaacactagaagcaccaaggtttagagactttctgtatgaaaggggctcactttccactgcgtaagccamtgcagtttgggaaatcccaaattcagctacaattcccttgttgctaaaagcattctgaaatgatacagagactgactttgccaagtactttcatttaatatcatcattcataatattatttttagtttaatatcatcattcacaatattaagacttgtttgtattttatacatgtagattactgttcttttgtattttatgcaactgattaaaatttgtatagaatatgttaaaaattcatttacatcaaattctaactatttcattcttctctggtcaacagtgcattagactgttgaaaagataaagatgatataaacatgtttttgatgttatttctagtgaagcaaaaacaagtacttcatatttctatttttctctttaatggttgatatttctttacttacagacttcatttaaaatgtgcccattcatatttactgataggagttaaagtgtatcaaaggtgataattaaaagtgaaataaaatatatggtgtagaatgctgtttaatctgtttcacaattgagttattttaatgaatcaacatgaatattatgttacctctatagatcagatagaaaaaaaaattctccacagtagtctctgcaaatctcatattctcacaggtatgtgtccaaggatggagttggtttttttgtttgtttgtttgtttttgttttgttttgtttttttcccccagagaaggtttccacatctcagcattattttttttatatataacattagggaatcccatgaatgctatatttagccaataggaactagagcaggagtcagcaggcattttctgtaaagtgcaagttaagtgttttaggcttgtgggtcagatggtctcaactgctactcctccactgcgtttggacgtcaaaaacagccttaggcaatatgtaaattaatggtcttggctgtcttccaaccatactttccttaaacagttggcaggctgtatatgacctaagggcttgttgttttctcactcctgacctagagattccatttttgcttcgtcaacctgggcttttaaatgtggttcttggaaacttaatgtatgtattttccctgatgcataattgctgagaattcctactgtggaacttattaagacatcagtgggggagcctttgcagcacctacgacagttctgcctccagaccaacatcctcctccaccctgagtcaaatttctcttttaattttttcaattaataaacttttaaaagcagttttagctttacagataaattgagcagtaagtagagcgttcccataaaccccttttgctcccatccctccctccacctatttcccttattcacatcttacattagtatggtacaaattttataatgaacgagccaatattgataaattaatattagctaacgtccatagtttacattagagttaactctaggtgttgtacattctatgggttttgtcaaatgtataatgacatgtatctaccattatagtaacatacagatagtgtcactgccctaaaaatcctgtgtgttcacttactcatcatccctccctctctccaccctccccctctcctctagaccttggcaaccactgatatttttactgtctccgttctgccttttccagaatgttatatagttggaatcgtatagtgtataggcttttcagactggcttctcttacttagtaatatgcatttaaggtttctcatattttttgatggctttataattttcctttatcactgaataatattccattgtctggaaagcttgtttgtatattcccctattgaaggccatcttgattgctttcaagttttggcaattaggaataaagctgccatgaacatttacaccaagtttttgtgtggatgtaagtttccaactcatttgagtaaacaccaaggatcaaggtttttagatcctatggtcagttatcttttctggtgaccatactagccccatcactcccagttactgtttgcattagttttcattttcatttctacatcacataacagtcactcctgttattcacaatattattttccttcacaaagacttctccagcagaaaagaagatggatgaatgccattcatccctcaaaattggaacctttcctcaaaatatgtgtttgtgtatgtactactatttttaaaaacttttataacttgcagtttgttttcatccttaaaggttattgtcagttcatcctgcatttttttttgtcattctgtatgtatagtgaaatatagtcargtgctctatatcagtaagtctggaatgttccattctggcagttatatgctgggatacataacattgttgcacaagccagagtaagtgtaaagattgctgtatcttatttgtgctctgaccatagacatgatcttattctattcaggctgctacacgaaaatactataaactgtgtagcttatacacaacagaaatatatgtctcacagttctggaggctgggaactccagatcaaagtgctggaagacttggtatctgatgagggctttctggtttggggacagtgttttctcgatgtgtcttcacttgaaaggggagaactccagtctcttcagtccctcataagagcactaatcccatttcaggagggattcatcctcatggcctaaccaccttccaaagccccaccttcaaataccattacagtggggattaggttccaacatattaattttggggagggacacaaacatgtcagatcacagcaaacaccagctttagtagtcatctctttaattatttcacaatagtttataattttttaaactatctgataggaagctctcagttggactgtatttttcaaagtcyatgtgaagaaagggcaaataaaattctggtttgaaaagtaacaaatgttctcagatgcaacatttgctaaactccaaatctttatatagatttatatagacaaaaagtcaaacgtgtctcctaaccctaacacacatgtagagaaaacattggattctgaacatggaggttgtaaaatagggtttattttccttttgcatacttagaaattttaattgtgataaaaatacaaaatttaccatcttaacccttttttattctctatttctgtatttttgtcattttaagagtgttacatagatgaaatatgacaatatgtaacctttgggattgacttttattgttgttttgctctgtataattctctagagatttatacatgttgctgcatgtatcaatagttcattcctttttattactgtcatattccatggtatggatgtaccacagtttgcttaatctttccatttttaaatgtacacttgaatactgttcggtatatttatatggctgtccatcagatctccagaaatctcaccctgcgaatctgaaactcttcacctaccaaacaacttccctttcctcctctccctagccaccggcaaccgcaattctaatttgtttctatgaatttagctactttagttacctcatataagtggatttgtatagtatttgtctttttgtgactgacatatttgacttagcgtaatgttctcaaggttcattcatgtaacatgtatcagaattcttccttttaaaaactaaatgatatcccattgtgtgtacctaccaagttttgtttattcattcatccattgmtggacatttgggttgcttccacctctcagatgttgtgaataatgctgttgtaaacatggatgtgcaagtatctcttcaactccctgttttcaattctttgggacatatactcagaagtgaagttgctggattatatagtaattctattttttttttttttttttttttttttttaraaacctccatactcttttccttagtggctgcaagattttataattccacaaacaatgcacacagactccaatttctccacatacttgacagcacttgttattttttgttttttaatttgtataatttaggggctactagtactgtttttctttgttgctgtttttttacatggctgtattgtatagtggtaaagtatgggcttttagtgtaygttgtacccattaaagaatttatctgtcgtccccctcctatcctcaccccctttcaagtctccagtgtctattaatccatactgtatgtccatgtgtacagattatttaactcccacttataagtgagaacatgtggtatttggctctatgcttatgagttatttcacttaagataatgacctctagttccatccatgttattgcaaaatatataatttcattctttttttatggctgggtagtattccatggtgtgtgtgtgatacatatatatgtaacatcttctttatccaatcatctgttgatggacacttaggttgactacctatctttgctattttgagtagtgttgttatacacataaaagtccaggtgtcttttttttatagaataatttcttttcttttggatatagacccagtagtgggattgctggattgaatgttagttcyatttttagttctttgagatatctccgtactgttttccataaatactgtactaagttaaatccccaccaacaatgtgtaagccttttcttttcctctgcatcctctccgacaccttcattttttgactttataatgataattattctttctggtgcaagatgatatctcattgtggttttaatttgcatttctcttgattagtgatgtgagcattttttcatatgcttcttggccatttgtatgtcttcttttaagaattgttcctttccccactttttaatgtggtgttttgttgttgctgatgttgttgttgtctgaattccttgtagattctgcatgttaatcttttgttggatgcatagtttgcagatattttctgccattgtacaggtttgttccctctgtagccatcctaatgggtgtgagatgatatctcattgtgattttcatttttattttaatgatgatcagcaatgttgagcatgttttcatgtttgttggtcagtaaggtgagtttttgtcgttttcttcatcatcagcctcatgtaagtgtcctagtctacctgcagtcttgtctcatcccttaacaattagaaggagagtcatcatttaaagaacttgccaaaagtaattaattagatctgtttgaattttttaattttcaaagtagcattttgtaacttttctttctgtctaaatttcccagtaaacttccttgagggcaggaaattatatctttttcactgctgaatctctgacacttattatagmgcttgctagttaatgggtacctaatacttgtttgctggatgaatcacacagtcttgatgaaagacattttttccccagcatctatcatgtactcattagcagagctcagtcgctaaattgcctttaccagaggctattctgaggcttctttctttggcaggtactcatctatttcttatttggggctcattatctaatggagaagagcttcattgacaatgctcaacataccactttcctgccacaaaatgccttatacaccatagagactttagttaccaggcaaacctagaggcaaatatcatagtttagacagtctacccagaatgaagtatattttccaatctaataatctaatgttttctgagagtcaaaaggtgtagaatgctgtttcttgctgtaactattgctagtttctggaaatgaatacaattaagtttctaaagtataccagaattatggctagagaatgcgttatgataattttaaggggtttcccatgtgaatatcacatgatagaagggacaccatttttcacattggacaacactgactgcttaacatgtaaataatcactcaggttgagtaaagcacactcctggcattgataaagtgccttctcatgctcctgcctacctactgttgatcatcacacaaactctaccaggcactttatgcagtttgcccttctcgcctaaaataaagcaagagaagggaaaataagtagcttcatctacttacctaattacttagagcaacaattcttaactgcactctctaggagtatatgaacatattgaaattgcattcgacattgcatgagtactaacatttttggggggaagcaccactgagctagagttttcagtattttctaataataaatactgtcagtatataagatgactgagaagcatgtgaattgagactgagaacaagatagagaatattgtctggtgatttggggcataggttttcatctctacatgccttttacatcattacttttgagaagtttctgtttgaactcggtaaacctcttagcataatctaggttctaactgaatagttgtgaattagtgtctagactcataaaatgaagaaattgcacaaaaccaactcattaaggttccaaataattaatctcagccacatttgagagggttgggttcagaggagtccaatgtgacaatgttaaatatttctaattgcaggccatttaaaatttctgtaacatctaaataccatacatattaaccatacatatttattttcttcctccatctatcctgcacatctccgctgaattgatctgttctttctttctatcacattctttctaggacactataaatgaatcagtctgaaacctacctccttttccacttttacctccatctacaatcttgcgagcactctgcccaagcaaactgtttccatcttcattcccctaagtgtgttctcaacatttcacctccatatgtaggttctcaccatgaaacccacctacactccactcttctctccatataagctttattcttcaagacgtggtcaaacctaccttctttgaaaagttcttccaaaccatytacatttaaaacagtatctactaatgagctatcaagccatgaaaagagatgaagggagcttaaatgcatattgctaagttaaatagacctacttgtaaagactacatactgtatgatttcaactatatgacattctggaaaaggcaaaattatggagacagtaaaaagattactgattaccagggattaaattagaagggaggaattgatgaatgtgtgggacacagatattttttaggcaatgaaattgttctttgtgatactataatagtaatgcgtgactttatacatttgacaaaacccatagaatgtacagcacccaaagtgaaccctaatgtaaagtatgtactttgagtgatgataatgtgccaatgtaggttcattgattgcaacaagtataccactctagtgcaggacgctgataatggggaggagttaggcatggggcagtgggtatatgggaattctctgtactctgctcaatttttctgtgaatttaaaacttctctattaaataaaacgtgtatatatatccttactaaagcactcgcagaataagtgtgctatgtagttcacccagccaacaagaaaagacatgaataatcatttagttacattcttattatttaagttcttacatattaattttctcccaaataaaatgaacccctacagaatcaggagcggcatatgattctttgtcatttctgccattctagtcataattctgaccacatactagtgttcaaacatttatttgatgtttggtgccttctttttctcactactgaaatataaggtctttgagggcaggggatccaacttattttgattattcatgaaccccaaacacctagaagagagtctagcacaaggtagccactcaataaatgctaaccgaatgaacatacacgcatgtgttaataagtaaaatgaaataaactatttaaagcatcaattcttaataaaaatgacacgtttgtttttgttttkcagctctagatcttacaagtatacaatgggaatatttacatcccctagctcttagatttaaaagctatttcttttaggctgtattcccccacatacaatcctggatgctcagagagaacattttttaaaaccacttacttattcattcattcactcatttaatacgtgtttattaatcatctactgtgcattattctggacactggagactcacttgcaaaggtgactgacaaagtccccactctaattgaatataatgcattctgctaaaatgaaaaaaatgtaactcacaaaaataagatgaatagtgatttctggatgttgaggagggagatggggaaactacataagccagaaggtcaggaattgtgactttgtccccgagagttgtatgacatacatgtagcagccctgaattaggtggtaacagccctgaaataggtaaagtctcactggatgtagatctgtaggatttttataaggatttatggccaggctctagcatgctactttcaacatatacaataaaaaaatcacccacaagctcccaatcaaagcataaaggcagaagtttatattcctagtgtgcattttaataccttagtaagatacaaaggttgcaaatgttactgaattaatcctcagccattttagtggtcatgggaacatggtgaggggttgctcacagaatcatctcaattttacaatgctgcatttccttaggatccttaactcttattttggaacttttattttggtttctattctaatttcctaaaacatgtgcagtatatttgtaaacaattttgaggttaaatactatattcaaatagagtgctctagcttttaaatacttgatgcaattatatatgtatatatacctgatttgtaaaccctctttaaatatggttcagtttttaagaaaatggatgaatatcttaaatctttgaaataagcttatggtaaaaatatctacagatgtgaatatgttcaatatttattttctctttcaaaagaacatcaaacttaaatatagacagagcatagacattgcttcgttgtatatgtttctttatctgaacattctatcactgacagtgtgaaggcaagagaaaaataatttctaaatgattttcaagtgacacttgccttctttatcagttcttcaaagaagagggattcaccctcattcaktttttattaatattttgttacaaattagacaatcacagataacaatgttttgatgatggttccattcatagcatcttccaataaagcaaaataaataaattaattaattaaaaagccttaaattttcctccttaaacaacaagcttatgttcccatttgtagaattccacaattggtaaacagatctgaattcattttattgatctgcctcacagttatatgaattctgccagacagtattacagatctcttcattcttagtctctgtaaaccaaaaggtatctgagacaggtctcaatcaatttagaaagtatatttttccaaggttaaagatatgcctgtgacagcctcgggaggtactgacaacatgtgcccaagaaggttggggcaaaacttggttttatacattttagggctacatgagacatcaatcaatgtatgtatgacgcacattggttcagcctggaaaggcgggacaacttgaagcagggaggggacttccaggtcataggtagataagagaaatatgattgcattcttttgagtttctgattagcctttcagtgaatgcacaatttacagaaatagtcacttatgtcttcatctgctttagtggaacaatggggcagaggaagcaattagacatggatttgtctcatgtgaacagagggatgactttgagttcggcctgtccacaaggaatttccttgtggacaaattgcgagggaggtatgtagcttttttatctttgtaactatcttatttaggaatagaatgggaggcagctttgcccaatgcatttcccagcttgactcttccctttgacttagtgattttggggtcctgagatttatttttctttcacatcttttaatcataactatggctaacatttattgagggcacactttgcaccaaaaactgccaatcctcatgaaattcaataattccatagaggtaaatattttattttgaaggtgaagtgatgtttccaagacagttgttagtaagatgctggggtgggaagcaaatccaggtctgtttagtttctaaatcttcaatctttttattttctaaatctttaatcttaatgtctgcactatgcttagggttaaccatcctcaataatcactggtttttcatctgtaactttctcttcttgttcattcattcttgatgactttaatgtaacagcattcatttatttttagttctgggatacatgtgcagaacgtgcaggtttgttacataggtatacatgtgccatggtggtttgatgcacctaccaaccagtcatctaggttttaagccctgcatgcatcaggtatttgtcctaattacatggatgaagctagattctcagcaaactaacacaggaagagaaaaccaaacaccacatgttctcactcataagtgggagttgaataatgagaacacatggacacagggaggggaacatcacacactggggcctgatgggggttaggggacaactacattcatatttattgatctctaactctagccacttcctgacccctcacctgatttagttttctttctctgcatttttctattatccttaaaagtgtagtgcttcagggaccactcattcccctagggacaggctcagggcagctatgtaaaaaggtgtgctaatacttgctaatttactttcaatttttctccttagggggcccaccttttagttggcctttttagttgcagcagcaaactggactgaccaagtgaatagaagaactaatctatgaaaccagatctgaaagtttacacaatttaatttggaaagctaaatgtgccaagaatagaatcaaagtatatagaataataaaaggcagggaagtactctgatggaattcttttttttttttttttactgtaataaaatgtgagcataacaactatttttaaaggtttagatgaatttgtaaatggtggatttgccgttgacatcagtaagaaccatatctcatatattatcctgaaaaagttaagaattttacttcagcagggtttttttggtcttttactgatgtttaatggattcactgactgggaatataatggtttcctatggaaataacatttctgtttactgctcaccattagtaagctgatagtctcctactatagtactgctcatgagagaaaccttttgcagattgattgattctgagatggagtcttgccctgtctgccaggctggagtgcaatggtgtgatctcagctcactgcaacctctgcctccctggttcaagcaattctcctgcctcaccctcccatatagctgggattataggcacccaccaccatgcccagctaatttttgtatttttagtagagacagggtttcaccatgttggtcaggctggtcttgaactcctaacctcaggtggtccatctgcctcagcctcccaaagtgctgggattacaggttgcctccaactgggaagtctatcatggccattgtcctcttatgtttcagtggtgatgtgggaaccactttgcttactgaccggggacttttttataaaacataaaaccataagaaatttaaggacctttgcccctcaaattccagttctttatctttcaacttatttgctctgcaactaacaatatgtggtttgtctttgttataggaatgcatgaagatttctgaagtaatttggtactgaaaaaaagacatacccaccaaaaaataaaaataaaaaacaggttactaaggaaaaacttaaacatgcaacattgtggaaaattaccctatagatatttgaaatgatattctgtaaaaggacagaaagcactctggaaacttatgttatactcttacgctttttttttgcccaagaatacaaaactgcaatatttgacctttcagaagcaccaatgaacatggacaaaatgtcatccagttccacaggctagaaacctgcacactgcttgacactctgttccctcagctgccatatacaattacatagtgctgaccttctgacctcctaaatatttctccaatcagccatgttttgtccacctccattgccaatgccttggcccacacaactgttatgtttttttctttctggtactataatggacaaaccagaattcttatatccaaattggctctcttttaggcttcacattttggccagactagcctttccaaatttgtatctgagtgtgacatgttcctgcttaaaacttctaatgtcttcccattgcttttagagaacgatgaaaacccttgtagcagaatgagccgcagacaaaacctctcagacattgagttgtagaaggaagggctttattcagctgggaacatcggcaagctactgcctcaaaatctgagctccccgattgcaaaatttctgtcccgttgaagggctcacaacactaaagatttcacctgaaagggttgtgattgattgagcaatctaggggatacgtgacaggggtttcatgccctggtagtcagagtgaaacagaacagagcagggagtttcacaatgttcttttatacaatgcctgaaatctatgggtaacatcgggttctaagttgatttttaactactgagtttaggccaggcatagggttctaagttgatttttaactactgggtttaggccaggcaggcccaggcctggtttcaggcctggcgctgggctgcctgtctttggttttacttccttgttgttttttctttttttcttaaaacaggtactgagtataaaacaatatgagagcgtctctctcttccctcacccttaatgtgaccactggtttcactcatgcctaatacccaaatcccaaatcctactgctgtgtgttcacattctgcattctgatttcgttgttttctctttttcattcaaatgccttgtctctcctcctgccccagggtctttgtatattatatcaccctttccaggaatattyttcacgctgctcttagtctagttaactcatactggtgtttcagatctcagttcagaattcaatgcttttccttaccacccaagctaggccagatttatctatgtgatctcatagaaatcattccttttcttataagaacctttcttaatttgtaataatacgatcattagtgtaaacatttgtctctcattagactgtacacttcaaaaaatggtaaactatgtcaacttttgcttattctaacttctcaagatcaagaacagtgatggctaaatactaggatctcactaaatatttactgaataaatgaatgcatgaattttagacatcattaagtaaagaataaatggaaatttgtttccatgtgttcacagtactcaaaaattttaatttgttatttaatatctggtagaccaattttagtatttgtaatggtatatatatatatatatacatgtatatatatatatatatactgttaaagtatgagactatgaggtgggaagaatcatctttgtaattggtacacacacacctatatatatatatagatagatatacacacacacacatataaacacaccaattggcatatatatatatatayacacacacacacatacaatatatacatatacatatatatatataccaattggtatatacacacacactgcaattggtgtatgtgtgtgtgtgtgtgggtatatatatatataccaattacaaatattatgattcttcccactttatagtctcacactttcaactaacaacctggaaagtaagacaatataattcattaatttctataacatttcataatataawatgaaaattcactgctgatttttagaggacaaaatctatagcatggtgaactttcacagctccagctttatctagttagagttatttaacccacaggttgacattctcccctcctcagggtctctctttccccagaaggtattgcctcttttcttgctttcctggcctccctcttcagtgtttcatgtttgtccttttgtgttaacctttggaattatcaaacaagttgttgccagaatctggggactcatggccgatgtgttcccggctaataaagcaaaaccaagagaaaataatcctcagcattgcatttcagaactatgtgggcttcctttgtattccacaaattcagtgttgctgattcttatcagatgcttaatttcctcatatcccagtaagatgatttatttggtgccctggggaaaaaattaaaccccttttatctgttttgtattttcaacattgtaattattaataaatatttactaaatagcagcatgatgtaggtgaaatatcaaattggtagaaataaatgcttcttaatctattatgtcctctaagacacaaaatcatcatctatgacatggagatggtgctgtttttcttcttaaagcatctttcacagcattattgtatcaaatttagtatacaagaatagtctttgaaaatcaaaaagctcaatcagaaattattattatttgaagaatatggtcttttaggagaattgtagaacctgcttatatttcctccatttttctatgaaagctttcattttaaaggttggctaaacaggtatttttgatccttttgtttcatttctatttatataaataagtggttttgatggggtacattcttattaggaaaagtttacaacacatatgcttaatattaaaatgtttgatataaaggtctaatttaaaatgtggttgaaagagaaaaaagtagaaaaatcttgtatatgcatgtacacataggcctaaggagagaagcgtatggaattgcaagaatattattaaaatacaattcaaatagttaagggtaggaaaaatgtgatgaaaacaactggatttttattcatagactccagcagagtaaaaatcacaaatttggtttttttccaaaatatgtcattttgtattcaattattcaagacagaatgggcagagaagtacaaggaaatgaaagaaaatattgataaaggaagataaagtaaccagactagattttggtaggatatagcaagacacaaaattgatatctcctaactacataaactaaaatacttcawtttttgcacagcaaattctattcttgttctggctaacaaaaattctgttggagtaaattaaaactgtgatcatatcactttttcgttggacataaaagaactaaatattttccataacatttgttccactcaggagtatctttcttgcatcttccttcacctccactcccatgataatcgccaccattaaaaccgttattactaagaacacaggtatttgttgtctttttccagattcttggggtctcttaattacaaagtaatttcttaaattatgcctccctttatctttcctctatttttggtattagtaatatctaacaaatctagatcaagtaggccatccacaccaggtcatatcctactcccaacccaatgcttataaaacataaggctaaaataatgaaataagattaaaaaatagaatagttgctaagactgataacttttagaaataatttatctaaacaaattgaataatcttaaaaaatcttgtggttgccattgctgttgttaagccacatttccctctttgatttccttttagaactgtattgttttgagaactggtataattagtgatttagagctaaggctgtagactcaggttggcattagaacctgcttcgccacttactaactgtacaaactctcatcaagatattcacctgcagcattgtattctgttaaaaggaatgcaatgaggtaatgtatgcaaagcctttagcatactggttgcctcataccgataagtaaataaatattaaccatcaccaattctcaccttagctctcctttaattggatgtacattcatatccaaacccatgtataatagagcagtggccatcagactgcatgtggtgaaggacagtacttttattaattgccagtttttgtagaaagataatatcataaaatacaataaaattcaattaataggaaacgtaaaaatatacaaaataaaagcccagagattttattgttatattcaacaaatataaaaaacattctgttaaatttctatagaagtttataaatgttttcacataatttctgtacttgctttattgcagaggggaaataaaatctatagacaggcacaagttccttgatcatacttctatgaagaatgtatattttattatttctcttttgaataagataaccctatttctaaaatattcaaatgttcattgatatagttatgtatatatacacttatgtatacacacataacaatacacatacatatatatatttggcttaatgtgatatttgtgttacaatgaaagtataaatcactgagtctgaagtgtccttaaaatagaggatgaggcgaaactgaccatctggctttgagctatcactaatctctactttgatgcctgagtatttgtcaaacaaagaaacgttttgcatattactgtgtatatttgttctctgttgacattatttactcagataatccagaaatgtttaaaaaactgatggaagcactttctcttgattttgttacatatgtacagtttgatttctttcacgtaaagcagtatccattttacatttttcttttagacaatgttctatacagttagtatattaccctacacatgcccaagaaatgtacctttgagaagctgatgtatgaccaaacatgtttgatcttagagctcaatttttactcatgccaccacccactatgacaccctcatcccattctaccccttcctggggagttaataacaacaatgagctttttttttttttttcctatggggataattggcaatccagggaagccaacccaatttctattttgttcaatgtttctttaattgatcagtgagggggaaaaggtggatacaggttgcgtgaagaggaggaaagattcattttgagtacctataaattttttggtactttcttaaaaactctttttaaaatatgcttctttttctttacctttttgctccttatatttgttgcttctaagagacgtgtcacctctgctagggtgataggctatataattccttactgctttcatctatatatttttttatctgtaggtatagaggtagataaaaatcagcagcataaaatacatattttctatgtctagttgaatgagtgattcagtgaaattgataattatatgtatcagttatcaactgtataatgaacaaccacaaaacctggcataaaacaataagcgtatgcatattgcttgtgaaactaagaccaagtgggccttggctaggtggctctgtagatctcggcaggacttgatcacctctaggaataggttagttttgattgaatcaacctggctctgctccccactctctctctcctccagcgagagtagcccaggcatgagggagggcaatcccagctgcacaagcacttgttaagcctctactttctttatctttgttcaaagtaagagaatgctgcaaattacatggcaaaggtcgttggttgggaggaggaggatgaagaattagaatcatttttgcaattgatcacatatcttaaaaagtaaattctttcaattgaacaatatgataaattagtaggaatagttaaataattatatttatcttgatgaaagtaacgtactcgggcaagttacttcaaccttctgtgcctcggtttcttcagttctaaaatggggataataatagtgtcatcccatacgattatggtgagggttaaattagtgtattatgtagtgtgtagagcagtgctcaacatagaaatatgcataaggtgttaattatagttattaacatcattattattgttaatattgaggcaacacagttgaaaactgacaaatgtgtaaaaatgatatatggttgtcttaatactttcttgagcatatttattttgtgaatttttggctaatatttatagcactggtgccatctgttcatcttacaaggattattattttaggagtttatacatgtctatattccagagagaaagattttacattgtagaacaagttgggacacatttttatttataatcttaaaatatcttacttatagacgtattgtaaataccacagatttttgtttctawtttcttgcttttataaattttgtactaatgttaagaaatggtagcaagcttatgactaatgtcaatttaattgacagctcttaaaatgtgatcattaattgatttgttctatgtagtaatgagaatatatgccaatatgtcccaattttaatgtgcatacagtcacctgggacctcgttaaaatgcaaatcctgattctgtaggtctgaggtgggcctgggattctgcatttctaacaagcttccaggtgatgaagttgctactggtccctgaataccacattttaaatgtacgtgcacacacacacacatgcacacacacacacagacatctccttatgtatatttaaaaattatgcacacatataaaatacatattttaaaatatataatacatatttatattgaataagtgaaaattcaaatcaaattatttgatatttagttattaaatgttataaaacatgtaataaatataatgaatcaaagtaacatataatatttaataaataaattattgtatctaatgatgtgttaatctctaaatgttgagaaatatttttactgccaaaaaatgctttaattttccattttgtttcccgggaaactacttaagtaacagaatttkgccctataaatataagttgctgtcgagactcctttgttggtagaaatatacttaaatttcctgggtcctgtaatcaggataaaagttgtctctctctctctctctctttttttttttttttttttgatggagtcttgttctgtcgccaggctggagtgcagtggcacaatctccgctcactgcaacctctgcctcccaggttcaagtgagtctcctgcctcagcctcccgagtagctgggactacaggcatgtgccactacgcccagctaattttggtatttttattagagatggggtttcaccatgttggccaggatggtctccatcttttgacctcatgatcgcctgccttggcctcccaaagtgctgggattacaggagtgaccaccgtgcactgccaaaagttgtctcttaaactcgtacataatyatgcttttatttgaggtacacacacaaccaattaactaattttttttctcctgtgggcattagtcacagcccaatattaaaaatttttgactacatacaactttatataaataaagtacattagtcaacttaattttctgcttttgagtgttaactacaaatattttgtttcaacttcaggactgtaaaatctttctaaaagttcacgatattcttttctttataagtaatcttaagagtactctgcctttttgttttaaagaagtggttagtgtcagaatagtagcattaaaggatacaattgattttaaaactgtaaaagatgaaagagattgggataaatctctgctgacctcagataaactctagtagatcaaatctccaaaatgtagaaaagggaagaaaaaaaattgagaattcagattaagtggatctgaatatgggaattcccatctaaaggtatgtgtaattaagttgaaatctattaagaataattaaataacagccttcttcatgataacaacatttgagttgcactttcaaactcaatttctcgttgtaaatataactacagattacaacttaatttctagtccataaattatttttcacctctcttatcttatttgatatttgaaagaaccctttgttgtttaatattatactcaaagtaagaacttggacttggagacctcctcctcctttaagttcaagcctcctctgaggagagatactcctaaggagtccaggatgagggtcattattgagctgttactgggaggggactgaattcgtggatgactctggaaaatagaggttagtaatatattagtagctattatttatcatgtatttattatgtgctatttgctacttgtgtctaatatcgtttctctatttcctctttttaagttattttggaattgcctagtattctaaaaaatgttatgattgtgttcagaatgccccttttatagttttcccttaaatggtgatggtgggcaaacttgaagacattaacaaaaacataattttcatttagtcttagataacaccaaggtgacatagtaactaagtggagttggtgggctaattcctagtggaagcctgggctcgtaacagaacataaaggcttttccaaggatgaaacactggtgaagctcctccttcaagttgtatatgtttgcatatgtgaaaatatgtgcaatccaagtttaacttgggaatgcttagctccttaggaatttgctactgggttaataactcttccctcaattacttaggttggaaagtcctcaaattttaccttagatcaggattggcaaacttttggcaaaggaccatatagtaaacattttaggttttgtgagccataaagatctttctcgaccacgcagctctgaaatttgtagtgtaaatgcagacacagacaatatataaacaaaggaaagtgcctgttttccaatgaaaccttatttacaaaaacaggtgaaaattgtgtttggcctgagagtcagtttgctggaccactggattagattctcaaggtcactttcaattctgaggttatggttttgccagattatctgagttattcattcctgatgagttatggaaggagagctccttccaaccagaagtctctctttgtacaagcaaatggcccatcacggtattttcctaaacaaaggcatttccctcagaagaggaattctgctgctactgttaagataataagtacaccacagatggtgctttcatttcaaaaacaaccacaacataaaaaagatataacatttctgtttaattattgcatttttctatcctatgacttgatgatttagtttggcagtggtgcaaattaatattcaagcttctgctggaactcatctgttgttgattttgttgtggtgggggtgatggttctaaacatagtcaaggaggcaaggtgagaaamagatacatcaaactccttatcgatctcgttttggcagattcaaagagtttatatttaagcctaaatttaaataagcattttcatattatcactgccagttttagagagtgtttcactggcacaataattgtattatccaactgtatagcaactatcaattagactaggactgccttgagaagcaaagtagggctcctctttctttggttcttgctgctgtacattggaggtctcatactgaaggctcacaggcttccctgtggccccttgacccactcaaggttgaaaaacaaaaactaagaaatagttgccaatgttaaaaggagattatctgtagaaacttacatttcttacttcctttgaaaaatcagatcttctaaagatctaaggtttttattttcacaggagaaccatgtgagggacggctgcttttttaaaaaaatcattgcttctaccactgtcttcatctcctcaccacagagcctgagtcagaggccatttatcctcattacggtgccatgatcatgccagctttcctcactcctgtatctacctggtcattagaggcatttgagtttgtggcccgtgctgtgcacattatccctggagatctcatcaattacaattatttccacctactggactttaagtagttctacctattggacattttcaatgcaatctgttttcctaaagcatactgcaggattgaagcacaaagtatgactgtgcaattactctcaagagcatttttgtttatgttggtcaatgtcagttttttaggtcccttataaggaaataccttttaaaaattcatgccaagaaacttttcattttcaaaaaggaaaatattttctttcttgaataatttttgtaacattatagtctttctctttttgtcctggctaccagaaagttcagaagtcagtgtgtcataatcctgatattatttctccccttactttgtgtgttctggttctctatttgtaatattaatactaactattaacgtgaacacacatatactcatgtgctacaaacaactttcaggttcattttgtgagagattagggttgaaaacatcagtacgacatgttcttaacttttcgaaaccatcctccacactgacaacagatttgtatttataacatacgaatcaggccctattattattcccttgcatattcagraattcaacatgtcttcctctcacttataagacatctaatttgtttattagagttttcaagaccctttattatgtttctcaaacctatcttcccatctacaacattctccacttctgtcccacaaagcktgtatctcagtgatgaactatttacagttctccaaatgtaccaggccatttcccacctcttgcctttcacaataccatttattctccctataatcactctagtattttataggtaagtcactcataacaaatattatattgttctgtcatttttcagtgaaatgaatgactattatttatcttggtatatttcatgctgaacccaatattttgtgtaaaatggttttcattgactaattatgtagctgacttttggtgagattttcacagaattgaaataactgatcaggatatattttttactacaaataatgagaaacttttaaagaataattattgagtgctcactgtataccaagttctcttctaaatgtgtaatacgtatttattcactcaatcatcccaactaccttattgccctatgatttttgtcctcattttagagatgaggaaactgaagcccagagagattgagtaatttccccaagaacacacagctagtggggtcagggttgaatcctactgtctgcctccacaggtgatgtttatctgctccattgcttcccatttacgtgttgaaagtatatcacttatgacatcaaatagcaactaacctcaacttccattggttctatcggttctataggaaatgctgggattatttgagacttcaatattggaggaacagattaagttctcaaaaagttttgagaaaatgtattagacaataacatctttgaatgtaacatgtgcatttgtgtgtgcattaattatttagccacaaataagaaggctgaaaatataccagtctccactatcacaagcaactgaaggcaatagttctacagaaagaatcacctatctgtgaagtcacgggcacagctcacagaaaggtgctgtggaattgacttctttggagtcctatgatgtgaacatttcatctgaaaagatatagtgtcagaatccttaaggtatccaccgagaataaattacttcctctacatcaagcatcttcttctcttccatattcaacacagtgaattcataatggagacaatacmtccctaagttgctgatggtgttgcaagcaccattcatgttttggacattatggcagtgacgatcagaagagaatcctgtggacctacgtttctggtgtttgtagcaacaggatgagcatcagtgagccaggttctgggcagagacacccgaagcccaggaggcagagccagattcccctgacttccactaagtgacccactaagtcagctctcagcatgtcactcatagctgattttgagataggtttttaactggtaagcaatatgcttaggtgccctgccctgtctcagtgawaaagacaagtgaaatgccaaagtctaatccttttgtttgagaaagtatagtttcaaccaatatatttattagtctcttggggagaagccagatttatagcattccattttgttttactcacaataaatgcatgaacatgtactgttttatcaatcttttttttcgggcgcatggcctggacattgactcagtggactctcatttattagtgagaaaactaattggaggatatatggagatgcagaactcagtagaaagccagaacatttatttggatgggatcttattctaatctgaggtagcatcatcaagaagaaataaagatctacataagttgctccaggagggggctaaacctgtcatttggctattgtgatttcatcaaattgatcactgtaactgtcatctttgtcttgaaaagcatctgccactaacaaaggctgttccccttggaaaactattagctctcagtgaatgaaagttattcagcacactgaataaattgtctcctgcatgagacagcatttgataattcacacttttatggggaatattgaaaggaaatttctacatgacattaggtcacattcctaattacagttagcataaagtcaagcccttaatgttttagtttttagcccctaaggaatatttttcagaacaggtatacaacatttttagaagaaaaccaaaaattattattttctgcaataataaaatcwattaaagaaaaatgaaaactttgtgtatattttttagtccagtggtattttcaaaaagatcaaggacagtaaggatctattttccatctatattttatatacatatagaatagcacastgttggacctatttaaaactagctaggtgtctttcatggtctataaccagacaggttgaacttcaaatttatttttaatagagggctatcaaaaatgcatatgtagattgtacccttattaattttttatttatttggcatgggattatattcattattattcatcccaaagtaagaagtatataaaaatcatctgtgaatatttctgacattaataataattgtaaagtagtaagctttgtgctgctcatcaattaatgcagaccatggcattgagcataatagtatttaacaaactgtatgctttccaaaaatgctgtgtggtttttcagttggagcagcttttgatgtttatcttcaagagttccaacgggactcaaacctttggagccccattgaattattttcagctactgtcactatgaccagctaacatgacacctaacctcatctggttatacaatagctctagtggctggcaagtaagccagctgattgtctaagttttagtttgaggtttcagtttgttcctttgtaagtaaaatgtatcaccctgtgatttcagtgatccaaggagcaactggcaactgtagagtattatatcactgttcctatggaaacatgtaaaatggattataaaatatctgaaatgtgtattttatttggttcactttattgtgaatatctgatgctactttaatgctccctttctgattatactctggttgaattgtcttctgtttaagttaaatctttagtttgctcatgtattgttttcttatgatatacttttgcttctatatattttcaataatagtaggttcttctcaatttattgtatattttaaaaatgtatagacaattactgtgcgcaggaaggggtatatccggtcctccatgccaaagcactctttcaccatgctgggaaactttctagagaatgagtagaatgtacagtgaagatcaagttccttcctctaacttttgtttcattttctctccacaggaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaaggtgagtattatgcatgcattattattacatagacttattacatattttatttttcaaattgataggtctaccatggctctaagaaaccttcacaaagtgctggaaatgtcatttattttgatctaggtgatggttgcacaggtgcctacttaagttattgatttagaatttgtgccccttatacactttactatatttgtgtatgtatgtgtaccaggaaaaatttcttctctgccacctccaaaggctcaaatcctcactgctacaaccactctaacccttagataatttaaattaattaagttaaaacaattttaaatctgtaatgatacaaatctgcgatgataagtatattagaaaaagataataagtatattagaaaaaataagttttgagcgtggaatcaaaagtattttccattttgatattatctaggtgaaagtaattacctacttgtggattattataattacagaaaawtaagagataatagcttgactcttaaagaacttgctgatattacacatctgctttcaaattgtgtaattcttcactgtatacatttgtagcattacttcttttactaaaataatttatccacattcatttgtgtgcaggaaggggtatatccagtcatccatgccggatgaatggaaatttcacatttactccaatcagatacccaaagagcaggctacaaagtttttttaattaatcaacaacatctgcacctctctcattaatgattctgccaaaagtgtcatttacttttatctatgtaacatttgagaattacaaaaatatttgattttaggatattcacatgtgtttctattcaagttcttttgtttactcttttgcagaagatcagatctacaataactcagtaaatattttaagctagcttggacagctcaattttctttttgtgttttattcctacaggaaaggcttagccatcacgagaaaatgcatattgttttcataatgcatattctctatattgaaataaaataatttaaaaatttgaacagtcaattcttcatcatctgtgagtgtataattttcaatttgcctaaattcagaaaatcgctcttgttggctaatactacttctgtaatttcaatgatgttgacttagtgkcactcttaattatatttttctgtagaacaatttattgaaacccaaacagttagctaccagggcctatacaggaaaagacagattattccagagtctgaaatatgagtgaattattctcagtatatggtggatcataaggatgattagagtagaaagaagttagaggatttccctgttcctcccaaaaaaaacacatccatgatacactttcattgttttaaataaattttgataacattggactcacctatatttaaatgcaaataaaaaattaaaaaataagcccacagaagctctaataagaccattgtttatttgccaccgtgctttatctcttttcactcattttatgttttgtaaatagttaagaattgactagatttttagaaccttaccctttagctgcataaatgtaacaaaacccaaaagggctgttatgtcatttaaccgaggtaaaatttgggaaccagttattttgcatatctcatagaaaatatctgagacaacaatgatgtggtatagaatgatacttggtatttcactcatgtatttgttatgtgtatatgagtgttttgtgtgtatatatacatatatatatatgagaaagagagaaataatactttttatgttttcaaaaaattagcagaagtactctaaaaacagttaagggggtaggtactataacgacagagattatcacattgtttacttgatagaggaaaattaatttcaaactttcaaaacccataccgaatataaataatgttattggaaatgtttgacaaattaagtacctggttaattattggtactctagggcattcatatctttgttttatatatatatatatatatatatatatatatatattttattattatactttaagttctagggtacatgtgcacaacgtgcaggtttgtgacatatgtatacatgtgccatgttggtgtgctgcacccagtaacttgtcatttacattaggtatatctcctaatgctatccctcccccatccccccaccccacaacaggcccgtgtgtgtgatgttccccttcctgtgtccaagtgttctcattgttcagttcccacctatgagtgagaacatgtggtgtttggttttttgtccttgagatagtttgctgagaatgatggtttccagcttcatccatgtccatgaactcatcattttttatggctgcatagtattccatggtgtatatgtgccacatttgcttaatccagtctatcattgttggacgatacaacttcactacatagaaaatcaaggtcaatgcttcatgcttttgtctgctaatttaattagtaataggagtgagggattggaatgtgctttcaggatacgcattagttccttttgctaccttagcaagtaatttaatagaaaccttatgtacatttgcactttcaagtatgtgtgctgatgaaaactcacgtgatgcattgatactaaaggccacattctacccccttgaacatagggaatgcatatggtagttcatcttaactaaatctaagggctcttcgtaaaataccttaaactttcaaaaacctaaaaagcagtttgggcagctctaatgcacttgtatttctgatggcagatgactttaatccctagttttccccaaccatcagtcactcttatatgtcctttctcaggacttccagaaatcattttctaaaaagccacgtgaactactatgattatgccaccagacactatttagataaatcctcagagtttattcaggtagtttcagttgctgtcttgccattctgttttctgcccctgtatcatgtcaattattagatttttaataacatagcagaaaatgagttgccttctgctgcccaagggtctttttccatgattgtaggaaatgaacattgaaatgataatctcctgaaggctctggcttatgggaagagagttatttgttrttattttgtgtagctttgaagttgacactagtatgactatgttgcttttgaaccacatgaaagaaagtaatttaatgttctaggatgtaaataccgcagctcacaaagattgattgaagtgaatgagaagttcatgtgttgatattaatgtgcagtggaagggatgtctgagttttctttttttgagaattaagttaaatgcctgtcattctcctatagtgtgtgtgtgtgtgtgtgttttacatcatggacccacaaagaggccatagctcccatttaaacctgctgtcctagacaaaaatccatgcacactcatatacatattttaggtatacagaccagagaatgtgaagggagtaatgtcctctgtgggctggaaatgattgctttacaacaggaattctgtctcaatggaattgctttacttcagggaaaacagaaatgggcaaactgcagtggtctatgcaggtatggatggaccattctcacacctaaccaagcaatgtttgcttttcctcctcctttcttcccatcactagttgccatgtaccgagaaccatctttgcatgatgttggggaaacggtcccgaagcctggggtgacgccaagtaaaagcacaagtgcrtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgcctttttaatatcttttctgtgactgtgacacttcatgtgaatgacatacttcacaagtacactcgataccttgcctgctgacagctacccataatcctttttgagtcctgtttcagcgaaatctatgtgtttaagttcaattttgtagcacacaaataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaaaaaaaaaaaaaggaaaatcagtaattataacctacaagaattgcgctacctaaatccatttcagatatactccgtcctgtttttaatgaaccaaacttaacgccatccccgtttctggctgcgttcccctcatactcagcagagcatgggcaagacggctgttgtgttctttcctgcagcagcaatgcaaacgttagttataaattaattagactttaatatttttggtgtttaatgacaagtttttaaactggacatattaggaaaaatattttttttagctcagcatgctgagtccggtactgtgtatttcaccagtacatgcctctagctcagcatctggggctcatgttgcccagtggctgggttagaggtgccttgccatgatctcagaatacagtctgttgaattatcctagatgaaaataaaggcaaaccaacacattcatccatgaggattttggtccattccatttattttcttttattttgcattcttaatttcctttttagtttaacactgtttgtttgagcttagggaagacaactaccaagaaaggccaggaacagttgactacacaatgaagattccatgcaaaatgttcaatattggatctaaaggggttcaaaatgtttcatactaaactgtttgggaatatatttgttaactctgtgtacacctaataaaattcaatgttttcttctcagaagagttcattgagaccaaactgaacctcatttattgaaaattatatgtgggatcaatgtactggcctcttgttattctttctatgtgggaggatgacccagtcatcattttccccatctgcactgtatttattgggaaattattttgtcactgctttcataaatcttcttcatgacagcccttgcccagcattaaaaaattctggcctgcttagctgattaaaggtttagtagaaatttaactgtttgtttatgcttatttcattttcatattggattctacttgaataaataaaaagttagcagaacgtttgagtagatttattgccaatgatgctaaattacaaatctaacaaacaaaatgattcctttggtcatttttgatttggtgttatgtcatcttgaagcctattgtttttaacaggaacagttaaaatatattagataacttccattaaccaattattttcagaaaacatagatcccataatatgtggccaactatatgagtaattaactaacttgtaatacagtcaaatgggcttatggacactacttacagcagcaacacttcacttcacacaaacacacacatatacacacacacacacacacacacacacacacacacagagcaaacacccccatctatttgttactgataattagccctacttgctggtttctttttcccctgcaagtctgtttattggtttaaattaagacaagatttatttttgtaaatgactgagatttatgtaaatgtgtatctctgttgtgttttatatatggggtgtctataagggcatttatccctatgaaggatgtcaaatactttcttctaatatatgtttagacatattgcagaggggtccttgttatttgtaattgagttaggtcatttactttgtgtctggtctcacctgtagcatgggaagaggacagcaatgatgagctgcatgtagtaggtacctgtgtatcaagaactgttggtatgtattgctaatttgcatacaaagagtttgtctgtctgcattgtagtttgtgtttaatatcatttgttaaattcacaaatacaacatattgaataaaatatttatatgaaggcatattaaaaaacatcaaacaactttatgtaacaaaatggcattgcattactcaccaatatagagaaatgtcatgtaaataagttggtaaactcaatttccccctttaccatgccaaagaaaattttagctctttgatgatacctctcttgctatttgtttgggataagacttcgccatttttttcccctcagaaattaagtttgctgttattaagtaagaagtgcaatctgtcactactgatgttccgtatagtaaatctgatggaattcatttgtatttagactgtgtgttttgtacctccatgtgcatatgtccattgtatcaagtctctataatactccattccttctgcatgcatatctggtgtgggagggttatttctactgatttgttatagtagctgattgctttgccagtccctcaacaacgctcagaaatgttgttttggtatttcaagtgacaacatttttgttttctaatataagattgctttttaaaacattttgctaccactttacttggaaaaattagagaagacatgacaattctccaccctatgtaaagagcaaaatggaactgaacatcatttcattacaaatcctgaagaatttggagattcttgctctaaatgtttgcttgtcctgaatgtttttgggtagcagtggcttaaagagatccacgatgggtccaaaggactcccgctccagttcttctaatagtttgcctcttggggagcaagcagaagttctttatcatacctagccacttgcttaattaatgctttaagcactaaaagttgttatttttatcaggatgaacaatatcagatttggttgtctttaaaagcaaaaaccaaaaacttattctttaagtaagttagacacgtatcacttcatttaaaattatctccctaatattatggatcattaatatttgatacatattcaaaaagagaccacattgactaacatccagttgagaacaagatgaaaataattgaaatattttttccattttaattcagaacaaggctatatcaagggaaagcgactgggctaaatcctcaatttttttttccaaaatgcaggcatatcaaaatccaggatgtacatggtcttactttgagtgaaatagtagtcatagctgaggtttcttagcctacaatgtgacatagggcctgttgactctcttgaatatggagtagggtttcaaagtgttgacagttgagtctgcaaactaaggctgagttatattttagttttttttttttttcctggttttcactaagtctaattccaatgtctactggcagagattgtgtttgcatttgaggtagtggagggcggtactttccaagtgctgttggaatccagataaactcaaggagcccagaaagacaacgggtataatggctctcctcttatgacttagcactttagttgacttttttgaaaaagtctctgggtggaatacctcagtgatgatgatttgccaaacaagcagcgttagtgccaacaccttctctaaacttgctgcatcccttccaattgacattaatcccactgcaacttcctaaaaacaggaatgagccaatgagatttgcttattttctctcacccattacaagtaagtttgttcttgccctgcttgttttttagagggagtttctatcatagagttgaaaatcacatttaagaaggaaagagtttatgtctttacatgtaactattttattttttccaatctaaattcaatcacttcttaatagatatattggtgtttgcattgctggcatcaaaaccacacatacacacacaaacacacacatacacacaaacatagtggacagaaataagtaaaaatatttctgttttcaaagaaaaagcattccttagagtttaggtaccattaacttctactataatacagttccggtactatggtttctaactaaatgaacactagaacagagctgactatattttcatctttgtccaaaattttagatgaatcacattttgaactttttatggtatgataatttctccaatatctaaattctttttctgagaaaacaaatgccgaggacatttttgacactcttcttacatgagactatgaaaaagagcagcacttttgttgtagttgttgttgttaataaaaaggataataacatacagaggattataagaaaaataagacatacctgaggttttgtgatgagctatagagaatcaagggcagttccagtggagctgaggctgacaaagtactgcccagctgccagccaaatccacccttaagttgcttttgtatggcctgggagctcagaaggaattttttaaattttttttacagctttaaagtattaaacagaaaccaacaaagaagaatatgagacagggacgtacgtggtccgtaaagtttaactttctgatccttaataggaggataagcgccgtgatagagaaatccaaaggtcatttgtattacgatggctagataatgtaatgaattccaatgtctgtgcatcagcgaatacgtcatcaaaattgctacaaaacaataataataggttgttcacagcttaaaatgtttaggtagtgaagaggaaagaatataacctacattatttattgactacttatatttccctcattttacggaagagatctatcaatttacgtactcaataatagaactacaacatggttgcactccttaatctcaggatagagataacaatttttataaatctattacattatgagaacattgttagtactataaaaatcaggatcagttaaatgttctcttaaaataattttcaatattaaatttttaagtaactcagtggatgcatattttccttatttttggaaatttgacttataaagtttaagccatgactagaatatttacatcattaaaataaaatttccaagtaaaaattttcatcttaaagtaatacggaaatgattttgctacattattctaggattttacaaagtaattcacctttagaaaaaaagtggttttttttttagctctaaataattaaaggttgcctaaactaatgtgtataagtagatttacctgtaaatatgtaagggaagtcccaattattgtacactttcataattcaatgtgaatttcatacaaagcaaagtttcaccattaagaaaataaacattttgttcctatcactgagtgaatatttgtaatttctatttaagccatttctagattttttttttttttttggtcttttgtgagcttctgagattggtgccattttatcacagtatttctcgtcttgacttctttgcatgaccccaggtttccagtaagtaaggtatccttagaaaaaaaagtattttaagggaaatggatgcatacttcaggcccattttatatgtaactcaatattgtctttttaaaaggccacactaccatggaataaattaaaataaaaaatcagatttcttgtacgcataacccctgcccagttttaaaaatgtgatcccttatttctagaaacctaaaatagatatccctgaataacaattcatttttaattatcagtagatatatata

SEQ ID NO: 12562 - DNA, 141083 bp, Homo sapiens
  misc_feature (1)...(141083): n = A,T,C or G, or insertion/deletion polymorphism (see Tables 1-2)
gctgccactgcactccatcctgggccaaagagtgagaccctgtctcaaaagaaaaaaagaaaagaaattaatgtcatcgcatccctgcttttctgtggcactttacttatcttcaggaggagagacagctggtcccttctgtgcaagaagctattctagcacctgttgttaggaggccttgggctccctacaagcctaaaactacagtctggcacatggtttagcttctctgtccctcaataaggagaatcccttccatctgtttcttactgtctgcctatcgtggagcaggggctgaggccttttcctagagctcctgactgttggtaggcttctgaacaactgcctgttacttctcacaaattctctctactggtctaggaagagtctcccttgtcgctgttgcccttaactcttctaccaggcctagccactgctgagtcctggccttgtggggtctgttgtgaggtcagcactaatctcagtgtcagttgagtgatgacctggatctctgcgtttggcttccccttgggggctggctgactccttttctttccttatcagttttaacaactcttgactctttggaggaggttgtcctgctttccaggaatgtgacttacatcatggaaatctgtctagcttctacatggagctggaaatctttgctctcatcccaggccatatttagagatttaacatggaggtcctcagctctgttcatgcctgcgaagtgtgattcagcatcctcacatgttaaattgccgaagcagaagggtttatatttagagcctggaccacgttgcctgtgggaaacttgaagttctttttggtacttgccttgttcaggtcactttctctagccaggtttcaaagtctcttccccttgtcatggcaacagggggtcccaggtattttctaggtgaggtcaaactgctaggccaacgcttttagggaggagatgtagtgctgaagcatgatgccatcctcagcgctgccctgggaagcctgctgcttggccctgggtctcccttactgctacctggggataaaaggcaaagcattttatttaaaattattttaaaatttagtaatcatttatgccaactttccaggtccctttctaaaaacctgagagggattcatattactaataagagctggctggatgtggtggctcatacctgtaatcccagcactttggaaactgaggtgggaggatcacttgaggccagagttcgagaccagccatggacacattgtgagacccccccgcccatctctacaaaaaaaaatttttttaaattaaccaggcatgtagtcccatctactcaaggggctaaggtaggaggatcgcttaaacccaggagttcaagcctgcagtgagctatgattacaccactgcactctagcgtgggcaacagacattgtgcttagaaccttgtctgctttttcttgtttattctttataaccctgctaagtagatgatattttcaattgcattgtacagatgaaggaactaattcccagagaggctgagaacccatatctgtgactgaagtgcgtgctctgagggactacattgcatctcctcccatggatagaaacctggattaagttagccttgtccttccttataaagagtgctacagaatggttaacaggttccccaggattcctgagtcatctggaaaaggaatatgtttcaaagcattgtttgtggaccgcctgcatcagaattcccctggctgttggttaaaatcacagattaactgacttacaacctctcggaatagggccagggaatctgcatttttgcaaagctcagactctaaagtctgaggaacatgtcctctgacatggtgtcagaattttcttcactgacacactaatcagtttctgggtaggcctaaaaccaacagtagggatttgggagactatactacagggattgacaaactttttctttaaagggtcagttcgtaaatagtttgggctttgtgggccatatgggtctctgttggagcaattcaactctgctgttgtaatccaaaagcagccatagacagttcataaccactgggcatggctatgctccaataaaactttgctttcaaaaacaagcgctgggctgaattgggctgtagtttgccaacccctgatctagagtcatcctggcccaccagccctctgacaacccctgtttgtggaacttattcttacactactttctattacctatggagagctgtatcaactaagataaaattgcctgatgtaacagataaaccctgaatcctagtgacttaaggcaataaaagttattgctcactcatatcagagcccagtgaggctactcctggttagaatcttctatgtgggccgggtgcagtggctcacgcccgtaattccagcactttgggaggttgaggcaggcagatcacctgaggtcaggagttcgagaccagcctggccaacatggtgaaaccccatctctactaaaaatacaaaaattagctgggcatggtggcgggcacctgtaatcccagctacttgggaggctgaggcatgagaattgcttgaacccaggaggtggaggttgcagtgagctgagactgtgccattgcactccagcctgggcaacaagagcgaaactctgtctcaaaaaaaagaatcttctatgtggtcatttaagacccaggccccttcatattgtggctgtatccctcttgggccccagagtcctctccattgcagctggcagataaggaaagagaccaaggattattcatgggaaggtgttttttttgttggttttttttttttttttttttgagatagagttttgctcttgttgcccaggctggagtgcaatggcacaatctcagcttaccgcaacctctgcctcccaggttcaagtgattctcctgcctcaacctcccaagtaggtgggattacaggcatgcaccaccatgcctggctaattttgtattttttttagtagagacagggtttctccatgttggtcatgctggtctcgaactcccgacctcaggtgatccgcccccttcggcctcccaaagtgctgggattacaggcgtgagccaccgcgcccggccttcatgggaagtttttaagggctgggtctggtagaggtgcccctcatttctacccatatttctttggccagagctgttattgttcgggatccagaaactgatttctcaagtccatgaggcccttggtctctagattcattctgtttttgtctgtctttgcttgaaacgcctccaattctttcctgggattgtctcttcattgtgaagaacctcgctaagttcagccaagaggagacagtgctcaacttcactctgattgtttctagccactttccctagatctgcaggcttgctgagtacatggtccaccttctgaatgactgcaggtgtaagttttaccaaatattttgctaccatctaatatagatttctatctttccagcctctgagatccatttcctcactggctgctgcctgcctactactttagggtgttgctattgcggcaccccactgcaagatacctacttctgtattagttcaggtaaaacagcagctttaactggtagactcaaattctacctgattaacacaactaaatgtttacattttgctcacatcatattctagtacagatgttttttgtggtgtagccttccatacagatgttcttcatggtgtggccttccatgtggtcaatcagagacccatgtttttccatcttgaagctctgccctcctgcaggtctctacagcctctctgtccagctggccaaaggctagaagatcaggcacatttcagaggatgtgctggaagtgatgcatatccatcactttggcctatattgtcttggccagagctcagtctcatggccacacatcctgcaagaggggctaggaaaggtagtccaagtccaagacaaaaggagaacaggttttggcatgcacatagcagtggctgccttataggccaggactctggactgagggaataatggccagcagagaattataatggctcattagtgggggtggcagtgggcagcctgccctggtagaagaggtgctgtcaggcattagctagtatgattcaaaagatatacaaataccttcattaatgcagtaagcatttactgcatgtccactatgtgccaggcagtaggccagacactggggccttgggaggagaacaaagctccccttggagctctgggtgagccattctactcctaacccttgtgctggaggcctagaggccagagagcctgggaaaggaagagggaagtggctaggtctttttaacttggctggtttgaatgcctcctacaacccaagaaatgcagcccatataggtcagcctggttcccactattagcaagcatccctctgcggtatattgaatgaaatgtaatatgggggaagagaaggcaacacatagtggacattctctttatagcttgctccctggttgttttcataggacgttgttttccttctgtgaggcatctaaggaaggtggtgggtctaggatatagggttatgtgtttgtgtctggctgctggtaaagttagggaattggcaccgtgtctcagaaccccctcagcagagctgatggcagcacagggaggacccagtgctctacatccttgcttttttcgtattattggctattcatgttagaagctgttgctgttgttaatttcctagtgggcctggctgaaattgaagcggcgggttgagctctgggcagacacagcatttagtcaacagccattgggcatccgctctctgcccgatctctgtccaagtccaccggcactcctctcactggagcggccagtgatgcgggcttggtaactgatatgtaggggaatggcagtagcctccaggaaggtcttcaaaatgagctaagaaaataggcgtagaggacatatttaatacagattggaatagaccatggagggaaggtttttattcttttttggagatttttgggtagaaaatcatatcactagaagcaagaatgtagcctgggtaatatctggaacactttcaaactgcatgcattgatgtgttgcccattttcagctaagagagggaggactacaaaaggttaaatttctcatataagattaattcagccatctctgtgaaatggtggaagcagaatgccattagactctctaatctcatttctctcatgctgtctttcttggagcctgtcaaacagtgtcctggcagagagtcagttctctggttgctaaacatcagagtcagtctctttctgcatgtgccaagagggctgtaatttagaaaatgcaacctaccttttaaggaaggatgaaaaggtactaaatgcacctttctttgcatgttagatcccaaatgttttgaatatagtaaacatgttattcctatataattttattttctatgttatcgtagagttatttgcatgacatattagaatcaaacttattaaaactgtttatattttgtggatctcatgtggtttcatgagtattgcttgagtgctaaatatactaactaataagatttgtgccttttgagtgtgcaactgtgcattcaggatgaaaacgtagtaacaattttgcccttgttttaattactcttcaacaacatgtgatttttgaaatctgatttaagcctttttggggggtgggtagctgctgctatgtaaaaagctgaatatacttggacattagattttctgttagttctggtcttttttcatattgccacataaaaatcctaaattaaagggggacagagggtggagcctaccacgattgtgaagtttctttctcttacttaaaatatagcattaaataatgctggttatttttatgttgcatatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgttccatagcagccctttttgcaaatggtagttgatttttgcagaaggtttgtggccagatcgctatgtataatactgatgaagcatttttgttccagctctgtctcggaagacctaggctgtagacgtggggatttcagtaggaaacattatggatctgtggagctggtaagtttatgctgtctgttcagtggtagtacattgatttagatttagagacgattgccaagctcatcagatcttttgttgtatatttactgttagaccatgtgggtacagtgtaaggattggattggaataaataactatacaaaggctatgataatttgatcttctttatctatttgtttttattgttacatactttttaatcttgtcttccagtttgttaaaaatatgttacggcttggtatttttctctgtgtatataattaaataaaacaatttatgaattaagaaaggtggcatttggcttatatatgacctttttcctaaaagtttataaatctagttttcaaggtttaaatattattgaaatacgtattctgattttctgtatgtttgctttctgggtgtgtagtaggagttagaatatttatgagagctgtttttcccattaaaagcatattggttggactagataaatgactattatggatgatcaatatttggaatgaaaatatttacattttccttaatgagaggtgttagtgtttgtgctatgatttttaaaatttgtgtgttttcattttaaaagagccataatgaaagcatataatagtctcaatattttttaaagatagaatgtgattttttccaattacgtgaaaatctgaacaaattttcagaaatgtgctcataaaattatattgattattatttaacactgttaatgacattgcctactatttctatttattaaaaatgagttgcttgtatctatttgtgtagcacccaattttcccctattaatataagctgcatccttgcagagtttaagtagtagaaaaatttatagcggagttgtgtaccagtggcgttctacttgaactcaagcatatgttatggacctgactgtgtacctagcctggagctgggtattcttgaaaatataaaatgagtaaaagatacagtccttgttcttaaggagcttactgtcctctggctgggcagataagacacataaaatatctgaagaatgaatttagccacataaaagatacctcagttgattcagtcaacacctgttctgtctgtcactggtgacaccacacyacttagaccaccacctcccctgaaggagcaggtgcatagctataagtcagagtaggaattggtactgtgaaagagatgcatgtagagcaccacgggggttcagagaaggaagggatcacccattctggccaggggtctcagagacacaccatggaagaccttgcagagagctgtgggatgtggattggtggcagagaggatagacagtaggtatgagctaacagtatgattcctggcaatgccgtgtcccaaggcaatgagcaaatggtcctgcctagcaaagagctttgtaattacaaagcaagcaagctttggaatcaggtaggcctgggttcccataccaggtctattacttatctttgtgaccagtcaggttacttctctgaacctcagtaatgctgaagaacatgtgatctgaagtcattcttgtttcatcattcactaattgtatgatcttggacttcctttarcatcagttttctcatctataaaatggggatatttctgttatctaccttagagggttgttatgaggattaaatgagatcatgtacataaagtacttagcacataagcacagtttatgttaaccagctgcagtcataaagacaaaattcagtagcaaaagtagagccttgactgtcaggtgaacactttggacttggcctagcaagtaatatggagcgcttttaaacagtgacaacattacttgggggagataacatgggtgtgaaagatggactctttaaagatgtggggaaatcacagaatatcagaatggaaaagtacttgagagcagtggttctcaaacttgagcagacatcagaactctctggaaggctgattaaaacatagattgctgggccctagtcccagagtttcaaattcagtagatccaaggttaacctacaatttgcaattctaacaagttcccagattgatattgatattgctggtcccaggatcatactttaagaagctctgccttagaggacctcagctaggtcatcagttatccttggcctgatgaggcatccagttgaccaaacgttcttcaatccatttgttcacatttttcctctggggccatgactgtgtgtatgtgtatttgtagttgactttttagaatattataaaatacattttaaatatatttaaaaattccacgtataatcttaccttgcagcaactgttttcatctccttgtggtaccttccagtccttatagctacaaacctcatttttatattgttataatgaaattatgtatttaatttaatttcgcattcttctttttccatttatactgtattttctaaatgtcttcttatatagtcttcagagtcatattttaatgggtacatgataggccaacatagtgataaatgattatctgtgtaaattttgtaaaattaggttgtttctcattttcccgtattaaaaatgacatgtgtgctggtggtcaggaaggttgggaaaagtgaaatgagcagagctccgttcttattatctgaggatctcttgaaattctgactgcagtgttttaagaggagcgtgatgtttcctctcacttctgaacaacagagtattattaaattacaaaccattatgtgttgcagggacttatgaaaaagtgagtttgacttttcttatgcctgctgtgatgaaaattgttgggaacccaataagtgttgggcatcttggaactcaaactttccagaaaggcgtctaagattatataaaattgaaattttagcatgaacttctcctgaccttgaacaagtcacaagtcttgtgaagaatgaagctcggccattcatatcagtaatgagagaagacttagggcttagttctctaggtttccatcctgcattagtttggtgatgagaagatggaaacccagatcttgacagactcatgggagaactacttagcattctttcaacacatatttattgagggtcatccatgtgtcaggctctgtgcaagtgactgagagtcaggggagagaagcaaaaccatttttctgctctcatggagccttcactttagaaactagcagcctcacaccgtgtccccaggctgtgttgtatctggatctcagctgtttccctgccttaaccagggattgttttcttatgaagaacagagatctgttctgtctaggtcaagtataaagcaattcactgaaaggatatgggtgaatctcacgggagggaagtgcagctgcgcctcatgtgatggaaaaccagcaagccactattttctctttctctctggtccatatgctttcttgtcttcacatttctctgtgtctgtatcactctcctctctgcagaacagcttctgatggcacagttgcctctctccagctcatttttcccagcagccagagtggtgttttcttttttagtttattttttattgtggtaaaacagacagaacataaactttgccattttaactatttttaagtgtacagttcaaggagcattaaatacattcatattggtgtacaaccatcactgctatacactttcagaatgttttccgtcatcccaaaatgaaactctttatcaattaaacactggattcctatttggcagttcctcaaaaagctaaaaacagagcttcccagccccaggtaacctctattctactttctgtctctatgaatttgcctattctagatacctcctataagtgaaatcatacaatatttgtccttttgtatctggttttatttctcttagcatgttttcagggttcatccatgtgatagtgtatatcagaatttcattcctttttatggctgaataatattccgttgtattgatacaccacattttgtttatccatttatctgttttgtttgtttgtctgtttgtgaggcaggatctcaccttgtcacccaggctggggtgcagtggcacagtcatggctcactgcagccttgacctcctgggctcaagtaatcctcctacctcagcctcccaagtagctggtattacagatgcatgccaccacaccgggctaatttttttgacttttagtagagacaaggtctctctatgttgtccaggctggtctcgaaatcttgggctcaagcagtcctcctgccttgacctcccaaagtgctgggattacaggcatgagccaccgcacccagcgtgtttattgattcatctgttgatgaacacttgcgttgtttctacattttagctattaaaattaatgctgctatgaacactggtgtacagatacctgttggagtcctgcttttgattgtttggagtttattaactaggagtggaattgccggatcataaggtgattctgtttttagctttttgagaaactgccaaacttgtttccaccatggctatactgttttacatttccaccagcaatgcacaaagtttctatttctccacaatcttgacaacacctgttattttccatttttaaaataatagtcattgtaatagtatgaagtggtatctcattgtggctttgatttgcatttccctagtgattagtgatgttgagcatcttttcatgtgcttattggccatttgtgtatcttctttggagtaatgactattcgaattctttgttcattcttgaattgggtttttgttttgttttgttttttgtgttttttttttttttttgctgtcaagttgtaggagttctttttatattctggttatttgtcccttatcagatgatttccaaatattttcttccattctgtggcttatttactctgttgacagtgcctttaatgcacagaagtttttaattttgatgaagtaaaatttatctattatttattttgttgtctatgcttttggtgtcatatccaagaaattattgctaaattcaatgtccagaagattctcttgtatgttttcttctaaggcttttatggttttagctgtctttgagccattttgagttcattttttctatatggtgtgaggtaagagtccagctgcattctcttgcttgtggacatccagttttcccagcaccagtggttgaaaagactgtcctttccctattgaatggcctggtacccttgtcagaaatcaattgactatagatgtgagggttagtttctgggcttcccttctgtctcattggtccatatgtctgtccttatgacagaatgatgttttaaaatgttgtcaatacaatgtcttttccttcttaaaatgtttcttcagctgttcattgtacttcaaggccagaccatgtaccaagccctacaagaacctatgtgatccttaccctgtctttctctttcaccttctttcatgccgcttcctcactgtggctcaaatgtctggcctttatcctggtctctggaacacactgagctcttccctgtcccaggacccctgcgcttactagtcattcttactgatggattcttggggcttctcacggctgatctcagcttaaataccatcttctcagaggggcctcccctgaccatcccatcaacattagttccttcctctgctattctstaactcaacatcytatttgttttcttagcagtgcttatcacaatctatattcatttcatttaccacttacttactactctgtattgttcattgttttatttctagaacatggcacagggcctggcacatactaagtttcttataaatgtttttttattactgaattgatttctggccccccagtccccatggtttacatgggttacagctctgttggccaccgtggtctcttcattcttggatcctaatttcaaattccaaatagaatactatggattgtttcctctttgttcaggtatctatccctgattcaaacacttgtgctcagggtagtggggtcatagactataaacctggcttttgaggcccatcccctcagcaatgcttgtggacagggcakattttctctggagatgatatagacaagtcagtttcaaagaagggcatgagctgagctggaactcccaaatgtgtccattaacattccttcatatagcgagaatttaaaagctcaaactaaaagcacttagtgaaaatgtcttcctctgctgatggactcccttatctctgtacttttttaaataccataaataaagatatagrttatgaactccctaaaaataggaataatgtttatttgccactgtatctctagaaccaagcacaatgcttagcattagttacttagtaactattgattgaatgaatgaatgatcccatttggttgaaattagagagtggcctaacccatcaaaaataaataaaggaaagagaaaacaagcctctttgattcccccctcaaccaatatacttaggctcattagctggcagtgcatttcatcaaaagcatatgccatttttcttcttgatgaattgcaagtcttgtctctcatggcagcattctaggcaagacacagctatcacaccatcaaccattcttcatcactttgtgttgaaatctgtcagaaaaagcacaagattgtttgtagcttttattgatctttttttggcctttaaactggatggctaggaaattgatacagtatcagtgataaatggtatgggcacaatatagacctctcccctccccagcccagctgctgactctcataaaaccccgtatcttgatacttctgggtaagtaatgatctactggtgatttcaagtcaggataaaacaaggtagtatattgtccattcctttttaagcttgtttcttaatgactcaaacctgcatttagatgagccacgtgcatgctcccctgctatataggaaataaatatatcagtgcttctctatacagatagcatgatttcgttgtcatgaactcagggtagcctcaaagggtatctggctgtaccgtctaataactatcaaaagaacggttgatgatgaacttgcttggcatctgcagattttagcatttgaggttttgactgtttgaggactcttgaagtcttgatatgtagtaatttgtatttttgttcaggcacagattggatttatacctgtgggactgttgtgaagaaagatgatgctttgctaatgagtgatttaactgcctgtccagcacccctaacacaactcagttttgtgctctactcagggttaagtagggtttttactttcaaaggcactttatgggagaaattatattctatctagtattaccaaactgagagattagtgagggtaccagcatatttccctcaggaacatcaaaacatcaagacttcagcgttgtacagctaaaatcataattttgacagatgttctttaaaatttatctggcttatatctgtgtctcacatagcaggccaactctttttttttgaggaggaggaggagtctcactctgttccccaggctggtggctcgatctcggctcactgcaacctctgcctcccaggttcaagcgattctcctgcctcagcctcctgagtagctgggactacaggtgcacaccatcacgcccagctaatttttgtatttttagtagagacaggtttcaccatgttggccaggatggtcttgatctcctgacctcgtgatccacctgcctcagcctcccagtcaactcttgtggatacctccaggtacaamgtatatcagaacattcaccaacaagttaacatgttttgaaactatggatggtgcttttttgatatttttactgcctctgttggtgattgatagtgctcacttttaagctttttcaggccaaaattattgtaaccattttctgtgatgtagaattttgagactttaataattactttttatacattagaatggaatcagaaatcttttattatggttattattttattatttttattattagttttaacattttattgaatgcttaccacgtaccagtctctgttgaatactgtagatgtatttacttatttaatccccacaaaaaaccatatgaggtaggcattatttgattaggccacacactgtagatgctcagaagacatttgtgaatattaaatggattcccatttaactgatgataccagagcggtcccacagctaggaagaagcaggagtgacatttaaacccaggtctatctgcctccgagagcccctgcgcttaatctcttcgcctgcaagcccatgctcttaaagccctgctgtgtatagagtgtttcctgagaaaattaggttgattgttagaacaaataccgctgtccttaatcaaaagcataaagtagctctgctttaggtttccattccaacatataatttcaaactatttttcgtccaaatcttaacaaaagcttgctattaagaatgtccataaggagttatccaaagacatgcccatgccttaaatggtttaaatttaattcctagatcaagcccaaccataagttagctacaaacacttggcctgcctttgttggcccctctcagacttgcttttcttgacttgtaccatggcattatgcctttaacctgcattgatggacagagtggaaagcagccagatagatcttggtggtgtgttgcttgtaggatgctgctaagaattttatgttcgtcatatacagagtctcatttaaaaagacctatgagaaaaaatttttctcaggascaaaaagtgccatgcttctcctgagaagctggtttgttgttaaccttataagcagtgggaatcctgtaaatgaaagggcttttcctctttgcattggctcctaggaagctcygaactccatttgtggcttatctctaacagtcttaaaggactttataacatgcatcctcatcttattctcttgttttcagtttatttacctacacttgatttttccttgttctgagtgtgctcagtatctcattttatcctttaagtaagatatatttaagtaagctgcttttaaatcctttctaaaaaataagatagagcataaatataaaagtatttctgtatctagccgttaacagcataatccttctgtcctccattgacaggtagaataactttgatgcttgtctcctccctaccctactttttgatacagtatgattttatgacctatttttctaggatcaacaaaacttggggagaattaacaccacctgaccagccatttggtgaccatcttgagctccgagtgctgtgttaatgacatgcataggcgggtcacaaactgtaacaaatccaccagctgaacacatgctgtaataagaataccagacaacttctccaaattttcccagacaaaatcaaccttgggaaccttgataccagacatcagcatgctctctagtttcaaaaccagagttacaggcaccccactccctcctttctgagtcctggcttcctcatgctctccctagaggccacaggagtctcccattcctgtgacactcaaggctctcctcctcagggcaagcctctctgcgcctctgtgctgctctcttgcagccaccttggcttggctcacaatctcaggctcctcaaccttatgctggtatcctgggagtctctgttgtttgactccagtagtcttcaactgatgggatatggtcccctgatgtatataaaaacacttccaaattttgatcaatgtataatagtttatttttcatataaccagaaatacaaactgaacacgccacttacctggttaactcttcagcaaaggaaattgagtacagcagttttctaccttgattgtggtttcatacactcaggaggcaaaatgcacataagtctctaaacacacagactttcttggtgtctgtttggtaacagccgttgcctttcacaccttacttgtaccagatcattctctgccctgcatcatggcttgtcgtgtgcccgcctcaactttcagataagcaagaccaggctcagcagtgtgcatcatctgttgtagcaggaataaattttaaacttgattaaaatatataatgtaatatacctttatgtactgctcttagcaatagaatatattttgttttctcaaagttgcttttttcagtacctatgttttcttctgaactcatgcaggccttccctcaaaactgtggtattcacatgccatgaacatgcatagagtttgaaaaccactcttttacctctttggggctgttaaagatgaagaggaatttggtgtttttgccaatctttccccacatgggctgtggactttaagagctctttttttaggccctcagaggaaagtctagcctattttaacttattaactgccccttggcaggcaacttagaacaagtttccctggggttcaggatccaagagaatttgaggcttcatcaaagtctctcttggtgccttaagatgaaacccttgtctttcagctttctcctgtctcagggcaagtttctgttttcgtagsgcacatatccattccatgggttagaagagcttttggccctgtttgttaaggaggggaacatctgtgggttctgaaatttgcttcccttttatatcactaatcaaatttagggagtcatgcaaaaaaatccagtgtagcttgccgtgattggcttaccataaatggctggctcatggtgtcacactgccactgttagttgagctataagtaatatttttatattgaactattttacacatgtaattaaagcagttactttgggttcttttatgtgcaagaaaaggattgtatgctttttggcctcaactttttaattggtctattgcagttatcgttgtgttgcagtcttttaaaatataatctcaaactgtgcgtgcataatagatgtgaaggctctttgattactttgggagtacatttcagctattctctaagttctctttttgctccttgtaatggttccacagtttcccttcttactttctccttttgatgcttcccttccttgtactccactgaaactgctcttgccaaggtcaccaaagatttccttgctaccaaatccagttggcattcctcaactctgcctttttttttttttaacattttgaattgattgattgattgtatagatggggtctcattatgttatccaggctgatctcggactcctggtctcaagttatcctcccaccttagcctcccaaggcaaggctgggattacaggtcagtcttcatgttacatgacaactctgtagccctgttaaaattttctcctctcttgacatctccatactatcagcttttcctcttgcctccctgcttcaccttctcagcatttttttttttttgattccttcttgtctggctggcccttaaattttggtgctcttctagattctgcctccagcattgttcttactatatatgctctttctgggtaatctttccctgtcttaaaattggtgactcccagatccatatattgagtccagatttctatccacagatttctgtgcatgggcgcatttgcctaaatgcccactggcagtctctcctgggatgacccataggcaactaaactgcaatatgccccaagctgaactcaccctgtctctcttgtgccaaaccactgagtgaatgacaccatcttcctttcagttgctaattccagaaaccaagaaatcacacatagccatgtcccagtctcttaccaaatcccattggttctattatatattctcaatggatttcatggccagttgctctttattcatatcactgtgtacagccagtgtcagacagccttttgagtgctttgtatgtgtaaactacttttcacaatgacctaatgaggtgggagtactgttatcatccccatcttacagatgagttaactgagattcagagaggtaaattaacttgtccaaggtcacacaactggtaagttgtagggggtgtcccccaactcccatccacaataggttatatttacttgaaagatccatgatcttgctgctgttacaggctgctccagtgcccctcaaacttgattatgcataaaaatcacttgagcagtttgttyaaaacccgtgttctgatttggcatatctggagtgggctgagtagtgtgcattttttacaagcttacattttgaaagtgacttttaattccttatgtgtttcttatttagactcttgaagaaatacaagtaagaaaagaacaggatgtttgcttctatgtagtccttcttttgtgtgacattggtatcatttcctctttccttgagcttctggcactttctcttgctctccctgacttctcaaaaattccatttaacaaattcttgataagattacatctagtgtgtccgtgtcctcagatgtaattaacctaatcctgggagctttgatttccttaatgctgtaaagagtactttccctaatgtacagctctggcaacatcatctttatgmattcaagcaaacaaattcctgctgtaataacaacagcaaaccttcagcatctcttttttgcttatgaaataaagtaggtagtcttcagcttgacagttaaggctttctgcagtcttgctccaacctatctctgagccttacttagctcatgtggcccatgatccagcaaacggacctttacccaccattgcccaggcctgagacttccttatactttttcatcgttctagaatgccctcttgaaatatgcctctgttgagtgtcattttttccatgcagccttacctgattcccctatgggaaagtcatctttcactatctagaaccccacaattgtttgcatttctctatggtacctgtcatattttacattgtcattatttgtgggcattttttacctgtcctagtaggcagagattatggtgcttttsttattgtatccccagcagtacttggctcagtgccagacatccacaaatcagctagaagatgagttttgccaaaaatctctctaataaattcttttttcttaaattttttatattacttcatagtatttttgtgtgtatgtgcatgtgatgctgatatactttttaatatatttttccgattatgaaaggaatacatagtcattatagaaaatttgaaayatactgaaaagcacagagaagaaaattaaattcatgtgtaatcctacaaataatcactattacgatttagtacacatcgatttagtaattaaatttgtatacaaaatgggtttatgtattttattgggcttctttacttaaaaacaaagtatagtctttttaggcataaagttgtcttccataaatgacttcatctccttatatgcaaatctcttttttcgtcttcatgtgtaattgcattggctatgacctccaaagcaaccataaatagcaatagttgcaggtgtccttgtcctggagtttcaggtaagtttttaaggctgtacatgagggtatcttttcttaatcattacatatctgagcatgtctctgattcatagctttcacaagaacaactttacctgcttttaagtgtctgagtcatcacctttttcctttaaaacttcacaaatgttgatctgttatcgtgttagtttcctaggcctgctgtaagagtttatcacaaactgggtggctgggtcacttaaaacaacagaattctattctcttacagttctggaggctaacagttcaaaatcaagatgtagcagggccatcctccctctgagggccgtggggaagaatccttccttgcctcttctagtttctggggttgcggcggcaatccttaaccccctttggcttgtagctgcgtcactccagtctctgcctctgttatcacatcgccttctctctgtgtctctgtatctgaatcaccctctctttttctcttataaagacatcagtcatgggatttaagtcctacctgaatccagtaggaccttatatcaacaaattacatctgcaaagaccccatttgcaaataagattatattctcaggttccaggtggacctgaatttggggggggacactattcaaccagtacagttaccttttgccctttagtgttctgaagagaaatctgagccagttccaattcagtttctttcttggtgacctttcctggctgggtttttcttacattttttttttcttttcatctttcattttttacatgttttccataatttatctgcacctttgtattttcattaattttccttaaaacattgcacctctgggattcttagatccagtcctttaatcaaggatgaatattttcttctgttatatctttgattattgcttgttttttcccctaaaatggtaaagaccattttctctgtcctccatgactgtcttttctttctttttattttcattttgttttgttcctttccattctataatcagcatctaaaatgatggagatattactgttttagttccctaaaattaacattttgttttcctcctccagtgaagattttaatcctacatttgcattttttcatccttttttatctcacccacttgcacaaggtttctacactattgcaaagagctcatgtcttctgtctccctgaggacagcaatggctattctgaaattttattttggtttcatagtaaagatggttaaaggtatgcttccctcttttagttttcaggattatgtgtagcattttttcatagcccccatttttttttgttttgttttcatttttgttttacttcaaacaaaaacaaagagctattcagacctttttttcaacattcagaatgtataactggctctcagctatcattgttcatttgggactgtagcttctctgagttaaacaactggctggctggagattatacaaagctccttgatcaatttccagggtctagttggtgtttatcttataaagctctgctggagtgagataggatattctcctgtgcttggctttttgctgctctgtaccagcggctctagaatttatacataacaggggcttaggaactaccagtagcagtctggttgaaagaggcrtattgaagtaatgtttgcttagctctttacataagcctgagaaaatgccagctgtctagatcaaaaaacaggatgcagattgtgaagaggttaaatctcccccagccccttggcatgttggggaaactaaactccctgggatgctctgccctcaggactctccatgtctcgctccctacctggggcacttggtttatgaggaccacattctctaagatggactcactctccctccctacttcttgcccagtgttttcttgtcatgaaaaagaggtgcttgtacgagtgaggctacctcaaaatgcagtgtccatgcagtaaaaagatgattcctagtgttttattcttactcttctgaaagacccaatgtctcttagctaaaattagatggtgtggggaagattaaagtgccttccaaccttccataattaccacagatttgttctgttccaagcaacaaagccagacaccaaatacgtttctcgattcttctccattggcygtatagtaagtagaaaatgtcttgatattttggacgtagaattgccaatcattccttcttaatattcaaaggagttgtcatcatttgtggtgaattttcacaagtcttttactgggaaatggagtatcagggactactgttcagatatgattttaattagaaagccaagacaggtatattttgagctggaaagctacatgacagtgcttatcctgaattgcctcatgtttctcagtaaaatagcagaaaggtcatctgttaggagaaagggtgtttctgtagtggtaacatgtgacagataaggtggaggatgtgatgggaagtacaaaaataatggctcagaagattggatggtggtgaggatctagccataatcaaatagcatgagcatgttgtaggcctggtcagatggaaactcttctttgaacacagaaaaagagtgagagttcagttggcagggtgtgagcgagtgacttgacttggtggcacgaggaggagtgagcagcatgccagatatgtgsggtggtaagtgcagcctgattaaccacagatccccagatagaacccatgccaaaaagagcccgagtgggttatgaggtaaggtaggtcccatgatgccacagctgtgccartgagaaggagaggatgctgttggagttaggaatggatggcagagccatggagttgggaggtattcgatttgaaaagacagaagaatatgagctcaggctgtcagatcaatcatagcgatgggtgttgagtttgctgaggacaggggccagggacaaggatgataagaaaagtctgagtccagatccagggccttggtggctctcctccagccaacatttatcctcttggctggggaatctgcctgccacctggttggttctatatgcgccatggtgctctcagcacccagctgcccagctgcccagtcacccggatctccctgtcccccggcacaggcagaataggatcaaggtgaggagtgggaggaggagaaaaaaacctaccccttccccctactctggtcctcacactggctccttctcccttgcctttccctgcaggcacagaagtggactaaaagagaccaggagacaggccccagggcagcactcagcagtgaggggatggctcattctacccatgtttatgccttttctcaccccctctttttgatgcagacatttaaacttttctttcttcctttctgaatagtagtactttctaagtcagggatgtgtctgtgtctgtgtctgtctgtaatttgcatgtgcagggtcaaatggatctgctttcttgaccagtatttgcagtttaaataaaccagcttatgttggaaatcatttctcaaagatcctatacatcttccagaataaattgcattatagcaatgcaaccttccccagttcccccaggcagagttggtctctccagtgtctgtcccctgttcttttgtctgttgttatggcatttaaccaggttgtgttgtgatttatctgattatatgtatgtgtgtctcttactccctctaggatttgcmgtcctctagggcagggatcatgttggatttatctttgtccagcagttagtacaggccctgaaaaaaatggtttcagtaatgtttgctaaatggacaaatatttaaacagatcttccaagagtttaaatgtagcataaagtggcttaatcatgctaatcagagcattttatattaatcactatcatattactacaatatatattatagcattataacatttattgagcacttattatgtccaggtactattctaggctcgttatacattttacattattaaatcctcaccacaagcctagaagtaggtacagtcattgtccccattttagacataaggaaactaaaatttagagaggaaaaattcagtgattttcccaaggtcacatggctaacaagtatggaagtgagatttgaacctggtcagttgagccccaaaacccatactcataagccctcattttaaagaaaggggatctaggagaaaatattacatattatgcttaaggatgtactttacataatctttttgagttttttttctaagtaaaaatattgttcctgtgatttatatacctgaatgccaagtacacagtgcatgctgaacagagatcatagggaataccagcactgatttagaatggaaacaagcaccaacccagtgaaacaaagcagtaaaataaatgaggaagtgctttttgtttttgaaaaattacatatttgtattaatctaagaaagatcctcatttaataattgcctacaatttgaaactaataatgtttttatttatagttaataacattttatgctttctatttaaaaaaattaatttgttaagttctacaaacaagtattcttgcttggatcttattttttttcctgagataaaacatctaatatattgaacactgttcagtgttaaatgaaacagttagttttgctgagattagaccaaggcctccactcaggatgttaaatcacatgaattttcactacttaactaactgaatgggaaaccaatttgatttgggtcacccagagctgcatgaatgtccagcatgtcattatacataaaaatatgtataattggacagggttgtggccctgtccaatagaactttctacaattatggaaatatttttatctgtgctgtccagtgtagtagtcacacatagccactgagcacttgaaatgtgactagtgcactcaggaactgaatgttttttatgttaattaaaattaaatctaggctgggcacagtggctcacgcctgtaatcccagcactttggaagaccttagcaggaggatcacttgagactaagagttcgagaccagtctgggcaacatagtgagaccctgtctttacaaaaaataaaaaagtagccaagcgtggtggcatgtgcctgtggtcccagctacttgggaggctgaagcaggaagattgcttgagcccaggaggtcaaagctgcagtgagccataattgtgccactacaccccagcttgggagacagagcaagaccctgtctcaaaaaataaaaaataaaatttaatttaatttaaacaaggctggtggccacagtattggacagtgcaagaactcagaagtaatcactcacagtgcctggcagatcctagccaaatgatcacttaagtcgttttgttgttgttgttgtttgtttgtttgtttcctttttctccctcctggacacggtcttcctcagaatctgagtatttggtgtatgaccatagcagagatataagaccaaataaagtttaaaaaatcctgtcctcttttcttagcattagtgatgttacacatacatgttaatacccttttcctaaacatatccatcaaaatgaatgcaaaagatctggtgtctcttctcraaggaaactgccccacttttctgtgagtgtgtggctcttatgtggctctcatgtggctctcgtgtagctccggtgtggagcatcagatccttcacctcctcagaagatgctctgggccagggctgcctttgtggggcagtgttgtgacaagatcttcagttttgcaactagcttttggtctactcagatttctttcttaaaatatttttcattgtgtatgttttcctagaaaatttgccatttcattgaactttttgatgatattggcataatttcatatagaatgaatgaatataatttcattctcttaatcttttagaaatctctttcttcttagtggttctattttctttattatcactatatgtatttgtctttgttctttgctttttaaaatcagacttgccttggagtatcttggatatgttaatcaattatactatctttctagttttataatttctgctctgatcttttattgattcctttcccctgctttccttgggtttatttcattgttctttttttatcttctagtggttaatgcttagttcattgtttttatccttttttgtttgataataaaagcattgaaaatgtgaatttttctgtaaatatagcacctatcacattatgtgttttcatatgtactgttcttattgttgttcacatctgaatagtatctaattttactattcctatttgactcaagaatttatataaatatatgcatataaataaatttatacatgcatatatacatatataaattcttgagtcaaataggaatagtaaaataaatttatatatgcatatatttaaagagatgggatatcactgtgttgccgaggctggagtgcagtggctattgataggtgtgatcatggcacactatatcactgaactcctggtctcaagcgatcctcctgtttcagcctcccaagtagctgggacaataggcacaataggctgagatgcatattttctgattttcagtttttaaaatccttttgatactaatttcttattcagttgcattatgctaaaaatgacctgtacaattttatagaatattttagaagttttttattttatattgttctgtagaactttttcttccttttctgggccagacatggtggctcatgcctcggcactttgggaggccgaggtgggcggatcacctgaggtcgggagtttgagaccagcctgaccaacatggagaaaccccgtctctactaaaaatacaaaattagctgggcatgatggtgcatgcctgtaatcgcaggagactgaggcaggagaatcgctcgaactcgggaggcagaggttgcagtgagttgagatcacgccattgcactccagcctggrcaacaagagtgaaactcgcttttctttcttttcaatattaggtcggtttttttaaagtttactagatatttttaaaggtgtgtattctctgtaccttgatacagtccatatatgtctattaaatcatgtttattaaatttatgatttgattccgctataaatccatactcatttttgccttgacctatcagagagaaatgtactaaaatttcccattacaattataatttyataaactcttctttctagttataatagtttttgttttatagtgatatgttgttactcattacataaatgtttatagttatattttggagatgggtggttctaattatccatataaaataacattttttatttgatgtctttttctcctaagttctactttgtgatttcattattcccttactttctttttgtcccaatttgcctagaatattttttactttgcctttctttttcatgattgctttattgtatttaatatatttcatttatgttaccgatcaagtcttttttgttttagtagggaaatgtaaccaattcatatttattaaaacatctgtgctgttctgtttacctttaggagaagttccaggctcctctttatccacttctcattttatccctccctctcactccatccttcaggagtgcagatctggattgatcagattagataacatcttactaagtactaaactcctggatagacagagctatatttgcaaaggtcagagcacacatgcaaacatgcaaaagtctcttttctggactcttctcccagaagaataacaaagggctggatgcattccagtgtgagaggagacctaaccaactccctcctctttgctggctttggaggggtaagatctcagactgccttcctgtcttctttctttctacaccatgtaggctgatctaccttcactagtagttctcctttagtcttggtctcactcattagtagagaaccttgctagagagggtggttagtgtaggagatgatttgtttattcctgtgttctgttctctgcccaaggaccactttcgtaacaccccagtccattctttacagtttttcccagatatgttctctgtttttcataatcattttcctctatttgtctcaaactgatattctgatttactctttacgggcattttcttctcagttctagtttttggttcaccatggtcactacattttgaaattcagtaattacacttttcatctgaaagctgattatagattgtcccattttcatagattcaatatgctcccaaattattaccataattggaaattttcaaaaaattccttggactttttgtagtaaatctgtcttgtagaacattttctctgatatttcagattttacattttatactatcaacttatcataggatcaatgattattctcttgattcttccttattgggtgtattagttggcttagaacgtcacagtgcggtaaaaaacaacaagtttatttctctctcatatgcagccaggaactctaagtgggtggtgggtctgcaccacacattcaggctcaagaaaatctgctgtcttcaacatgaatttccagatccctctggtcattggggttctagccagtggagaaggaaaaagtgcatggaagaggtacctcccctctcctaaagggcctgggtccatatatgtacccaggtgagctttggcccaccttcaagtggaattaattcagtcaaatggccacctctagggaaatggggtctagctttgtgtccagctatgattctgcactgtgacaaatggcgagagtggattttggtggcagctggagctctgtaccatcttaatgaattgagggagagggcttctaggttgtgcagttttgacatttagatgggttctgatagagattgtgtcattcctgagccaaatcttctcccaaaaaaagaaagtgtagattttttatagttgtaattggccagatcaaaggtttgtgaggacaatagaaagaaaatggacagagacagctacctgataatcagcttctgtactgcgttaaaaagattttcttcctgaagtgttagttttttcattccccagtttgctggggcactttctcctttcacagcagctgacgtactggtcttcatcaggccccagccaccacagccccctctgctttagttagcaagctgtgtgagccagccgggcttgggggacactgagactgccactctgtgctggccctgagtgtgaccagtaggatctcctgcccacctactgccctcccacccatgctctcctcaggcaggtcctgccagcatgagctcagggtgttggtgtgaacctgcatggtttgattaagttactgcccaaccgactttccccagcctgtggtgcttccggttatctggcctgcccttcactttggcctttccttcatgatagagctggtagaatttctttgacatttcttgcatgattaatgaaccttctctgctttccagggccagtataggtcttacccctgtttttatatccctttggccatttgcaatagaaatttggcattcatctattcccatatttcttgtttatgaatatttaatgagaccgatactgtgtcaggtgttatgcttagctctggagatgcagtggtgagaacaagtaaatgtagttgctgtcttttgaagtttgctggagagcggagagagcgcctgaggaaagacaggtgggaaccaaataatcatgcagagaaatgtaaatcacaactctgcagagtgccccaaraactgacaacagggtcatcttcccaggcagtgggtcagggaaggtatacagaaggagggggactttggtagaactgaaggatgagtagtagggttttttaggggaaggtgagaaaggagggccttccaagccaggaagtcccaagcatgtgtccttcggtgagaagaagtggggatgctggaatagaggtgggattgtggcacagtcatatttgcagtttgcataatcacccaggctgcaggcttcgttgtgaggagccgcttggagaggagcagtggtagatgggtgtatagactcagtaggaggtggttgtggtcatcaaggtgacagatgatggtgacttgaatgaagatggggatggtgaaatggtaacggtgatagtcaaacccattagcatgagctctgtctttatggatttcatgagttcaaagggagctgaatttctttttaccatcaaatcgttaaatttgttcttcctttttttcttgaactttttaagcaagacaagcaatatgcttcctgttctaaactcaacaaatgaaragagcattattacgtatgcctgtgtctaaaatatagtgttttatgatgtttaatttatatttttatatgaatgaatgactatcagctcttctcccaagccttcgactcctagatgagactagttatagtcaggactgtctctagcaacctctattttaagggtaacaagtaaggggagggtgtgtcccacgtctttatagacctatgtcagacattattaattgatcatagtgctcttttcttgccaagtccagatgtcatctcagaatgcttctcccaaagcccttgaggcagcctataccagtaacactctacctgaaatctacttgcttttccctctattttaacagtgagtagaaacccacaaagaagctgttgatgctgaatcctctatacttcccctgtgaaaacggcagtgaccctatgatatctaaatttatctttctcttgtactttaaaattggcctctgtaaagttagagacagtccaccagattaccctcacttctgacaccaactactacagcgttcaggagtccccaagaccactctcaggtttgatagtttgctagaaggactcacagaattcactaaaagcttctaagctcacttatgatttattacaacaaaaggatacacattaagattagccaagggaagaggtgcatgggacagagttcgggagagttccattgcagagcttcccattgtcctctcctgatggagttgtagacagcattaactcctcctggcgatgatgtgtgacaacatcagcaccgagtggaatgttgctcatcaaagaagctcacctgaattgcggtatccagagtttttagcagggcttgatcccatagatgtggttgaccacccacgtggctgacctgagccttcacccctcagaggtagagctgatactgtgtgacccaaagccctcactataaatcagtgtggctcagagcccctaagtaatcagacactaacacaggtcattcccaggtcttagagatcacctcccagaagctgagggcaaaggctagacctctgtttggacaagttgaaattcatgactacacagcctcttgggctcatcctcagtttagcgaatagtgtaatgatctgatgtcatcaaaaaaacatttgcttttagaaattattttgcaggagaaagatgaaatataaaaactgaacctaatcacggacattctctggaagatggttagggagggtggtggttagatgaggacaatgggtttctggggtctggctacctctgttcacatcccagctctacctgtactaactagttaagtgactgtagcccgttattttacccttctctgcctcagtttcctcgttcataaatgagaataataataatacctaccttgtgttattatgagaattaaacgagataatacatattaagagcaaaagaatgcatggcattcaacaaataccagatactgtttctatatttatcgtaggaaaaatttatcaatctcttttaagtaattttccttgagaaaattcattgcagtttttccctaaattttttctattaatttttataccatcgtatctcttaagcactagtgaaaacgtgaggtaaccatctttcctgagaaatcacatttctgttttgctgagtgagctctgagttagagaggtgagaagtgcccctcagggcagatgcgttctgatgagtctgctgcagatctttgttgcaaattgtgggtagatttaaaggctaaaaaaagatgtgttgctttcccaagtcactactgagaaaatctagaaggagaaaataagttaaatcttgagtcagtaattttggactcaagtgccaagccctggtgtgttcactcacctctttcgaacattgggccccttggagactgtctatttgcaagcatcaccttgccagagctaaaacacagtctgcctgcctggggagggactaattggccttttggaaactgtttaaaactgaatgaagcacaggcgctttctccgatggtagtagagccttgagttcttgccagccactaattgttctttaggctttcctgtgaaggaggctgaacttgagagytggcttttggtcttgccatctgtgaactgccacttgtccacatgtggtgtgtattaagattgtttttgctgggagcatcagtattggaatgtgttccaattaaaatgtgatgctcttgttttccactcttgcaggttaggcattccttactcttgggttcccaaggacagtgggagccaactgtatgagtacctgcctgatagagctttaaaaaaactgttagcttctaggctgggcactccagcctgtgtccttagatgtggcttacttataggataattacatacagatagaagagacattgtaaatgcttcctaattgaatgctttttcccccctagcttatttccagtgatgctgatggagccatccaaagggctggaagattcagagtggaaaatggctcttcagatgaggtaaggaagcctccccacttcctgtaatgccaccaagcacatgattatagtgcctgggatatagcagtgaaagagttctggaagaggtaaatagagcttttcagagctttgcttgaagcaaatggaagggaaatgtcagtattctggcatggaaggtgctattcatagggtgacacataccctttaaaagatctatgttaaaaccaggtagacacaggaagttgttctgccagcagtgggaccaaagacaattctgccaccctctgtgaatggtcccgagtcccagtacttcctctgccaggctgatcagcttggcacagccatccgagcagtgccagggtccaggagggagatgccaaaaattactgcaatgacaaaatgtcaccaggaaaagaggctggtactgcctactgctccttgggccacgcctactttctgggctctctgggtcttccttgctgcaggccacagggactcaccttgcttttttttttttttttttttttgccactaccctctctatcccacggggtctaccctttaaactgcagagtatggcaaaaactcgccagcctttttcttctttgctgcctttttacacggtagctcatcatagctctagttccctgaccctgaccctgggcaaggaccccagccaccctgagcctcatttttttttcatctgtaaattagaaactgtctcaagattattgcaagaattcagtgagctatgtttgtgaaactcctagcactatgcctggcacatagtaagcttcagaagtgctagttatgatgctattgatggttattgttattgtcatcactgccacattgccggttttctcctgaccacctcctaatgcaaattctcggtaaagagctatgaatttaacttgaaagcccatgacatttgggaagtgattgcatgttttcactcttggccttagccatgtacatttacctgacccttgccattgacatgttagccaaatggaggctgaatacccctgaataggtacccacatacttcttgttcagaatgatgttagctgacccacatagaagaaggaactcatggagaattttgcttctgaaccttagaaacatccctctccaaatggcctggcccctgggactagatagcctcaccaccacaagctcaggcagccaagggttctcaggagctaagccaggcacagaggcattgagttattgctctccagtgcttggaaagctagcggccaccatgccgagtttctactttgagagcccatggaggctgtataccttgagacatctttctgctaccaaaattttgcagaacttcagcccagcctgaaatggacaaaccaaactggactttgccaccctacgtaagcacaactctggcccctgccgcatccagtgtctggaggaaatacayacctcccaggaaagacatcaatggggccttcatgtgatccttaatcaccatacacttggcagtcaaacactgctcacctggccctgccatacaccagaggataggttctgggacccagtcaggggttagaaataacctgtgcttgggtcatgatcaggagtggcttaagagtcagacttcccagggttcaaatcatggccctacaactcaccagcaatgtggccttgggcagttcagttgacatcttgggaacaatttgggggagttactgatttcacaagtcattgcagtctgttgtgttcaaaacacagtccgtctcaaattgcttctctggaaatataatatcaaggatcgaatactgttttaggttttatttccaccgaaactactgagcatgatgctccattggagcaccttggctgttttgtattggtggtcttcagttaaaagtttctggccaatggtactttctagcctgataaaagaccttgtgggcacttgacttccagagggaaaaaacagctggctttctctgaattaggtaaagcagttagtgcagtaaaggactcactatatatagttgcttaaaaattctcaaacctctgaacaaacaaattgcaaattttgtttttgggttatttgtgcttttattattcaattgtaagagttttttatatagtctggataattagacacttatcagatatatgattgggaaaagttttctcctattctgtgggttatcttttcactttcttggttgtgtcctttgaagcacaaaagctttaagattagatcatgtctagtttgtctgttttttttctttcattgctggcacktccgttgtcatgtccgagaaaccattgcctaatccaaggttgcttggtcactttttatagtttactgttcccttgagataatgtcaaatttgtcttttatttctttaaacatagtgtaatggttttatcatctgcgaccgagaattccaatatgtgaagtttttgtggctgttgtttcattgttttcctctggcctatgctcctcatgtaatgtgcttctgcgtgtgctaggctgcctgattgtgtgctacttattgttcctgaaaatttttaggaataatataaagcctaagatgagttgctttttggtagggaggacttatgtttgcttttgccagatagatacctttaaaccaaatacccatcttgagaccttttaaactaccaaagtgctgcagattacaactacagatttatgtgaaagctggcttgtggtcaccacacctcagagacactcccctgctcagctctgctcggtgctgtgacaacttccttgtagtttttggtggtggaggtggtttcttctgattccctcttccttcagtgtgcagccctttgggatcctagcataatgtggggcagggctcctattggacttgcctaccccagtgggtcttgggatttgactctttgtccccaacaaggtcaccaaaatccaaattcaattttgctgggattgacaaacatcctcaagccaaaaaggactttcatgctgcatttacctctgtgcgttcccacttgcctttcagttttaattggcaattcctacaatctggtaagcactccagtgcttttttcccacccctccccccggccaagacagagtcttgctgtgtcacccaggctggagtgcagtgacactatctcggctcactgcacctccgcctcctgggttcaagcaattcttctgcctcagcctcccaagtagctgggattacaggtgtgagccaccatgcctagctaatttttgtatttttagtagagatgggatttcaccatgttggctaggctggtctcgaactcctgacctcatgatctgccagccttggcctcccaatgtgctgggattacaggcatgagccgctgcgcccggcctccagtgcttttaaggagatgattttaatatttttctagtacttttagttttttcagtgggagggttgatctgaataacctagcctgccattaccaaaaacataagttatatcgggagtgcttttcatataatgtgacaaaacattcattcaactggcattcatagggtcatttcctagtgccagacaggctgagccctggatgtaggattgaataagcctgctgaagtccctgctcctaggggcctgcagatggcagggagagccatcagtaaccaatacaaacacatagaaggattgcaaattttggtaactactgtggcaaaaacagaggaccatggtgcaaagaaacaggaagagccctatttaagatggggtcgtcagaaagcccttaycagcgacagccagtgaggccaagcctctgaacagtgcttctcagactgtccatcttttcaatttccggtcagttgcaggaaattaaatatgtgatcctactctgcataactagtacacagaacccaccttatgcaactcatcaaggaattggatatcatccagattggtctggacagtttcatgagatgaatccactgaacatgtacttacatgccacaggcatgtcagaacactgtaaaggtttcttgtacaccttgtcatggactagtaaacagtttgcagattggcatccatcagaatggaccatactttcctgccttagagttcatctgggccaatccccttcccaatgcatgagttcctgcatcagctttgccagcagttagctgatctgttcctgcttgagtgtatctccagtaatgggaaacttgatacctcctttataggacttttttcctcctgacaccaatcaattctgacaccaactgagtgtcctacaattcaattctcacaccgactacctggagttagcgtcagactccacaggtttaagggctcagtcccacaagactgtcctcatttcagaagccagtcacaagcattgggtccccagattacctacattccacatttcttaccaacttggctacaaagtcaggtagccgttaccacagcctcctcctcagcttccataactccctaaaatcactcacagaattmatgaaagcacttttttttttttactattactgatatattataaagcatcagtccccaacctttttagcaccagggaccagttttgtggaagacaagtttttccacggaccaggcagtgggagatggtttcaggatgattcaagcacattacacttattgtgccctttacttctattattattacattgtaatatataatgaaataattatactactcatcataaggtagaatcagtgggagccctgagcttgttttcctgcaaatagacggttccatctgggagttataggagacagtgacaaatcatcaggcattggattctcatgaggagcacacaacctagatccctcgcatgtgcatttcacaatagggttcatgctcctgcgaggatctaatgctgctgctgatctgacaggagacggagctcaggtggtaatataagtgatgggagtggctgcaaatatagatgaagctttgctcacccaccactcacctcctgctgtgtagcccagttcctaagaggctatggaccaataccaggggttggtctgttataaagagtacaactcaggaagaaccaaakggaagagatgcatagggcaaggtatgggggtggtggcatggagcttcaataccttctccagttgtatccatattttcagtacctcaatatgttccccaacatggaagctccctaagccccatgatttaggggtttatatagaggtttcatcaggtaggcatgacttttttttttttttttttttttttgagacggagttttgctcttgttgcccaggctggagtgcaatggcgcgatcttggctcactgtaacctccacctcctgggttgaaacaattctcctgcctcagcctcccaagtagctgagattacaggcacccaccattgtatcccgcaaatttttatatttttagtagagacagggtttcacatgttggccaggctggtctcgaactcctgacctcaggtgatctgcccacctcggcctcccaaagtgctgggattacaggcatgaaccaccacgcctggccaggtaggcatgattaattaaatcattggccatggatgactgcctcaatcttcaaaccctctctcaccctggaggttggggtatggagctgaaagttccaagtttccaatcaaggcttagtctttctggcagccacccccgatcctgcagctatctaggagccccctgtgagtcccctccttagaacaaaagatgttcctgtcacccttatcactcaggagctctgtgctaggaaccactaacaaagaccaaatacgtattcccattataccacamccctaaagcagttaattccatttttcagaatctcttaatttctagaaaggtctttttattgaacataattcacctgtctactgtattttctttttcttttcttttttgagacacggtctccctccctctgtcacctaggctggagtgcagtggtgcagtgatggctcaatgaagcctcgacctccatggctcaggtgatcctccaacctcagcctcctgtgcagctgggcctacaggcgcaggccaccacgtctggctaatatttgtattttttgtagagatggggttttgccatgttgcccaggctgatcttaaactcctgggctgaagtaattcgcccacctcagcctcccaaagttttgggatttcagctgtgagccactgagcccagcctatattttcttttttcttttttttcttttttaacacaaggacaattttaatcctacattttcctatagtataacagcatccattgctagctatctatgaattgaaactgcatttgctaagaactgtgaacattaagaagctttacatgaagtcacatgtgttgatataggcacatagacatcttctagcaccaacagaatacatacgtaacacataccgaatgatcttgatggatawatttgctccaccaggtaattctatttagtaaaattcagttaatgcagaatcccatttttaaaatttacatctttattacacatttttttatttttaaaaagtcattccagattgtaatttgcatggcaataaacagtggcttcatggattcttagtttcttaaagctgtctatagcaatttaaaacacaagtcttcttttcaatttgcagcacctgacttaaagtttaaattcatcgaatgtactcattaaaactgttcagtttctcttatgagaaagacatgtttcaattgctatttcccaaactatctgttgagcatgggtgtgtattgtttttatttggttaatagaattactcacacaatttatagccggaacaaaaacctctagcctctctgaatggccttccactcaaaacagcgatgawaataaatgtctaaaatgtatctggggtctgccccaacttgatatcaccaaacgtgtttccaagtttttgtttttggttttttgggttttttttgagacgaagtcttggctcttattgcccaggctggagtgcaatggcgtaatctcagctcattgcaacctctgccttctgggttcaagcgagtctcctgcctcagcctcccaaatagctgggattacaggcacctgccaccatgcccggctaatttttgtatttttagtagagacggggtttcaccatgttggccaagctggtctcaaactcctgacatcaggtgatccacccacttcagcctcccaaagcactaggattacaggcatgagccaccacgcccggcctgcttccaggttttcttrgaaaatatggtttttaactctatgcataatactctaccacgtgatacaccatcacttctttatttcccagttgttcatttctaccattttatacttgtaattttttatattataaataagattgtaatgaacaccttcatccataagttttatgcgagactggttatttctttagaataatatcaaagaagtggcttactggttcaaacagtacatgtggttttaaggcttttaatataatttactgaataatctccagagtagctcaaaaaagtcctrccgacagtatgttattatgcctccagagtcgacttgctaacagtgaagcaaattcaaccacaaatttattagattctcacctatctcaagattatcacatcaaagaagcaagaagatgtattactggtgaggaagccaaattcaaattctttcagaaaattcactcaactttagatctgtaaaatagtcaacagaaatgcttcccacaaaaagtctacagggcttttccaaaaataaaaagagagaaagagaaaagtcaggccaggcacggtggctcacgcctataatcccagcactttaggaggctgaggcgggtggatcacgaggccaggagactgagaccatcctggctaacatggtgaaaccccgtctctactaaaaatacaaaaaaagtagccgggtgtgctggcgggtgcctgtagatccagctactcgggaagctgaggcaggagaatggcatgaacccgggaggtggagcttgcagtcagcaccactgcactccagcctgggcaacagtgcgagactccgtctcaaaaaaaaaaaaaaaaaaaagagaaaagttagtaccaaatgaccagaattttttatttgactaaattctattccatgcataagcgtgacagtctcctgtgtttatctgactttggcaataaaaaaacaagcagccttgtgcaatggtgccatcttggctcactgcaaactctgcctcccaggttcaagcgattctcccacctcagcttcctgagtaactgggattacaggcgcctggctaatttttttgtttttgtttttgtttttgttttttttgagatggagtctcgctctgtcacccaggctggagtgcaatggcgtgatctcagctcactgcaagctccgcctcccgggttcatgccattctcctgcctcagcctcccaagtagctgggactacaggcaccagccaccacacctggctaatttttgtattcttagtagagaccggtttcaccatagccagaatggtctcgatctcctgaccttgtgatccgcccacctcggcctcccaaagtgctgggattacaggtgtgagccaccgtgcccagccaatttttttttgtatttttagtagagatggggtttcaccatattggccaggctggtattgaactcctgacctcaggtgatccacctgcatcggcctcccaaagtgctgggattacaggcatgagccaccatgtccggccatatatacattttttttaaaggcctgtctccctttggccatatcgagattaagctcaggtcattaaaaacagacagattttcaaaatcacttctttacttctccaagatcttcagtgctgtcatcatttacctctggccagttttcctgaataacatcaattatgtcatctgtaaagtcttcctgaatgataatttcttcctcttctgttactgaggcaccacacaatttttgagcaaaaaatctttgtgcttttttaagatcaatttcaaaagttagaggccacacattcatgttacatgtttcttctctgttgtgggaattttggctgtgtaaccttttctggtatggccttcttttctttgttttatttgacccctttcacctctcttttgtattttattcttctcttctgcccctgctgttccttgaccctcattaattccagcttcttgtttgggtgaattttcttttttttgttgttttttgagacgtaggctggagtgcagtggtgggatcttggctcactgcaacctccacctcccaggttcaagcgattctcctgcctcagcctccagagtagctgggactacaggcatgcgccaccacgcttggctaatttttgtattgttagtagagatagggtttcaccatgttggccaggctggtcttgaactcctgacctcaagtgatctgtccccctcggcctcccaaagtgctgggattacaggcgcgagccaccgcgcctggccctatttgggtaaattttctacagtaagttttgcagattcatttggaaaattcttctctaaccattatctacatttagcaacattaggcatgtatttacagtagcctgttggtaatgaacagactccacaataaaggactcacagtgggtaatcagcatctaactcggccctgttccttaggtctcctttgcacttggccccataggattcagaaatgtctgcagccatttcacaaacccaggtggttccctctgctattgccagttgaagcgacacatggaactatcatctgtattttccactcagtgtttctatttatattctccatagccccagactgtaagtctgagccctcttcaatgtgacatctgttgttttcctcctaagacacaggatcagttccatcattgtcatccttattgctgttccttggacacatgtgaggttgttattgaaccttttggaccaaagtgctcagaaccgaacacagggctctgggcatgctccacacagccacagagtggagcaggctcatcccctttcttgctgtagacactctacctctttttatggaccctaatgactcattatgaacctacaatatgctactttgcccaccccccatctttttcacatgtgctggtgtttagctgtggagcagcactatgatataatggagactattttggagtcaaacaaacctgggttcaaacctcagctctaccactctctagtttacaattcagtgtctctgtgcctcaatttcctaatgggtaaaaagggaggggaaatccttccttataccatctgagcttgtccttcagtaatttgtattttgtatctaagtgwaggatcttgcattgtctacattgaatttaatctcattagtgtgtctcataattcctaattgtcaagactttttggtgacatcttgattctgtcacctgtcctgttagctaacccactaagcagctttattttaccttcagatgtgcttgtcttgccatgtgtgtgcttattcagattattaattaaaatgagtgtgacccctgggtggatcactggggacctcccttacagctcacttgtatgtatcaattagtagatggtgcagcagaggggacaatctttcagctttttacaaatctatcttccttagcattgggaggactttttttttttttttttttttttttttttttgagacagagtctcgctctgtcgcccaggctggagtgtgcagtggcgtgatctcggctcactgcaagctccgcctcctgggttcacgccattctcctgcctcagcctccagagtagctgggactacaggcgcctgccaccacacctggctagttttttctatttttagtagagacagggtttcaccgtgtcagccaggatggtctcgatctcctgacctcatgatccacccacctcggcctcccaaagtgcttggattacaggcttgagccaccgcgctcggccgggagaactgttatacactgttggaggatatgaaaattaccacaatcttttgggaaggcaattagcaataattaaaaatgtgtataccatttggcaagaccttctattgctaggaygtatattgtagcattatttaaaataggaaaaaaactggaaacagcatcaatttctttcagtagaggaattatcatgtaaactatggtccatttacacaatgaactggttagtggccattagaatgaggtagacacatatgtactactacacaaaaaatgtttaagatacatgttagacataaaggcaagttccagaatgacttgtttaatatcatgccatttttcttaaaaacaaaaaaatgggaaatatgctcgtcaagatgcgagaaaatttctgaaaagatacwgaagaatataatagtaattgtttctggagaatggaaatgggagctcagkaaagaagctggagctggaggaccttaactttccacttgatgccytcatatactgtttacatattttacaagcttatattcattcaactgaagagttgaattttttaaaagaagaatctatgtagttgttaaaaagaacaaaatagatctatatgtattgacatagaaatattcccgggctgggcatggtggctcacgcctgtaatcccagcactttgggaggccgaggtgggyggatcacgaggtcaggagatcgagaccatcctggctaacatggtgaaaccccgtctcaactaaaaatagaaaaaattagccaggcgtggtagtgggtgcctgtagtcccagctactccagagactgaggcaggagaatggcgtgaacccgggaggcagagcttgcagtgagccaagatggcaccactgtactccagcctgggcgacagagcaagactccatctcaaaaaaaataaaaataaaaataaatattcccaagatattttctttagcagagaaaaatttttcagtgtaatatctatactactgtcccatttatgaaaacaaattatgtatatgtatatataggcttatgtatgtatatatatttttgtatgtatatatgtatgtgaatgtgtgatatgtgtgtatgtgtgtataaagtaaacacatctttgtaaatgcataaaaagatctgggattattcagaccaatctagtagcatggttattagagggaaaagaagtaggttgggtcatggaggatgggggaaagaaaaagattttaacctttgtgtagtttcacatttttataatcagctttcatgcttacatttgtaattttttaaaagttttagtttgttttttaaaagaatccattttccctactgccatgttatctcagcagtttaacctaggaactgaagtaaaatcagcgtaactgcattcattcatgtattgaactcactctggaatagactctatgaaaaatcaaaggaattattttaaaactgtggataccatttgtattctgagtttctgtattttgtggattccctgcttaaagtcaaatatttgagaacattcaaataaaatcagggtgtcatatatggattttgattacattatcctcaaaatatcctggccagattcagtcttcctccgtcacatcccacaagtataagtagggggtgggggaagataatgaagacagtgagaagctttggtgggctttggatctgatgcagaaatgattcaggacttttgggtctctgtgggcatgtacaggcctgaatgcagcatggagcaacttgagttcatttccctctgttgtagcctttcacaaatgtttacctaaagggcataaaataagcatgagtgtttgcaatgttaaacttcagttatctggaaagtgtactcatcagcctattttctcctaactttctagttgatgtcaaatgaataatgtgttcctgtttcattgtcaccttaaactcctatagacagagtttctatatctccaagatcttttgtaaaataggtgacacttaaattagttaggatttattgtaggttaaaaccacaattaggtactacttcaccaactccagaactgcaaggactgaaaagctaaaagtttggtcagagaacatggaacaactagagctctcatatatcttgctaataggagtttaaattggtgtgtgtatcctctttggaaaattttttggcagtatctgctaaaactgaacacacatacgtctgtgtcaccggatgtatacccaacagaaatgagtacttgtatccaccaaaagacagactcaaaatggtcatagtggctttattcttttttttttttttttttttttttgagacagagtctcactctgtcacccaggctggagtgcagtggtgtgatctcagctcactgcaacctccgtctcttggattctagtgattcttgtgcctcagcctcccgagtagctgggactacaggcatgcgccaccacacctggctaattttttgtattttttgtagagacagggtttagctttgttggccagactggtctcgaactcctgacctcaggtgatccacccacctcggcttcccaaagtgctaggattacaagcgtgagccaccaagcccggccagtggctttattcttaatagccaaaaaccagaaacaatccaaatgtccatcaatagaagaatgaatgcgtaaattgtggtattcttccagtggactactacatggccatgagaaagagtgaaccactgccacaccagtaacacaggtgaatgttgcagaccgaatgacaaaggataaacgcctgactcaaatacacatcatatgatttcattttcgtaacgctcaagagcaggtaaaacgaatccatggtgatagaagttaggacagtggttctcttttggcatgtggttgagtaatgactggggaaatgaacaagggagccttctggaatactgaaaatattttctatattgatctaggtaatggttatgagggtgtataaatgtaaaaaaaaattatttggctgtacacttctttgtgccctttactgtccactagtactacacatcatcggaacctggagcttgtgttcagagttcttcttcagggtcctgggaaaagtgggattttttttgttgttgttttttgttgcctagtctccattgcttttgtcagttcctgcatgtatttttgtctttacacctcatcaaatgtggttttagcaagggatgggaagtgtcttgctctgtaagactcacaacatttttggagttgggttatttcccctgtgttttggttaagtattcagtgaagaggaaagtgaaataggtaacttttattttaattttttttaatttttaattttttttcttaagaaacagggtcttgctctgttgcccaggctggagtgcagtatcactatcatggctcactgcagcctcagccttctgggttcaagtgatcctcccacctcagccttccaagtagctgggactacaggcacacactaccatacctggctactttttattttttaattttatttatttatttatttatttcttgtaaagacaggatctaactatgttacccaggctagtcttgaactcctggcctcaaataatcctcccaactcggcctctcaaaatgctgggattataggcatgaaccactatgcccagcccagtaattttttaatcattaaagaaaactcctcatattgacagttggtattcagcatgccagtgcctctggagtcccatctctccctctgcgatgctgagcagcaccttgcgcctccctgtggtgttccattctacacttggcagtgttcaaatctctgggaggcagacagttgcaagtgcttcagaagcctagggcatgcaggtcattttccatgcctttgaatccccttggaaatctgctaaaacccctagaccccttctcagaataatgtttttaaatacatgaaattaaatactaggattacraaggaaaacagttgtattgaaataattatcaacatgatttttgaaacctaatttatgatacagtaatatatatgattttaaaatacattaaataggccagatgtagtggctcacgcctgtaatcccagcactttgggaggctgaggtgtgtggatgactcgaggtcaggagttcgagaccagcctggccaacgtgacgaaaccccgtctgtactaaaaatacaaaatgcagtcaagtgtggccgggcgcggtggctcacgcctgtaatcccaacactttgggaggccgaggcgggcggatcacgaggtcaggagatcaagaccatcctggctaacacggtgaaaccccgtctctactaaaaatacaaaaaattagccgggcgtggtggcaggcgcctgtagtcccagctactcaggaggctgaggcaggagaatggcgtgaacccgggaggtggagctttcagtgagtctagatcgcgccactctactccagcctggatgacagagggaaattctgtctcaaaaaaaaaaaaaaagctggtgtggtggcacacacctgtaatcctatctactcgggaggctgaggtagtagaattgtttgaacctcagaaacaggttgcagtgagccaagatcacgccgctgcactccagcatgggcaacagagcaagactccgtctcaacaaaaaataaatacattaattaattaattataatacattaaataatgaatctagcagcaggcctcataaatactgtaattttgaaaagtgaagagtgtaaacagtattttaagatatcagcaatcactataatgaattctgaaaatatctttgattttttttttgtcggcatggttaccagaactgtccattctatagtttttttgcatatattcataactgaatgaaacactaaattttagttagaacttagggaaaataaagttatatttgttttgccccatccaagtttatgccccgctctctgtgctgaattcttttagaactggcatagagcattgtttctcaaagttcagttttcatcagaaccacttgtaaaacagttgctggttccccactcatagagatcttaaggaagaagtttacgatgggcccaagagtgcacattttaacaaatttgagaagcacagaactaagatctgttgctgctacctgaaagaagcttgtctgtgccatccacgcatctcttggaggccccagaagtttaaacgtcctgatgacagcttaggagtktactctctaggcgagagagaaagacgttcatgacagtgttgcttttagtagaacaaagaaaaataactgtgataggcaactgatcaagcacaataatgtgcaattatgcagtgaatacatggagttgttatgatgtaaatacatatttattaatagtcatagtgggaaaatgtgataccaaatagtatgcctattgtgatctctgtatatgcaaatgaaaaattgtggaacaatacacgaaaatgttaatttgaaaattcaggtgatttttgtttaacctttgttttctaatagggctaacaagttttttttaatgtgtcaagtaaataaaagttttagaaatactaaaaaataaaaaaataaaaagataaaaagtttactctctaggctctgctctagctttgtaggatccaaggccttgggaccatgacaccaaccactgtggagtctggctgaggccagcttccttggctggactccccctatgtctggtcagctgatgcctgaggctggctggtgggtcatgccatcgctgcatgccctgcagtgtcatagtggaaagacctggagaccaggagtactgccagtagttcatggttataaagtaaataactgttgataatgaatcatgcgaaagtcctacaaggaacaaaatccaatgatatgctttcaccaaaaggtaaaaactaagaggtaatatcttgaataggtaatcaaaattaacatcaccactgaggaacagatgggtattttgaaatatgataagctgaggacaaacctcacttacatggtattccagccaagtctgcataccctgaatctaactggggaaatatcagacaaacccaaaatgaggagggaagatgctgcattcttcaaaaatgtcaaaatcagacacaaagaagggaactatagacactggggcctacttgggggtggaaggtaaggaatgaaaaattacctattgggtattatgctgattacctgagtgacaaagttatctgtttaccaaacccctgcaacacacaatttgcccatgtaacaagcctgcacatgtaccccttcaacctaaaatacaaaatggaaacaaaaaaaaaaatagtgacagtcaaaaaatgtcaatgtcataaagacaaagagtcagtggaaatgttgcagatgaagggagtctaaagaaacacaatgaaatgatcctgtactgaagagagaaaatgcttaaaatgacattgttgactcaactgacaacattagaatacagatggcatcaatgttagacttagaaaagttgataaagctctactgtggttacgtaagaacatagccctactcttgcgaaatacacactgaagtatttagggatgaagcctattattttacatctgagtcttaaatggttcagaaaaaatattgtatatgtgtgtatgtttgtgtgtgtgttgggggttgtgaacaaatgagccagtggggtaaaacattaacagtaggtaaatctggtaagtaaaaggtaaacatgcttttttacactgctcttattcttgcagcttttatataaatttaaaattatttccaaataaaaattcatatgtatgtagcaatagctagttttttaaaattccagaaaatctgataaaagcaaaataatactaaaattttcacctacgtttttactccttaataggcttaaaaggcaggacataaaaaaggacacagaagatgatgtaatggttaagataaaaaaagaaaaaagaagaaacctctggaattggaactggtttcagttccagctccactacttattatctctgtagccttgggcaacatgtttaaactctctcagtctcaatttcctcatctgaaagtagggggataaaatagaatctatctcataaggttgatgggtggttctggagataatgcatataaaatgcttagcctaatacttggcatttagcactctctcaatgcatgtcagtatttccagagcaatgacaaggacagagagcttcccgtttcattttataaggtaacataaccctgaaagcatgacagaaatacaaatagaaaggaagcctatagatctatcacacaaatatgatacataaatcatttgttaaagtcaagcagtatattaaaagaatactataccatgacctagtagggtggattccagaaatgtaagaacctttcaatgccagaagagctattactatattcattattcattcattacattacatactgtgattccccccatttaacctgttctctcaacagttgccccccaaaaaaagcttttggtaaatttaattttcattcctgagaaaagcctctttgtaaacttccaattgaaggaaacatctttagcatgataaagaaactgaccacagacatctagtaaatcgctagaggcatgtcaaagtcagagagtatgttccagtagtctgtcttacatacgtggcacgatggagatatcaacaaagctgcaatagagtgacatcagtcatgygggaaaactgacatctaacacagtctcagcccagaccatgcaagattcagacatttactgtaaacagtaatttaatgccttataaggattgagaatgatagagtgttcaataagtagaactgagttaattgataaatgatttggggaaaattgatccttcagagcatacatcaaaataaatgataaggaatgaactataaaaatgaagcatctaaaagaatatagaggtaaacagtttcgttaatgctgggatgggggaattttttatagtaattaagcaaaagccataaagggaaaaaaatgaaaaatttgcttatgtaaacattttgaaacatctatgtggccaaaaataccatagaacaagtttaaaagcaaaaatttgatcagaagaaattatttgcaatctatttcaaagatttcacaaaagaatacaataatcagaaaactggcaaaggacataaacaggtaacccaaaaaataattgtaaatgaccaataaaaatatgaagaaaagcttcaatctaaatgttatacaggccaggcgtagtggctcacacctgtaatcccagcactttgggagaccaataatcacttgaggccaggagttcgagaccagcctggccaacatggtaaaccgcatctctactaaaaatacaaaaattagccgggcaagggggcatgtgcctgtgatccctgctactcaggaggctgagacaggcaaatcacttgagcccaggaggtggaggttgcagtgagccaagatggcaccactgcactccagcctgtgcaacagagtaagactctgtctcaaaaaaaaaaaaaaaaaaaatacattttgccattaaattgtaaggaggcaatgttgacagtatagggaagatggtaccctcagccattgctggtggaactataattttgtatcagtcctcctagatgtcagattggcattgtgttgcagatcctcgacaacatgcataccctttgacaaagaaatttaacttctaagaattatcctaaagaaataattgaataagtaagtatgcaaacgtggaattagaagatgataaattttatttacaataacaaaaattggaagcagcctaattgtccagtattattagttgtatctatataataaaagagtatagagccaataacayaggattatatttattgacatgtaaaatagttattggcaaagcaagccacaaaactgtatattcaatataatttcatcttattaagaaaaatacgtatgtatatgcatggggaaaaaaaaaaacagaaaaaacctaccaaaacatggattaattctagatgaattgtgcctgttacaggggtaacaaaaagaagggggttcctctagggggcaccaactcccaaatactgtggaagtttcagcccagaaaggagaggtacttggtacccattttaggaatagctgaactcaccggttcactggttatttttcctacaccccaaaggcctcctggatgcttccacgatgtgaatttagactgggtgtcttttctaatgagaacatgcagccacagcccttgggtgtatgcttttaacaatgatttttctggttctttggccgctggttcattgccaggttcatgtttactttctgaataagcctcttaatgtcacaactttgttccattacagaatgcaactgccctgcctggtacttggcgaagaacagacgtgcacttagagaacccagaataccacaccagatggtatttcaaatattttttaggacaaggtaattatgctattgtggtggtagggaagaaagggtattcaaaatggaagttagtgttcatataacttctggtatcctatatgagtgaaactagccattttaggaacactaacatcagggcatttcacttcaaggtcagtagtaagctttgtaggctaaaagattcagagtctcagccctaagagtttttgctcatagtttcctttttttatggacagtcatttttatccctggagagctaaagattagatcatctgaaaaagtgatttgagagataagacgaattttccagggtggaaaaacaactttagacctaacaaggcaattgccctgtctatattgggttttgaatacttagttcaaggcaatgagggaaataattggttccctgagctccagggcctgtatagaactagagagacattagactgtagactctggcatcattcatacattcaaccatgacaagtatttatcacctactacatgccaggcaatgtgcagagcaatggggatacaggggcaaagacactcatgatatgggtttggatcctgatcctgccattattaatcaaaggacsttacactagctactctccatttctctgagacgcagttttcctttctgtaaagtggagatattacgagtgcatatctagtaggtttgaatggaagtttcaatgagatatgcaggaataatactaagcccagtgcctggcacataccaacagctcagtcattaatagctatgtacatttaaagtgaagggctcaagtgaaaatatacagaaaggtggaaaacaggagtgtggttaatgacaaaagatttggagaatggaagaataatcactattttgagattcaaaatgagttagagaaattgcttctcaggctaatgtattcatttgtagatatgatgcttgaatgatgaaatgagagtgagcagacctaaatgatgcctttaaagaaacctgactgtgtattattgtaagaagttcctttatttggccaggcaaagtttattggtgtgtgggggatacagaagcagttattttaaaaaaggaaatcagcaggaaaaccgtcatcttcccaaacgcttgcaagtagtgctcagagcagtgaggactttagagaaaaatggcgccatgagtttggatgccttcaggtgcagtaacagaaaacctgactcaaactggcacaaacagtaaaggatataacaaaaaacccagaggcagggcaagccccaggcttgggggattcagaggcccagtaatgtcaaggacccaggccttttccgtttttctgcttccccatccttagtgtggcagcttggcccttgggctggccctgttcagggtcacaagatggattcaggaattccaggcatcacttctagactccaccaggtccagaggaagaagaagrcggtatttaggagtgaggaagcctctctagaagccccttggcagatttctccagtstcattggccagaatttggtcacatgttcattcctgaaccagtcactagcaaggggcagaggaatacatgatcccccgagagagatcagggtccatcccaagctggctttgggattattgttccctgagcatgtgggaagggctggacaccacctgcagtgtcctctaccatctgtggytggcaggatcagttgcattctcactgttctaaacctttcttttccagtccatcagaactacattggaaacgatgccgagaagagccctttcttcttgtccgtgaccctttctgaccaaaacaatcaacgtgtccctcaataccgtgcaattctttggagaaaaacagtaagtatatggctcacacttgaagcaaaatttatgcatcagtttcaggagataacccctgtgctgtggaactgtgtgccagtttcttccagggcatgcctcatagtcttctcgtgattcacctctgagaagttgacagtgcctttgcccaaagcaccttattttctgcaccaggagactgttttctggccttttgaaaaaaaaaaacttatttattttatgtttgctaattaccgcattctagtctcttctggtttaaatattttctttgggatgactttgtctcttttgggcaaagaatcaagcctttacaatttttttgcctcctcctgctcctcttgtggttggtatttgtgcacatggggagagggcttatgagacctaatggtcacagaagagaactgtggatccacatgggccctctgtctgacttccgttgtggagtgactgatccaacctctgaactcgtgaccacggaagtatagttgattcctctggctcttttgggtcattggaaagcatttgcccctgaaacccacagtgccagctatttgccttttgttgtaaagtcactccttgtcctgatcccaggtctccgctagtctctgaatctcttagaagctctccatcccttcctggggcacatccgctatgagctataggtcagatgtgaggaggcaggaccattgccataggcctgtgtgtgtcatacttctggtcattaacatttgcagccactgagttgctacccttctccaagttcaaaccaggtgctgcctggacttaagattcccgtgcaaggccatgcccgggaaggggcctctggttcaaatgctctgaggtgcctccaggtcttcccttgacagatttacagcatcccacaatgccttcaaagcctgtccttggcatgggggcatcaagagccctggcatccacctcttggctggcctttcttccttcaccccttccttcctccctccctccccctccttcaccctcccsctccctccctccctccaaggcaggagagggtgggtttcccccttcttctacttttctggaatggactttctcaatgtccatatcttcttcctccaggaagtagcaatcacatcctcactgagatggctgccatgtatgaggagagacagagtgggacaaatgcagggggaacatttgcttattttaatttccaaagatactgtctatatgacattataagttgtgataagcactctgaagacagagaatgacagagcatgctacaggagccccacttagatgagacagtttagggaaagcctcctgaggcggcgcccaggaaacagaggcctgaagatggaagggagccagtcatttgacgagtagaaggggaatcagagagtgttccaggtagaaggagcaacaaatgtgagacaaacaagggttactcatacctggtattagagaagccaaggaggtggaatttaaatcccaggactgctgtgaaggcagcataggggcagggcatgatgagaagtgccagtgccttcacccaacacctcttcccttggccttcagttatgtgccaaggacaatgagagggttctcagctgttgatggaagtgctgaagggagggaggaactgagaaatcaaaactgagcattggcacaaggggtcagttattaagcccctcttggcctgaaactagtgctagaggctatgggaagtccacagaaatatgtgattcaaccctcgctctcccaactgccagcacacatcttctaggttataaagcagttagaaaactagctaggcccagcacagtggctcatgcctgtaatcccaacattttgggaggtcgaggtgggaggagcacttgagcgcaggagttcaagaccagcctgggcaacatagcgaaaccttgtctctatgaaaaataaaataaaaacttagccatgcatggtggcttacacctgtaatcccagctctttgggagggtaaggcaggaggatggcttgagtccaggagttcaaggctgcagtgagctatgattgtaccactgcactccagcctgagcaacagagcaagaccctgtctctacaaaatcaaagtaagaaagataaaaaaaaaaaaactagctaaacatataactctactctacacagtcttgcatatctctactgtgtttcttctaaatacacagaaatggctcacacaaataaaatatgaaaaatgatttgtacttattttgaaaattatatccaaacaatacagcaagtgaaaagaatccaactactcagagataatcactgcaacaggcttctagacatccgtccctgtagacacacacctgcacacacacacctgttacacagggtaatcttcgatgtgcacttctgcatccttgctgtgctcactgggtgtagcctgatacatacatgcacttgactctacctgtgcatttgatgcttcccctgaacacagaaccattttacttaaacattgactctggaagctacaaaagggaggagatgaggaagagctttaccagtttgtggtgaagaaaaacacaaatccacaatcccaggagccctgagtttcgcacccacataggcagctcatgaaggtgtcactgtcacccagtgcagcactggagccctctgctgtgccacacattcccccgagctgcccttggcttctctttaaaactgcctttgggctgggcagggtggctcatgcctgtaatcccagcactttgggaggtcaaggcagaaggattgcatgggaccaggagtttgagaccagcctgggcaacatagtgagaccctgcctgctacaaaaaaaaaataaaaataaaactgcctttggagtgttgggtaagaagaaaaggtagtcaaggtaggatctaagctagaggggcagattcaagaccatctcttagacagggaatgcagtgtaggctggagccagttaaaaagcaaagccacagaagaactcgggtttcaatgggaaggacctgtagaatcagaaaacgtgtatttctatcgtaatattcatctataattggaaaaaaatttaatctctgtagcacaaactacaaaaagaaaagctcagcccagtttccttggctaatggagaacccataagaagggctctctctagtgcaacttctcatcctcagctccaaagacatcctcctccctgggctggagaggggtgagagtagcaggtctccaaggatgtagttatgaaagttttgtttatgcaacgagaccatgggcttggaaagctcaaagaactcctctcccttgccattgttcagagcttggacagatgaattggcagatgtgtcccaatagcacaagaaaaatcatatttctttgcccattccctaaaagaaatgttcttaccctcctctagccgtttgtgatgacaattttattactaatcaaagtcaggaagaaagttttaaatgtgtggtatatgataatcccttttgctaactgtgtagtgtgaacctttgtggatcctaaatctatgtcacctcttcttagacgattaggaagagaatagcactcatctgttcctgggtggtgtggacgggagactgaatcacttaggcaattcttcatttcctttttagtcaaaatatattcattgagtattcctataatgagtcacagttggtactcatttaggagaaaggagactttaaataagaaaacacagataaatgtaaaagtgtgcattatgaaaatgtctctgaaagattcaggggatttctagttcaaaaagtttttgactgggagacattatttttgggtcccattgaacatgtggagactgttgtcttatggtctttgaggcttatttgatgcttggctcagagaccaaattcccagccgggcgtggtggctcatgcctgtaatcccagcactttgggaggctgagacaggcagatcacttgaggtcaggagtttgagaccagcctggccaacatggcaaaaccccatctctactaaaaattagccaggcatggtggtgcatgcctgtaatcccagctactcgggaggctgaggcaggagaatcgcttgaacccaggaggcagaggttgcatgagccgagatcacaccactgcgctccagcctaagcaacagagccagactctgtctcaaaaacaaaacaaaacaaaacaacaacaacaacaacaacgaaaaaacaaattcccttctcatctggttcagatggctcaagtgctctccataatacctaagacactgaagacctgtatgttgaaggccatgctgaaatccacacatgttggggtggagagatcctggaagttgctatcaaacctgagcaagattgttttcagtcatagaatgtgtttattcatatacattccccttraggagaaagaagaaagactgggcatggctttcttttgaatgacccgagaggctcttttggagaaggaagttgtagaacttgtcactgatttgatgtttggacttttccagggtacccagaaaatatgccttccctacagtcccacaaaaactctttctgtgaagtccatcttaaggtgagttctaatgggtagaaaccccacacatggatttggagccctttatacactgtttttgcctgtgatcattctgatgttacctttccattgtcttgagccttgactgtgtgtaagatgttttgctaagcacttgacatgacgtgcatcacctcgtgtcatcatcacagcaaccctgtagggcaggtgctgtgactgtgccattttatagatgaaatggaggttcagagagagaaagccaagatcatatagcaagtgtgtagtggaaccaaggcctgagtccaggtccaactgattttgagcattgctcttaggcatctctccttactgcattagttgccagcttcttttttcttgcatgcactcagatactttagttttataaagataatcaagaaatatttttccttccatttttctaccttgaaatagaaacccagatgtcagcaaagaatgtacttattcttcgccagacagaacgttaaatggatggaacatctggctgcttcctgctcagccacctctcgtgcccccaccctcccacctccctctcatctctctcccatgcttaggtggcagcctcccctagggaatgccgccacttggatccagcctgttgctttgttaccagctaagatgttacatcatagctatggtagcttctgtttgtcaggcactgtgctgaatgctttatgagtgttctctgagtcaatctttagctccatgaagtagatctattattatctccactccacttatcaggaattggagcctcagagaagtgaagggatctgacaaagatctcacagctggtaaatcacggagctggagtccatgtgactccagagcttgggctgtttaaccactaatgccctatcgtatgaagggcaaagcttatctcagagccctagtgatttcctctctattcgtctgcagctacatggtggtagatgtgtttccagtgttcccaggtgacacctaatagctacaactcatccttaccaaaatggctcttacagtgacaaacttgactctatctgttggggactgcatctggctgactgaaaggcaccaaggccgggcgcaatggtgcacrcctgtaatctcagcactttgggaggccaagtcaggcagatcatgaggtcaggagttcgagaccagcctggccaatatagtgaaaccccgtctctactaaaatacaaaaattagccaggtgtggtggcacacacctgtagtctcagctactcgggaggctgaggtgggagaattgcttgaacctgggaggtggagggtgcagtgagctgagaccatgctattgcactctaacctgggtgacagagtgagactgtgtctcaaaaaaataaaaaaaaaaggaaccaagattaagaagtgaaaaatgttatatcccactttcaagcttagtttggtctccagattgcagaccttttcctgtctgctctgtatcttctgatttttcttctgagcagttctaaagcctgagttaagcctctccaccaagaggctaacatttttgctgagcacagaaatatcctgctgctttcaaggaactataaatcttaatttgcttggagagtaataccttaaattatactggtttaagatttctgtgaattcttttttctaaaaagaagtttactctagctcctttcttctttaagaacgtttaaaaactaggcatttcatttgttataatttcatttagtttatgagcaagtcttagcttttcagtataccctcatagctggagcaaggtacagcaagattttaaagatatgacaaactacacattctacagttgctgccagcagagaaaagattttatcttcttttgttacaagaatgaacttgaaaacttaaaaggaaattaaaatataaatactacagagtcacataagcctagattcaagtcctggctctgctttttaccagatctttttcctgttatttaacttctgagcttcaatttcctggggctaaaatagtacttgcctcataaggactaaatgagaaaattcatgaaaagcatttattacagtgtctggtgtattgtaagtagtctagaagttcgttattatttttaactttcacttataaatattggaatattagctgaaaggaactctagagatctatttcaatctccttgttttacctctataggaacttaggttcaagggaatttacgttgcttgtccaaagtaaaacattttaaaaagtcttgttaaggatggtcttttgccctatgtggcatagaaatttcagttaaatcttaattacattcattacttttagtaaataaaaakaagaatctagaagaatagccaaggttacctgaaacagatgttcctgatttctctctccctctcttatgagtatcactaggagccagttatataagtcaagtacatgtggtgttggttactttcatctgtttgttcattgatmactcatttgttgatttgtatcttctgagtgtcaggccctttagggaaaacagctgtgattttctagaagctcctttttagcttctctgatgctgcagctcatcctgtccattctatttcagtgccatgaatctggacaaatttgagaaaggccccagggaaatttttcatcctgaaatacaaaaggtaacagaaaattttatgcttcataattgtacaaaattgattacagtgttaggatagaactgacaggtcatcataatccttakcctgggatgcaaagccaaatcacctatgcaactttaaaaaaatcatcatgggagaacctcacacctaaggttctgatttgatgggtctatggtagggcctgggtatctgagtttttcagaagttcctcaagtgattctaatgcgtagccactcctgagaaccgcagaactgtcctcaatccacgaaccaatagggtgtacattcagaaaaatcttattggcttaaaagctaccctttttactgagtaatatagaattgtgtggaacattaaagaattttttttttaatcgaaatggagtttcactcttgtggcccaggctagagtgcaatggtgcgatctcagctcactgcaacctctgcctcctgggttcaagcgattctcctgcctcagcctctagtagctgggattacaggtacctgccaccgtgcccagctaatttagtagagatggggtttcaccatgttagctggtctcaaactcctgacctcaggtgatccacctgcctcaggctcccaaaggtgctgagattacaggcgtgagccaccacgcccagcctggaatgttaaagagatttttaaaaagttaataaatacaaaacgtggtcgattgagctcttactcatgtagtagactgcgctggctaccatcgaggataaaaggtatccagaaagccattcctgttttcttaggtcttactgttaagggaaaacaatctgccttaggagagaaaaaaatttagtcataatttaggtgacggtttatcagaaaaatgtcaaccaaacttttgtcttgtagttataaccaatttagctttgaaacttacaaacacagccatcactagtagagtgcctgtcatgtgtgaagctgagattgaagtagttgggtacgccagggatgggtgacaagagaggaggctggagaggcaggctagaattctatccaggaggcagcagggagccagtagaacctttaagcagggagcatcgtgctcaaatttgcttttaggtaaatagcaagaggaggactgattggaacatgaacaatctttgcttgtatatctttaaaatacggttagcttttaaaataaggttatcaactcttggcttaccccaaatatagagagttgtgaattctcatatcttttgttttgatgtaatttttaaaatagtatttacatccagcctcaaccccagacggaactcaggcaaaaatgggtatgttagtttaaactgtaagcgactttaagccatccaggcttattacaagtgatactttatagcaaattttaaaacaaactagaattataaatatgtcagtacccatgtgtccttattacttcactcacacaggttattattcctaatccttctttaagccttggtctgatcccccacaccaactctgcttcccagacacggagccccaaaacccacagagccagagctctgtgatgcttctttctgcctcttgctactgagccagttccctcggcagagctcacctctgctcagtcatccctgtctgatttttctaggagaggaaaagaaaaaaaaaaaagatatagcagcattctgcctatttatatcacaactctgtgcctgtttttaccaaayaaaaggtacttttatgctttcctacatttgtattttggcttttttccccttaacaaaaggaaccatttgtgaactttccccttgtcctctgtgtgtgtgagtgtgcatgtgtgtgtgaatttgcacatgtgtatgaggctcagagatgcagggtgaaggctgtcatcacatttctgtagatttcccttaggaagagttgagcaacaggctttaggtagagaggaaagagttcttaaaaatggtaggagccagagagtaaacagaaagtaaaccaactgtgttataaagaaggcatctttccacaaagagggaaggtggctggtgctgtttttaaatgttatttgtctgtttctggctgctatactgtagtaacattttccttgaccaaaatccagaagcaatgtgtgattaagctagctttaaatggatagagaaaaaagggtatctgtgtgtttcttcccactcctacccatcaagtttgtttccagatagttgcgatatgtttcctaaatgaccaggtattttataaaaaccggtagagctaaatttgatttttaaaacacttctaggtttaaaaagtgtatgtaaaatcactctcccaaatctcatatatatgaaaaaaatcagtgtcagcctcaaactaatgattagaatcatgcatacatcaaaagtaatgccagtaggactgtattgagaaacaccattactagccaaaattatactttctgggctaaaattacacactagaaagcagcaaaaaagaggacttccgatgctcacaaattcaggaacaagaatattttaaaaatctgaattatgttaagtgggacattggcaaaccagggcaaattgcaggactattcgcttctgaacaaatgtaatccaaaataaagaaactgcaacataaatgtaacctgacagcctatgacatccctcctgcctctacagctgagtgttgagactctagccctgagctcagccgggactcctgttgcaaggctctgattccttcagcctagcccactgaggagcagcctctattaccaggccagggactggttgcaaaacatcccagtcctaatgcttgcagggctagtggcaattgaraagctgagaggtgcgatccttttcttattcaccacagttagcaaggaaggagcactggcgtgggtgttaaaaggactgggcgtgagattcagagctgacacttacaggccacgtgaccttaactggggatccaattcctccacctgtgattcaggaacaattaaactgcacccccccataaatatatatatatacacctactgatgtacccataaaaattaaaaataaaaaaattaataaaaaccacaaggtgttgaggaagatcaaagtaaaccatggaaagagagaattttgtaatgacatacacagtgacatgcaaacataatgtcccaatgtaaaaaatgtgtaacataattttattttttcccagaattcagaaataatacagccaggcgtggtggctcacgcttgtaatcccagcactttgggaggctgaagcaggaggattgcttgagcccaggaattggagaccagtctgggcaatatagtggaaccccatctctacaaataatacaaaaaaatagctgggtatgatggtacacacccatagtcccagctacttgggaagctgaggtgggaggattgcttgagctcatgaggtcgaggctgcaatgagccaaggtcgcaccactgtgctccagcctgggggacagagccagaccctgtctctttaaaaaaacaaaaaaagaaagaataaaataataaagatggctgagttctgaatgaaagaggctttctgttaaataaaatggaggtttgtatgcctcttacagttctttcagaattgccatgtctccagttgacacagctcttccccagagagtcttgggccagaaggaggatgagggtccctccagcctccgtgcctccatcctgaccctcgtcgcctctgcactgtccccatggctcwcctgggccattccttcccactccgttcagccacagggtccctgtcagagccttggctttggtgtccgcttatcaaccagaatctacttttttagaagttctggaaaagatgggacttccttgtaataagtttacaaacttttatatggggtgactaagaatgaaaaggaaagtaatttaagttgattaaatctccgttgtgtaccaggtcttccacacacgctgacagtgatcttcacaggggttaagacagaaggaaggagagacccaaatagattaaatgacttatgcccaaacacagttaagaatgcgacagcagggattcaaaggattgtttaggtttgctgctccatgctgctcttacgagatggtcttataggggaaaaagatccaagactcgtggcacccacctttgtcatagttgggtttttttcccccaaacaaagctcctataaccaacttttaaaattattttcaaaatgtcagtgtgagcaaaccaaagcttggctttcacagcaagtcaaaatkaaataattactgttatgcctggatgtaacttttaaaactttatttgacaggacttgctggttcttgaagaacaagaggtgagtaattctatggagatatttgcacctgctctgcctccatgtttgtaaatatatttctcctttcactgtgaacccagcctttgctttcagccaaatctccatgtagatttgcacagtgggacacattgcgcggaaagaacttactggcatgtatttttaaggtatattttagaattttctatgcatctagctataaagctatgaaaacaatcaaactacttaaatctgcttggaaacatttaatgtgttaagcttatgatcagggtgagtaatgaggttttaattttcattaaagtagggtgtgtgtgctttattaggatgctcttaatatacaaaatgctgaatttatttgcatgttgccattccctgttgcccccattaaaaatataaatatattggattttctaagtatataactaacatagggaaatatctaaaatattatcaataggcaatggagtaaataaattatggtttatgtatcttatccctctcagtaaatagcagtatcttttgtcttgttgctcaggccaaacttggaaaaatccttaatccatgtctttctctctcatcctatatctaacctatcagcacatcctggtgacacctcttcataaaatatccctaatccaaacacttctcaacacttctaccacaaccactctggtgtggggatgccaccccatcctctcttgcctgggctctgcagactctcctaactcttttcctggcttccactctcaccctctcttctggtttccagatagtagccagttgtccttttgaaacatgtggaatcgggtcatctctctgctcaaaactctaaaggtttcctgtcctgttcaaagggaagccccagatcctgaccctggcctgctggagcctgcatgatctggcccctctacctctccaatcgtcagctccacactcaacatactgaattccttattcttccatctcctcagaaagagcctatagttcccactgctggggatgcttgtcccccagatgtcctcacttaatcaggacctctgctcagagagaccttccctgaccactctgtctagaatagtacaccctgcctgtcacccttagcctctttgatttttcttaatgctggtattttcatttgtgtgcttattatctgtctcccccatgagaataaaagcaccatgagagcggagactataagcaccatgagaacagagacttctttaattttgtgttcccagatcctagaacagtaaaaatagaaggtatagagtaagtatttgttggttgaacaagtgattgattgattgatgattgattgattgaatgaatatattatgaaatgctatgatgccattagaaaaaataaggtagtaacacaaaggataaatgcttgagaggatggataccccgttccccatgatgtgattattacacattgcatgcctgtatcaaaacatctcatgtaccccataaatataactactaatatataatacacctaatatataatactaatgtataatacacctactatgcacccatagtgcaagagtgagatagagtactatggtctgaatgcttgtgtccccccaaaattcatatgttaaagcctgcctaccaatgtggtggtattaggaggtggggccttgggaagtaattaggtcatgaggggggagcccttgtgaatgggattagtgcccttataaacaagggagcttgtttgcccctttcaccacatgggcatgtagcaagaagccaccatctattaacccagaatatgccccgccccagacaccgaatcttccactgccttgatattggacctcccagcctccagaactgtgagaaataaatttctgttatttttaagccacccagtctatggtattttgttatagcagcccaaatagaccaagacatagacctttacttattggcatggaaagattgccatcacatagtatttactgaaaaaagcaactcacaggacattatttacgtataatcccaattatgtttttataaacaaatatttttatgtatattcattcattcattgattcaacacatacttattgagctcctaccgtgcatgtaccatgtactgtttgaggcgttgcggatacatcagtgagcaagaaaggtcccttcttcacggagcttacagtctggtggggtaagacaagctaaacaagtaaacaaacaaacagaaacatggtaagaccagtaaccccaagagctgtgaagaaagtaatgcacagaggtggggtgtgtggtgagggggtaggttttttacattgaacagagaaggtttctctgaggcagggacacctcagttgattcttgaacatgtggatgtaaatacaaagaaggggctgaaaggatgcaccccaaattgttggcgggagttgcttttgggcaggacagtggaactggggtgggatgcagcagagagcaggcaaagggagatgcttgctttttttattttttaagagagggtctcgctatattgcccacgctgacttccaactcctgggttcaagtgatcctcccggctcagcctcctgagtagctggaacttcaggctcataccaccatgcctgactacatttttatccgtattttgtccatcttagattcatgcttgttgcaggagaatttatggacttcacatgtaatttgtaaaaggcaaaaagtaaaaaaatcacatttctggtaaaaatttgaaaaagaaatacacaaaagataaaaggaaaaaatcacctgcagtcacaaagacaactgctattaacattttggtatatatgtttgttacgttttatataaaattaggattatatatagcttttgtatctcaaaattactctgttcattaatccacagatatttattgagcacccactgagtgcatgcacatgcctgttgtaacaaacaaacaatagagagaatgcactgatgggaaatgtgaacacttacttcccctgccccgacttcaccactttttcaggggctggaccctgaaagaacgcctgttcactgttcattgcatcctcctctgctttttttgaaactcccaagttgtgaaaaataagttgctgatctctttatttttcaattttatttccttattagggggatattagcttgagacaacactagtcacttgtcatgacatcttggagtgtgaacaatggccatgatcctccagagcttctctgagagctgtgtggcgaggcactctatttaatcctgctgcttctcaactgggataaattgggagcatttatcccaattccagcctattctagtggtaaactattagctgcaaagatgggcaggtaatccaataaagaatactagtgaggctcccgaaaggttagcactttggtaaaatgatgtcagtgtcctgaaacccatgttttgtttgctgcatagagaggcacccccacaagagaacatggcatcccaagctgtactacacatggagagaggaaagatgtgtaggaacttgtggaaccctagaaatatggaggtgttgcctaaacaagagtaacaaggaaccaggggtgtctcattttgaataaggccatcatttctcaggtccaaaaaattcttctggaatcattgggactttagtttccccccatagtttgtttttctcagaagaactataattcatagcatactactgatttccaagaatgtgactgcctgttggtttgtaatcaggttgagttttgtcttgtaaaatttagaacttagaaaatttaaattccatccaagcaggaatgacagatgtgaccttatctgtatgttgaatgtctgagcaagacttacatcctgagaaaaccagtacctgtgaattccctccagcagcacctccctccagggacccaggtctggccttgagaccttgagagctctgaatggctggttaaaatattatctgcgacagtccacttgcaccagatcaaactatcccctcctaaaatatgaaatacctcattataatgagccataccttgatttctggagataggtgaaaactgttagtcatggacataatttgggaagtcctggacaccatattacctaaatgaggctgtataagtaggttcaagtacttaacaagtacttccagtctttctggaatctccacctgaaacaggaggatttcatataatttatcatttaaactgggaccctttgagagtaattactaataacatcaggacaacagataaaacagatataagctagggctgtcttggcaaacttggacacatgatctccctaccttgaagatcctacacccttgggtgcacaggtacttaaaagacccccatcatgcaacccttgctgctttacagactttgctcttgtctgaccctaataacttgtgatgaagacttgacaagaccttgcaaaaccagtctttctggagtctccacctgaagcagaagaggtcctcagcaggggtatggtagcatggtgccagtctcagagcaatcctataaaaccttttaaaagcattggccagtgatcaggtggtagtaggccccatctctgcttgtacatctcagtttcacttgaaacttttcagagaagattatgccatgatactggaaagaatgctggatcaaaagtcagaagacccaagttccagctccggtcctaccgttcacttagttccagccatgcgcaagtccctgtcttccctgagcttccctgtcctgtcttaaaataaaagcatggactcagtggactatagggtcctttctggttttagcaggctgtcagtttatggctcagagttatggtcattgacctagtccttcttgctagctgtcagctcagctggacctgatcctgggcctcctgacagcctcttggttttttctttagtctagtggttctcaaagtgggggccctaggccagcagtatcagcatcacctcggaacttgttagaaatgcaaattatcaggccctatcccaaacctgctgaattgaaaactcctggggtggaacccagcaatcttcagtttaacaagcccttcaggtgattctgatgcctagtcaagtttgagaaccactactgtagttcctgcactattattctaagaggatcatatgtcagaccccaaattactgtaggtgctttttaagggacccttgagacatgtgcttactgtcatcacttcgaaaacagagaaagaaaagttataaaccataaaaccctaaagtgaatagaggtccctggaaacattctaagaaatttatcaaatgctagtttgtaaggaagcagtgatcatttggagacatcgtatgaaaaataagttgtttctgacaaagtttcttttctcatttattatgcatacagtcacttatgtcatgaatatttattaatcttttccaatgtactatggtcaacactggggattcaatggaaagaaaacagtgtatgatttctcctgcacaggactcaggttctagtggtagaaacagatacgcaagttcaataaaagatttacagagtgtaaatagtgcttcgaggagaataaacaaggttctccgatggagaataacagcaggaaggagggtggctttatatggggagatcaggaaasgccactctggaaattgacacttgagctgaaacctacgtgatgggagagagccagtcatccccggaactgtggaagagttccaggtggaggggtcagtttgggagtgtcctctctcttcctgtatagaaaaccactgttagtgatgagtgtgcatctcargtgtgttggggacagaaaaatgttcggatgcacagccttagaacttggattttcggatttttaatactctcagatccagctatcctgaatcctggcaatcgccttgacttcctgcctctgacccattggccagtgtgctttaaatatctttgtcccttgtctacccttaattgaccaccaagaatttcttcatctagtggtgggtcaaccaaccttgtagaggtcgattctcttccaacatttgattttgtgtttattatgaaatacttcaggtatacaaaaaaaagtatagggaataacataatgaagacctacaaaaccactacyggccgggcatggtggctcacacctgtaatcccagcactttgggaggctgaggcaggtggattgcctgaggtcaggagttcaagaccagtctggccaacatggtgaaaccccatctctactaaaaatacaaaaaaaaattagccaggcatggtggcatatgcttgtaatcccagctactcaggaggctgaggcaggggaattgcttgaaccagggaggtggaggttgcagtgagctgagatcacgccactgcactccagcctgggtgacagagtaagactctgtctcaaaaaaagaaagaaaaaaaaaaaccactacccaatttaaggaagaaaagcattaaaaatatgattgagtccctgtttacgcctccctgcccctgttcctctgtcttcctcccttccctgtggaagctgctatctatcatttccaccagatcagaattaattcggtttaaagttggagatggtagattgcacatttgtaccagctactgcttgcttggcttgggcttgctttttttttttttttttttttttttttttcacatctgttttgtgacttcttcarattgaatatctttaggaattggggaaaatgagcttttagtataaattgcctataattttcatttctgtgtctaaaagagtccacaatatatcagcctgagattatgttaagctttgaattacaacgaactcttcttcgctgactgggatttggacggttgctcatgggttgattggaaratggtgccaggcctgtgagttcctgtggccatttgttggaaccctgttttgccacagaacagaactggtatcctagagatkccattagtaatgaaattacaaatgaacgaattcataaaagcatacagtctcatctgtaagctataaatacctatcaaaatgaaggaatgattgttgttaacattggtcaataacccagatggatgggaggaagggatcccctgactgtccatcctggtgactgccattgtgctaagtcacgaacagcccatctcaaaactatatacgctgtgatgataaaattaackgtaacaccttttgttattatcctaagggctctgtgaatttcaagtttggggttctttttgccaaagatgggcagctcactgatgatgagatgttcagcaatggtgagtgatctcctcccgctctctgctgccagagaccctgtcctgccttkttgcattcttgccagttggagcttaacttgtctgttgagttggagtctttaatacgaggagatagttttacacaatttcagcgtgaattttgtagggcagttgttgcccagtttcattcatttggcaaatatttattgatcacctcgtttgtacccagtcactgttccgggcactggagagacagaagagcacatgggatttggagaatttggttctacacagtcccaagagcagtggaagatttttctgtgatttttatgagaggaagaattataagatggcgtcatcttcctaatatttagcacttttcgtgttaaatacctgcttattctgaacgcaagcagtaataacatttttgttttgcgatagtaaacacctgtggtcccaggctggcagtagtaagctgggttcatctgattctgcagttttcctttccttggagtcctgggaattgtggggcttcctcatggtgctcaagaagaaggaaatgtgacttacccatgctgtttaccatgcrtgaatcggcagagcccagttaattttccagcgattccggtccatagttagaaaatgaggacttgttgatgcccatactttcctcatactctacttcttcctgcagaaattggaagcgagccttttcaaaaatttttaaatcttctgggtgacacaatcactctaaagggctggacgggctaccgtggcggtctggataccaaaagtaagcctgcctcttgatctattctgttgtaatttgtataacttttgtaagtcagcctgacccgtgtctgaacttataccagagaagggggaagggatggatgagagaagactggagggaggtgagctccacaccctgttcaacatagagtcatggacctgtttggcatttccattgagcttcgtaaaactaaatcagccctcacagccctggacagtgtcagaagtcctggtctgcccatgaatattactgctcagcaccatctgtgtgccaggactctggggatatagaagtggataaaccaacatggggtcctcctttctaggagcctgcagtccaggggacatccagcagatgttatgcagataatcatcaaatggtttagcactaagtacagaaggcaactgagaagaaaaagtacagagtgctatggggcattttgcctaatctgggggattaaggaaggcttctctgagcttttttgaggccagagggaggggcgagtcggaataattggagggtctcgaggggagaagagaattccaagcagagagaacatccatgaagaccttgtggcagaaaagaacatgttgtgttctagaaactaagagaatttgtttatggctggagggaacgaggcactgagaatgatgcaatgtggcctggagtaggagagggggcatgaccctgaagggagttttgaggttatattaataagtctgcattttattctctgtcattaaggggtttcaagtaggggagtggtgagattagatctgtacctttgagcagacaggggaggcagaggagaagcctgctctcagaggctgtggcaacagtccaaacargagayagggttgccttgggagagggccataggtcagaagggagacaggggaactaattcaagagccattttcatggtagaattggcaagtggaggttgaaagaggagacagtacttgaagacacttcagggtttctgccctgggtagctgggtggggttggcaccagcggtgagattggaaacacctgaaaggaagcattttgaggatgggggcctgagtggggaaggtaggtaagattacaagcttagggttggaagttctttcaccatctcatttttgtgtagcattgctagcttttccctttgtttctgtttttttgctttatttgatcttcacagtcagtccttgaggtaagtcaggcagcgggtgtgaggcccttttggcctaatagtgataggcttcgagtgcaggtctccttaccctctgggagcctcatcttcccaccagcctgccatggcatcacggattctgaattcgggagagctaagtgtgccctaactgacagatgcagggataggggattgggccccagttgtcaggttccagcttcactcgaacacacatagagtgcacaaggtgaattcttcaatgcctgcctctcatacccccgctgccaaccctcagcgtctccaatatggtcataacaaccatccactgagcccttgatacagccaggcattctgctaagcactttgcaaatataatctcattgagtctccccaatatccctaggagttagatacgacttttatcctcattttcaaattaaggaactgaggctcagagagaagtgaggtaacttgtcaaaagccacatagccaatgacaaattgaatccaagtcggcctcattgtaaagcctttgcttttaatcacaaacaattctgtcacaaataccacttccttttggcttatggacataattgtttgtgtcatcttgtgttaatttcatcccgtacctcccacagcaactgcaaggcaaggaagctcaatactctcctctttagcctggacttcttatgaccttctccattctgaggcaaggcatgaattggacagcaagtgagcttagggagagaggaagaggcctttccatgtggggggttgcatcaagtggagggttgttgcttccatgcaggtggataatccaaatatcttggagaatgtcctgtatacagtatttccctagtctgcaaatgaaaatgctttccttttggctcgaattctctgtgctcactgaatgcatatttatattttgcagatgataccacagggatacattcagtttatactgtgtaccaagggcatgagatcatgtttcatgtttccaccatgttgccatattccaaagagaacaaacagcaggtacatgtgaacatacaaaccatcaaatagtgatgtgaatgtggagagggcaccattatgattccatagaattaggggctatgccggttaacatatgagctgagctgtggccaccaatttagggatgcttttggcggtctgtattggaactttctacaaatcttaggaagagctattctcactggtgctgtcaccttagagaaataaggggtcagagataataatgtgcrtgcgtgtgtatgtgtaaacatgtataggtatttgtatgtgtgtgagtgtggtttcatagactcttttttgtctctctctttttttttaatatatttgattcaaacattcttctatccaacatggactcttgagagactattttgtataggtgttaccttttctctgtgccttctctcagtgtgccttgtgtcttgtcaaaatgagactctccaggacatatcataagtggtcctgtgtgatggttgacaagtattgttatcaggtcactgcaggaagttaacactgagtatctacatgggatgtaccaggctgggaaaaaacctctatctaagatactcctcacccaccccagagcttggccactgagacaggagcagaggagatgggttggtgagcaagggcctaggctggcaaaacatgggaagcctgaagtcaaagatgtctgaagttcagggctctgtcatagtggctgtggtttgttatattgggttatgtttttttaactctgtgaatgtgccatgtttgagagtctttctcagtgatgttatttatgctcactacaggtrgaaaggaaacgccacattggaaacgatatcgtcaccattgtgttccaagaaggagaggaatcttctcctgcctttaagccttccatgatccgctcccactttacacgtatcctgggcctttgtaaatgctccagtgtggcaagctgtggttcagcctcactggacttccatgacccttaaaccaaatcttgtcatggacttgttttgtaatgctagctttagactcacttttggggaatttttcctaagcattgtgtatagttcccccttcctctctccttccatttcagtagtagatggattaattctcagagaattcttgactcctgaaatatggtctcttttctcaggtagtctacaaaatgaggaaaacttcctgctatccttcagtcataaatgatttagaagaattataggtgctgaattctctgagaaatttgctttaggcataaaaacttgcaagttaagataaaaggccaaaataatttttcttgttgatttaagccctggtaatcgctgttgtattaccatctcttgaaatttgagaaatgatagaattaatagtatttttatctgattcccctaatccctgttcagctcatattgctggcaaagtccagcaatggggctgaagcttctgcagtgtctgagctcagctctgccagacaggcatggggcatgagcttgacctgcccagcagacactcagttgtggccctgttgctctgggtcccagaccatgacagcaaaacccaaagttggtggctctactggttatacataataagcaaaaggcaacaaatcagcattttcagaataaattctagtcgagttactcatttccctggaggctccaagtaaacatgtttggakacaggcccacggtgactcatggcatctggagacttggacttgttccttgtgacataaaaatagaggatggaagtaagtgtttaaaagttaacagtttccaaactttcttccatgagggtagggaagcaaacaatatgcacttgcaccttcattagaattttcttcccttttcatccctgctttctgagtaatatctgcccctgtcccctgggatttaggactaatatttcccctttctagaggtggttcttcttgtataacagaaaacttctccaaattcacagtagaagcagtggtgaggtgactgttcaggtgattgagaggtagtcattattttttagaatttccctgagttatacgttttagatttggggcttggcacatttgttcctgaaaaggggcaagcagatcattaaggcagattcattccagggagcctagaaatggagacactaaggaattgatggctccatagccctagccaaggaaagcaggggttgggagatggtgggtggaggtggaaggggaggaagaagagtgggagaaaggaagaagctggatggattctttcctactattttagactctgcaaaccccagcacaagctaagtagattctgctcagaatctgccaccagctacaacaggcttgttttgttttgtctaccaaacccaaaaggagagaaagggaaggtatacagcggaaacatttaaattgctttccctttccaaatgtgtgagatgaaatgtattactaatttcctattgggatcttgtttgtacttccaggcaagggaactgctctttttgctttgctgactgcttagttgtttaatagctatatttctattgcttttctgacagctttggagatttaaaccttttccccaaaggatgcacatacaaacattgaacctactcatggtgccctcacataagtctccctgggctgtctcttggaaagaagtatgggttctgtcccaacctaagagtgataggtgccctaagcacagaagcgctggtcragaatgactctgcacaagggattttcagagcgcaagctgtcagtcgtgagcatcagtgttrtgattagttcccttaaccatcaccacagatatttttgccttagtgagatacaatcaacaaaatgacaattacaggtaggtaatgactttgtctcgattgcttgtcctaattctcatgcttgttaatttagcattgatttttacaagactcttgatatacatatttcttgattgatttaatatgagtgcctgcaccttacaaaactttcttcaaggccaccatctcttcaggaaacatttactccatccagtgttgttccatgaaggagacctaggggtcagggttagtttgatattttattgtactttaccatgggaacaggtttgatatatttgatcttcatcctttcctagtctacattcttgcctgcttatctttctgttctcaaatattaatctgttaaaaggtattatgttgtaaaaagaacctgaactttgagccaaatagatttgagttcgaatcccagttctatcatttatttgaggctttgaaaaaaatgttttatcttcttgaagcctcaggccttctgtgtagagtgaaggtaatgacactaccccggcaggtgtagtgacaatcagaggcaatactgtatcttaaaataccaagtatgctgcctggtatgcagcaggtgctcagtgatggccattgctcttcttcctgggtacctggcttgatgggttggaccatgaaggattcaggaagacctggtctctatcctcaaagcacattgactaagctggaggggaaagcgaggtagtggcctcggccctggcagaccagagaaggcactcctggcatggagcaaatattcctgacacatcccatatgcagctggataaatggaaggacagaatagtggtgtattacttcattttcatactgctaataaagacatacccaagactgggaagaaaaagaggtttaattgggcctggcgtggtggctcatgcctgtaatcccagcactttggaaggctgaggcgggcggatcacgaggtcaggagatcgagaccatcctggctaacacgatgaaaccccgtctgtactaaaaatacaaaaaattagccgggcgtggtggcaggtgcctgtagtcccagctacttgggaggctgaggcaggagaatggtgtgaacccgggaggcggagcttgcagtgagcccagatcgcaccactgcactctagcccgggtgacagagcgagactccgtctcaaaaaaaaaaaaaaagaggtttaattgtacttacggttccacatggctggggaggcctcagaattatggtgggaggcaaaagtcatgtcttacatggtggcggcaagagaaaatgaggaggaaacaaaagcagaaacccctgataggcctatcagatctcatgagacttattcactatcacgagaatagcacgggaaagactggcccccatgattcagttacctctccctgggtcccacccatggcatgtgggaattctgggagatacaattcaagtggcgatttgggtggggacacagccaaaccatatcaagtgctaatattaattctgcaatattctctacttaggctgaaaatattttcagaagagagcgtaccactctttggccctcccttgccaactccaccagtgtttacagaccaccaggaattcagggactttttgctagtgaaatgtaagtttctgttttgaaacaattttgcaacttgttctatgtcagaatacatttcttcagattctcccagaatgctgtttaaggaaatgtcattgtttaagcattccatgttccgttaattctttgcacaacatgtgtttagtattctggtcatgttgtgcacgttttctcctatgttttcatccccaccttccatcctgtcacctgccttgaagcttctctacactcacccactaaggaccctcgggcctcaaatttgcctttctgccctgtgttctgatagagccattgctgaatctctgcttgtatatgtatctgtatctgtcagagagtgggatgtaggtgggggaaagagtggttgtgggtatatgcttagggatagggagagttgttggggaatgtgtgtgcacacttgcgtgagtgtatatgtgcacccatgcacatgtgtgggaaagagaaagacagaatgagaacataatgtgtgtagaccatgactgccaggcatcacttgctggtgagcacatattttcactctactggtaatacccaaatacccgactctgaggccacatctcttaaagcacaagagctctgcgcatccctcctcagggcacccctgggaattatttctggtagtcccatggtgggactgtgtcattgatcagaaacaagttactcgggttcatctgctgcagcttgctagccgcacgccctggcagggctgcttggtctatgccctccatgaagatactgctttccagcctcctgccaggtatgctgggcattgcagctgctttgctggctgcctcctgtccccacctgcaactcctccccactacagtctttgcctaagtctgtcactgttgccgtgcagctctgagacatctagaatgcccctctcttcactckgtccgtcctggtcacctggcctcaaggaagcattgactgagcccaaagcctcactgagtcctacgtggacaagtgttacccaacctccaatcttaatcctactccagtactggcccaagccagtccctcaggccagggcaagggacaggcacatgttgtttctcctctgtcttcctgtctccccagtcactccttcacagtcccaaacatgacttctcctgcacagaaacagtgccaagcatgagtgtcagttctagtcaccagaaacatccaagtcctggccaggctgtttggtagcctctcttccataggaaacccctcccttccctttcagagaccttggcatgattccacaactttgtcctggagaacagagacatgaaagacacctttgctgaggctccctctgctttccagctgggctgcctctcttcccagctggaccaccagcrttgttacctcccatactccaacctataccagggtccatgggtgatgtctccctcgacacattagaggcagcagacactgcaaaccatgtgcaacagatgatgattttgtctctccctttccagtatttatactcattatttcaaatgctacaacaaggtcccaaactcagatgcctggagagccaggcagggagcatgagcaagtgaggcgggctgagtggaggacagtcaggagtgctgggagctgtgacacacttgagagcatgtgctcactccatccagctgaggcctttcagagcatgcaccatggccagggttgccagatactctgagttttcaaatcaagccagaaagctgaaattgtatgtgaaattgtccgagtctcatgtgttcaagtccagaggatcagacagagagcaagaaacagatctgaaacagagtcagcaacagagtgggtgtagctactggaagctgaaagggtgttggcagcatggggctcaggaagacagcattcactgtagggggcctgtggcaaggaaggggccgctaaagacctgtaaccaccaattggagatcactcagcagcactagggacccggcttataagtggagccagtcaacagatggactttcatcagcgttgtcaaagacttgaggtgaaatgaaacgaagggctgggttgatttgacattgaagatttgaaagtagaaacagcagaagaatgcaggctcaaggtgatggagagggtgtgttgaggagatggagtgtggggccaggaaggaccaggaggggttggtgcgctgagaggacaggtagcagccggcggatcatagagtctcggaattccaaagtggattgagcagcgaggttgaaaactctgagattacaggagatggcatttcaacaaaaatcttgaccttttccttttcagccgaagcgaggctttaaaatggattgttccaaggtactaagcagaaaaaaaacctcaaacaaaaaaattcctagattcacagaactaaagaaaagaacagacaagcatagtttcaattcttgtgtgtgtgtcaagagatatcttgtaattccctttttaacttgatttattttagtaattaatggtgaaaaagccactttggaaaccccaacatttgcccagaaacgtcggcgtaccctggatatgttgattagatctttacaccaggatttgatgccagatttgcataaggtaattctgggtccatggtcttctttccttcttatggggtctgagttgagaacacaagtcctcaactcagcgatgaggccctggtgagaaaagcgtaggaggcgccttgatccttgctgtcaggactgtgctgtggccaccatgggctgacagtctctcattgtgacacaagaaggaaggacattgggtttccatacacaggaatgcgatttccagaaagccagggcctgtggaaatcaaggtgcaaaccagggacagggaggttgggtatcaatcagcaatctctggagcattgaagagtgctttttttggggtggctgttcttggtaatactactcagcattgccagtcacatgagctgatgggcaggcaaaggtgggatttttagaaagacatagggtgcttttttttggagatttattggccagccccatattcaggcactgaaacaagcattcccatttactgaagacccagacacttcgtaggcctgagacatagccacactgatgagacccaacacctttctatcacttcaggtgcacatgtgctcttttcttttttttttttttttttttggagacagagcttctctcttgttgcccaggctggagtgccatggcatgatctcggctcactgcaacctccacctcctgggttcaagcaattctcctacctcagcctcccaagtagctggggttataggcatacaccactgcacctggctaattttttgtatttttagtagggacggggtttctccatggtagtcaggctggtctcaaactcccaacttcaggtgatccacctgccttggcctcccaaagtgctgggattactgtcatgagtcactgcgcccggccgaccagcaccattttataggcactccttgactcttgtctggtcggtgtaccccaaccactcgcagggattgggccaggctaaccccaggaccctaaagagcaaacctcaattggtaatctctcaattccgtaaggtcagggaagacacagagagggtaccaagatgagcaatgatgtccttcaagataagtaatcatatcccagctgaagcatcactgcctgagccaggcttccctagccccccagttgaagccaggtcccctgttaaatgttttcatgtacttgccacacttccccttcatagcagtgatcacatgtgctaaacatgtcgttgcttaatctgtcttcccagtagactctgtgctccacaaggatagagactatgtctatcacattcccaaaatctggcagaagactaggtgctcagtcggtacttgctgattgaatgagcataccccattcagtgactacagttttaaagagaactaacattactaagtatgcactaggcactgtgcgaagtaccttacatgcattgcctcatttaaacctcataacacacctaggagacaggtattaaccacacaargacactgagattcggaaattaactaatttgctcaaggcgacccacaaggctgcagatttgcacagctctaggggtactgttctcatagaattcagtttgttgtgttccagggggtgctgctgtgtaagattggcatcccagagctgtgcaatgtggtggcccaggtcacactgttagtaagttagtaagtgatacagctgcaggtctgctgatttcaaagccgtgtcctcagcccccatgcaatgctggctctccacctagtgactctgaatctagtatctaccatggacctggtacacagcaggtgctccatcaatgcttattgagtgaatgaaacagaaggtagaaataggaccatttggataaatagttttgtgcactatgagaagccaaaagatgagacttaacaactgtttgtggaaktcataacttgtttttcttttttagaacatgcttaatagacgatcttttagtgatgtcttaccagagtcacccaagtcagcgcggaagaaagaggaggcccgccaggcggagtttgttagaatagggcaggtgggttttcttctgaaaccttttctgcgagacatgtagttttgagttccatcctaaccagatggcccatgtgcaaagactttgtttgcctgctgctgtaggagctctgtaatttctgttaggattgttgtggcaaccacgagtgagatttttgagaacygagtaggtgcagttctctgcaggcatcactgagagagcaacactctgcagaggtaggaatgctactgcctcaaggcaagtagccacagggcccagctctgggcccccctcttccagagaacacagatctcttgcctgcctcctaggaattttctgaagagtgaggagccgatttgggaaatgccccttaaacccatgactggcaggaggaagcacagagtggcagtggcactcacagaagacttgaattaccaccctatgacttggaaacaatccaagtcaccaccaagttaggtggtgcccagtcatccccttattccaggcattggagaaaatcactccctttgccccgctcgcatgtgacactggtatttctcagttccgggaggcgacacagctgtctgccttgatcacacatcacagcatggagaaggaggagtgccctcagctgcaaataaggttctggcccagaagtagaaagctagacaaggcaggtggagagaggaaagccatgtaatcaagggaagcttagttacaaggttctcaaacattggttcttgtttaaagatacccagactttattcccagagattctgattcatcaagtttgaggagggacctgagaatctgcattttttcaagctcatggtttataaatcacagtaatgatatattgattcattgaaatgataaaatgcatttggataatttgggttgcgacattgtcattaaggcttcactgtgtccagctaacttcaattcttgattaacaagtcagtagaggaacccgaaatgttagcctgcaattactcctgttttattaaatttttgtcaaatcacaattgtttatcctgctgtacttttgccgcctagtaaactttaatagagatctctgttctgtaaggcactaaaactgaaatccattgtgagaggggatgctccatcaagcttggcagcttcagggatctgtaaaaaagaggtgagttcatgatactttcaatttgaactttgaattcyccttttccttaatgaaaatgattgagattattggaaaaaggtttgagagcagaaggaagaagagcatgtctactgcagagtcctcagggaaagccctagataaaactgagtggccatttagtgagagcctctgtgttgccatggtatgcacatgccttcacctgcttcartggagcagagctgctggaggaccgacctggtcaggcaggccaggccccacagggcctctcaagctttatgtgcatacacatcacttggacaccttgaccaaatgcgtgttctgatccagtaggtctggagtggggctgagagtctgtgtttccaacaaacttgcacgtggttcctgtgctgctgaccacagacatgctttaaacagcaaggctcctgggcagtgctgctcaagcttcagtgtgtattgaattcacccccagagtttctgattgaacaggtctggggtgggacctgaaagtttgcatctctaatggcttcccaggtgatcttgatgctgttggttagaggaccacagttgaaaaaccaatgcttaatctacagttcactcagccagccaaaaaattctttggctatttatctacatcctgttccactttccatgggggtaaaaactaggtgatcatcaaaaataraacagacaaaaatacacaaattatattatgaatatgattttgtattgtagaacagtaccccatgtacttaattatatctccattcagaatacataaaagttaaatgggacagatttacagcacatcaccagagaagtgtccattataaaagcaaaataattatgaatacatttaccttactgataaaggtatagatgatgtgagcctacgtgctttaaagtctggtttcaggaaaatgatgagctcaaaatataattaaccctaaaaaccacaaccaacttcagacaagactactggaaaagcatccttcccaaaggctgcagcagttccagtgtctgcttgttcccatgcacagtaggaatttactgtttccaagtacgttatagataccagattccagtaagatttaataatgataagaagtttttaggcttatattaaaaacagaagtctgtggaaccataacttgttcaccaggtaataacagagcgagcgtccattgttgaggtcagtacttataacccacccgcaggccgtagaccacctcagagaaactcagctccagagggccccatgggctgctgctgtgcagttggctctgcagaggccagagccccctgctgttcccaagtgttctgtgcccagagaacccggctttgcccacctcttcagcactcatcgtttcatgagctgtggtcatgttcttagagagtgcccaggaacagtctgcacttagacatgaaagcctggagaccacattctcacctggtggaatccacatgaaggctcccccatggaagggagtccagggcaatggcaaacactgtctgtcgtcagaccagagcaactgtgggaccagatctgagtttgctgctgacactgcacgccccaatattcaacagttcctcagacctcacatggtcactggcacccgtgtaaagcaatggacaccctgcgtgcacctgcccattaaaatggggccgggtgcagtggttcatgcctataatcccagcactttgggaggttgaggccggaggactacttgagcccaggattggagaccaccctgggcaacatggtgagaccctgtctccacaaaaaaaattaaaaaaattagccgggcatggtggctcatgcctatggtcccaactactcaggaggctgaggcaggaggatcacttgagcccaggaggtcaaggctgcagtgagccatgttcacaccactgcactccagcctgggtgacagagcaagacctcgtctcaaaataaaatttaaaaaaaggtaaaatggcatatatatgcagcatttgagtacaattttgggggtttcacagacctccttgagacctctgtggatcctgtagggcccttgaatcttatgggggaagaacttctttctgccttagtgttccaaacttgtgtcttctgggcagaaaacatattgttactaagaactggttgttctgttggtgttacctaatgctgatgtctgtgtcttctccctattgacatttatattaactttgctttttttatgtccttttggtgtaagtcacaaactcagaattgccagaaattttcttggggaaacgtcatttcaattaatgacctgcacttgtttagccttttttccatttacaaaatgttgtcacattctttaggggatctttttagaacatcacaagttccatcttagcaattggaatattctttttgagaccgtgcatttcctaaagggagagcatcctttccttttctaagagagcagtaacacacagcatttaccctcagccctaatgccgttttcaaaggtggtcctcagagccctttgctttaccttgagtatgcaaatgcatgtttgcttgggtacttaagaacacacctacatgtgcacatgcaggctctactacagccccaggtgggacacatcaggccctgatgcctgattgagagtaaaagtgaagatgtaagayttcaacttgggcctgagaatctccacaaactgaggcttatccagtgctttggagggaagctaagaattctgttgaaaatgtccacaattctggtgtgactaagatcatggaacacaatgcctcctactccacacatccacgtgtggctctaaggctccccctttatgcctgagatggaaatgaactaagaagagtttgcttggtatagatatgtcatgcggaaacctgactagctctgtttacagctcttgccaaacagatgttattttttctttaagattttgtatcttatgtgggtcaatargcattttcacgtgaaaacaatatcaaccttttagtgcatcatgtatgttttactaatttgctgaatcagcaacacaggaatctgacttttttatagaattatgtgggacttcctttaatgatgaactaatatgaattctctaaaacagaggcaccatttggcccaactcccaggtgttaaagcaaaatgcttccttagaaaccattacgaatgcgtcaattgcctctgaaaaacattataatacagagacaggttatggtgccagaaacctgtgaattcactcttttcctattgcatacgtatttgaaaggagacttttcttcctaagaaaggtaattgagtccagaccccagggtttggagtgaytccgctcccacgggggtatctgtgttactgtttcaggtgtggtactgtacatttccatttggtgggctgcagtgtattttttctggtgcacttatcttccgatgcttgtattgcctcacagccgtgggagccccagtgtttctgcagtaatttccctcatgaagccgtgtgtgcagatccctggggccaggccttgctggtttccactgatgctggcgtcttgctagtggatggttagtgagtagctgctcctacaaatgtctttttcatgtaacttgtagtacttctaagatgagtgaccaccaaccaactccctttgggccataaatgtgtgatctgcagagagtttagcgaagttttatttccttatgaaattaaacccttgtttccagggcaagcagaggaaatatactctgaaccaagcatgctggagggtgggccataggttctcttcccaaaatatatgatgggactgtggatatcaaatgacctgcaaaaagaatctccttttcagccaatacttattatcactccaacattttactttaaatcaacaaggatacattatttagaaccactgtctctgggacattccctctctcgaagtcttaaaaawaaaaaaaagatttctgattcaaaaagtactgatgtccaaaacaaacaataagaatcttagataacccatttttgatggatatagaaacaaaaagattttgacaaggagacagattccagctcaatataaaatcacacattctgacagccagatagatcagccttcctggggagttagtcagttctctgtcgccacagatcagccaccgtcgcccagagagggtgcaacttcagagcaggtgtagactcaaggacagtgtggtcccttccatcaggagtcccctttagattattccagaccctgaatgaatgacagaggagctaaacactagtaacaggttgtctcctgggcttcagagggagccataggcacagagacaatgtctccaaagggcatttcctcggactgcccagaaacagctgcccagtctctggttaccgtagtgacattttgtgagaatcccaaagccaccactgtgagaatgacataatggcctaaaactgtggcatcttcccatccttcagtacaacctayacgtcctccctccgacgcttactgggcacatttaccgaacacctgctgtgtgccggggccccacgccaggtgccttctgaagcatgataggagatgtgggccgtgcttcataatggatctatttctgacctcatctgttatttttgatatgtgtttcaattgtgtgcccatagtcattgtatctataacgaacttaaggcagataatttaaaattcataaatttataatttaaattcagtatgtaatttttgaaattacaaaatgattggaaactgtgatctgaaagaaaacctctatgagcctcgagtttctctaaattggagataattttttaagatgctgagaatagtttataatgatgaaaatcggtgaaacaaaatgggatgatgatcacaactagaaggaggggattgtaggggctaaataaagttatctgtattaagtgtttacatagtggttggcacatagtagtaacttattaaatggcagctattatctttactatgtctctatgaacttgctaagaggtaataaaatccttccgggcgcagtggctcacgcctgtaatcccaggactttgggaggctgaggtgagcggatcacaagatcaggtgttcgagaccagcttggctaatatggtgaaaccctgtctctaactaaaaaaatacaaaaattagccggatgtggtggcggatgcctgtagtcccagctgctcaggaggctgaagcaggagaatcacttgaacccaggaggcggaggttgcagtgagccaagatcgcagcactgcactccagcctgggcaacggagcaagactccatctcaaaaaaaaaaaagtaataaaatccttagatcttgccaaaagtgaaacaacaacaacaacaaacaagaatgcaaacaacagactttagaagtttagtgcagtctgttagttttattgatgaacaagctgaggcctaaataaatgatatgagttacccaagatcacaaaactggttagtggcacgtctgggactagtacccagatgtgattgttagtccagggctctttccactaaaccaactacattatattaaactctaccaatgtctctaacacagatttccaaaaatatagccctgggcaaataattatgaaaaattttgtgatttaaagaatgttcactccttcccttttgcccttttgggaaagagaaagcatgcttcataatgactattcgtaagcttgcctaaaaccaaaagattctatttgagttgcctctatttttttaaatgcaaaatccaaaccaaaattaccaggttcctttctgaaatttttatcttaaggatccaaaatttaatggaaatgtcagatgtaaggagtattgtgatttgccargaaattctttcttccaaatttgaaggaagtcgccttcaacaggatggtgggtgtagctgtttacacccaccattgctttggtttatgatttaaactagttttttcatgtccttattgtacaatgatgcttctgtttgtttttgcttaaaaaaaaaagaagaagaatcttcagggccttctttatatttcttgttgtgcttttaagccacaattctcttatttctttgtttacctttctcttgtctacatttaatcatattatgaaatgtttccatgagtgaatccatccattttgtttcagactgagttccactctatcccattagcctttgcttaatttcattagatgtatcccttgagagtctactcctttcaaggtcattattaaaaatcaagaccttttgtatcctaagttagcaaaacctactttgaaaggaaactgaatactgattaaatatgctctcgccctgtgttttggttttgcagtaacagaaaagctggttctaaaagattgttcttcataaagagattacaggaaggaaagcattgtcatcaatcagtcattaaatccacctgtcactctgtcrggtccttgcctcctcctccttcttgtgttgtatacaaacctgttcagccatctgagaaagactggatggagattaagtgctaattcactctgtacacagctcggcagctgtacaatgtatacctctgttcctatgtaaaatgaagggcctctgtcatttattaattccytggagtgctgttgctgctgtggtcgcatctctatccactgggatatggggctgctccaacatcccattttatgttccaacactggtgaagagagcatggctttgtccttgcacaggcttgggctccacatcctggaggtgtgacctcagacaagtattaacaccaggcctcaggctcctcctttgttcaatgggagtattataagttcctacctaataaggtcattgggacatttaatttaaacatatgaaaccctaagcattagggtctggcatatggaaagcccttagtatatgttacctgtccttgctgtgactgctcttctcccacaaatggaataattgtagttatttagccaactatgatgatgggtatgaggatgatcgtccagtgttttgaaaaattaagtctgccccagcggaagtacaaagaccctgagaattagttccattttgtgggagcccagggtagaggaggaagaaaagtggttgatgagctatcataaaatttacatttgccccagtaattgagaggaacaagagacaagccctaggtgtaatactaagcttagcttagtctgtgttctgacaaatctgagccctcagaggcctgcaggagtgggagctcctctccccactgtgggggcagttattaatcctgatggtgaaagctctgctccctcctggaccatccaggacgggatgaactcccaaccacacttagatttctggaaaagaaaagatcctcagggccccttgctcctaaattttaattaaacccaaccccacagcagagcatttgcagaataaatgcaggtaaagaatgagccagccacttctcctgccccaaatgtctccaccatcccggacacctctgccttgccctgattctgccrtccatctcagaacagacccttttgcttacagaactgaatggaacagccttagtaattattttagccccctgtgtcctcggagccctcaggagcaaagtaattgttagcaacttagattctcagtaagtaacctcaacaacaaatcctgtgtggaagtgcaatgtcttgaaccatccatttattggagatttccctgagcattcccacttcagttcgtttttcctgctgttttggcaatttagttaatatttctctttatttatgtttttgtctaaaaaggagatttcctattcctttgggaaaaaatactgaaaatgtataggcaaactactaytgctacaaacacgggacatattagggtagagtgtgtttatatttatcttaagtccaaaaggaaattttaattttgctttcttgaggtatgtacaatatgacctaagatataatgcaatttcaaatattacataaaaatgagaaaatacttgagaaaaatggctgctcttttttttttttttttaacttggtgttcaggcctttggtacaaccctagtaaaaattggtattgagagatgttgctttttctttgatgaacaaaaatagcgttttcatgcctctgctgctacgccccctatatagagttcgggatatagaattgcctatgggaagaaagcatcagtacttcttcctgagctaggaggagaatagtgcttgaatgtattttgtagagcttatgaaagccctagaagctgacttccttccttgcctagagataacttgggttcaaaactacccacaggcacgtttggtgggttctggaaagcgtgggctgggttgcagtgatgggtaaccaggtttccttttccagatgaccttccatcagtgcccgtgtttgacagaactctgccagtgaagcaaatgcatgtgcttgagaccctggaccttctggttctcagagcagacaaaggtggtattccctgccgggtggcatgctgtggaggaaggaaaacagttgccttctgcggcccacaccacaggtcgccagggtctgactgcataagttctgccagctgtttcctttcctgatgctcagtgcttgggrtccctcagtggcccctttgttctctggggagggaagccrttgggggaaagggktgcatacgtaattgcattgtcaggttaaagtggtgtggggtgcctcctgaattccagaacacctccaatcctagtttttctacacagtctgcccctggaggccctccaggttaccttacttttccatttaatctcctcctctgtcttttttatgtcaccaggaaaagatgctcgcctctttgtcttcaggctaagtgctctgcaaaagggccttgaggggaagcaggctgggaagagcaggtctgactgcagagaaaacaagttggagaaaacaaaaggtgacttgatagattggtagattccattcgattcgtttttttttttcctcaggctgcccaggttttactgaaaataaaaatgagtaggaatttgatcttattagtttgttttttgtttggaaacatcacaaaaatarcatcactgtttccagaaggagcttgaaagctagacaaacacattgaggactagaagaaattctaggccttgcataacaggttctagagatgcattaaactctattagcaaatctattactgaagaaatgtttagactggttcccagagctctaattactttaattgatgtcatgtcgtaggtatgaagttaagtccacaaactctagaatataggaagtaggactttctttcctttcccttcctttttcctttcctttcctttcggcagagtctcactcttgttgcccaggctggagtgcagtggcacaatctcggctcactacaacctccgcctcctgggttcaagcgattctcctgcctcagcctcctaagtagctgggattacaggtgcccgccagcattcccagctaacttttgtatttttagtagagatggggttcccccaagttggccaggctggtctcgaattcccgacctcaggttattcgcccgcctcggcctctctaagtgctgggattataggcgtgaaccaccgcacccagctgggaataggactttcttaattttcctgtaactcaacctaattttaatatgtagtctccattttgcctagtgtcggaaacattctcagtccattcactgagttatgcttaatttccagggttcctaggtattgccaaattgtcaaggtctgggggcttccacacccgcatgtcatgtgtaaggcatcatttctttctcctcccaggctgccacctgtatgctattaacactcaccacagcagagagctgaggattgtggttgcaattcggaataaactgcttctgatcacaagaaaacacaacaagccaagcggggtcaccagcacctcattgttatctcccctgtctgagtcacctgttgaagaattccagtacatcagggtaggtttgctctttaaatcatttatctcccaaccaagttgtcttgaagcagactctgtccttccacccagagtttgttacccactgaggttgtcccactgtttagtagmcaactagggaaaccctcatctctggtgcccttgtttcccccagaagactaaagctaaagctcattcattccagtgaacatctacgggtgctgttctaggtacgaaggacacagcgatgaccaaaacaaagtcttctgatggggattactttccagttgacagttaacagaaataagcaaataaagctatgatggctggcataaagaaatactaaaattaaacatagaggagggccagggaacaaaggataatggagcagggagttgggagattctgtttwgaaagaatgtcccaggaagccctctctgaataggttacctgtgagcagagatccaaaagaagtatgggagtgagtgatgagggtatctagggaaaggatattccaggcagagggagcagccaggcaagggccctgaggtcctgttgaaggcacagtcaagagcagagggaacaaggcaggcaggtcagagagaactgggaaatatactcttgagccctcaggccattgcaaagacttcggccttgactctgagtgagatgggaaaccactggaaggtttgaagcagagaagtggcaggttttgaaaagattgtcctggcttctgggtagaggggagcttaggaggccaagggtggaaataagaaggcctgccacgagaccagtgcagcatcctggcaagaaaggttggtggctttggtagcaggagagatgggaagaagccgtgggcaatgctttcctgcttgcctcagtcagcgggatttgctgggagattgaagggggagcttgtgagagaaacctccaggctcaagttccctccctgacatcaccatctcttatcttttaaagactagggtacattaaggtatggaatatatctagcattggccactaagatggagtatttctactggagagctgagaaggtattttttgcttagagttaaagccttttgaattatgcctatcaatttctgctaatgttcaacttcaggggacagagcaacatgacagttaagttaaaacacgttaaaatcttgctctacttaagtgttagctttcttcctatagtgatttgctattttaatgaagatttacatgcagcatatacatttatgtaatatgagcactgaaattaaatctcctgagtttatatcttagctctaccctgtgtaaactttgtgatgacttttaagcctcagtttcctcatctgtaagacagaatagtagctgtacctaccttataagtaggattcaatgagaacagtgcctagcacatgttaagtacacaaatagattagttagcaattattaatactattactgaatcccaggacaggaccagacgacataagggataaagcagaccatactgttgattgcattttgtttaattgtttcctggcctcgaccctttccagtagacagaggcctgagtcttgaggacaggttatgggaaggagatgtcggatgtgacccctggcactcctctcttgtcccttcttccctgtagcacggggctctgcaggagcctggagagggtgccttctctgtaaggagggaatggrcagtggggcttggcatggagctggctgctctgttctcacccctgtctcttgtatcctcaccaaccacacaggagatctgtctgtctgactctcccatggtgatgaccttagtggatgggccagctgaagagagtgacaatctcatctgtgtggcttatcgacaccaatttgatgtggtgaatgagagcacaggagaagccttcaggctgcaccacgtggaggccaacagggtaagccagcggttgtggggacaagtgagaatcagaaaagagtaatcatcgttgtgtattctaaccctgacatgccatgatttggatttctttaaaattatgtactattcatcacatcagtattatgtgattcactatttagactgagccatgtgaagttaccatttttataggtcagaatggttctatctattatcatgtgactgtcccatttgccctgtttagttttcagatctttccttgccattccatccttccgaataaaagagatatgaaaaggccgggcacaatggctcacgcctgtaatcccagcactttgggaggccgaggcaggaggattgcctgagcccaggagttcgagactggtctgggcaacatggcaagaccctgtctgtatttaaaattaaaaaaaaaaaaagacatgaagagtcaaaaggctgactataataactaaataaatgagagcatttgttagatgatttgtcctgggagggtccttggagaataagcttgacctctgaggcactgcagactctcatcttggggactgggtgtttggggtgggtactgcaccctccctacccccttaaaaacccactaggaaaggaagaaggggtggaaacccattaggagggagtgagcaggcagatttgccctgagagtctacacccctggcctgatgcacagagaacaaggatgtcctagtgtggcacaaaatctagggccacccaaaactgctctcatgttctaaaggtgactgtgtggggtttgaaccttggcgcccactggacagtggtgagcactcaccaccctgaggcctggcagcctgtctgtcactggagagcgttcarcactgacactgacattagcagatcacagagcttttcagcccacgtatgtatctctgtgaggcaggacaaggcctgcttgtcagtgagccattgaggtttgcagcatgcagtgcaagccagtattctggcctaggtactgaggaaaccacagaatggggatgtcagccccagggagactaactcctagtgagggcttccagacccacaggctacctccagtcctgttcagctaaatcaaacagactgcagaattcttccaattatgctttacaacttgtattaattgtaaatatgctctgtataaatattaaaattgctaattactattttaggaagacttaagacctaattagagcaagattttaagaaacagaaaaataagaaatagaaaactgtagttgtgattaggagaccttcttgtcttcagctattattgatcatagagtggtctgtcatttctcttatctatattggtggtggccagacttgtctgcaattggagtcatctgaggagtttgaaaatataccactgcctgtgttcctcctccagggatttcctgggtctggggtgtggcatgggtttgggtatgtttaaatggtccccagataattgtaatatttagccaagttgggaatccctggtatatttcattgctttgcaaccctggctgtcatcccttggagagctttaaaaaggtcagtgtctgaccccaggccaagccaattatatcagaatctgggggggtgtggtacttgagaaccaatatttgtttaagtctgcccccaggtgatactaatatagacctaggagaaggagtgggtcctgaaacttcctaatttaaagctgggaggaatgccgcccactccccccacccgccgccccccactgcctgggcatccctggaccagcatgtcttcctgccactgacttctgaggagctggagccctgatttgtactttaaaagttctcaccctcttggccgggcacagtggctcacacctgtaatcccagcactttgggcggccaaggccggcggatcacctgaggtcaggagttcgagaccagcctggccaacatggcgaaaccccatctgtactaaatatacaaaaattagccgggtctggtggcacacgcctgtaatcccagctactcaggaagctgaggaaagagaatcgcttgaagccaggaggcggaggttgcagtgagccaagatcgtgccactgcactccagcctggcgacagagtgagactccgtctccaaaaaaaaaaaaagttctcacccccttcttccttctcaaaactgtgtaagcagccaaacaaagcagaaatgccatggtgcagcaggtccttgttcaatcagtccttttcctggcagctagtttcctaagacttagccagcttttgctagtggaaaagtcctcacctcatttcagagaaactttctgacaagttctattttaaaataaatcatgcttaagtggctgaaaattatgcagtttacttactcatcagggtagctatagagaatatcattttattaaatttcttttatatggtggtttttattatttacctatatttaatgtcctataattcattataggatttctttttcctatgatttgtaaagaccctggataaattgggttaaaaaccattttctttgatgacttctgtgctttgttttttggatggctgtcaggaacaactctcaagttttctgtcctctcttctatgtgcttcttaaaagacaaatatacaaagttttttcctaagagaaaaaaaaatgtatttttgttgttgttgttgagactgagtctcgctctgtcgcccaggctggagtgcagtggcgcaatctcggctcactgcaacctctgactccctggttcatgcgattctcctgcctcagcctcctgacgagtagctgggattacaggcacagccaccatgcccagctaatttttgtatttttagtagagacagggtttcaccatgttggccaggatggtctcaatctcctgacctcgtgatcccgcccaccttggcctcccaaagtgctaggattacaggtgtgagccaccgcacccggccaagaaaaaaaagtttttaaggraaaaaaaacccttccctatttcctggctctgagaggatcagcgtgtacagccctcccgtggtagaatggcggctgcacagctcccagcaggcacrgtgcagtgcacagctcccagcagtgcttagtcagatgcactcactcatctttcaaggagggtactgtctgtctggggagatgagccctaagaaaatgaaaaagataatgagctgtatgttttctaatagctggttagaaataggccttgtgggaacaggactagctttttaccaagatgttcctgcagctcagcacccagggcagtggggacaggagagagaagctgacacagcgtaggtcattggaatttcatttccattccgtctacattcgctgcctgcccgcctctgtgggcaccagtgttaactgggcaggcctcgcttcctgctcccattcctcctctcttagccaggaccacttgatacctatttcaggcttgtacccaccccgggttctgtaacaatcctagctcaagagaggaaatgtttaagaagcactaaagcaacattctgaaagtcactgacaagttcactgtaccagtgggcctgctgtgacccactgccgctgctttaaccaccagcactgacctcattcccaaaaccaagtgctcctctagggggaactgcaggcatagccatgggatctgggtccctggtttatgggaggggctcaggtcctcatcttgacgtctgcccagaatccagtggttctcagctgggggctgagcccagaatcacagggaaggctgaaggcagagccagctaggrgaggtacagttcctacttcacttgttacaagtctgtgttttgaatttttacaaccaccatacattatttgttatcattttaaagtaccaatagaatgaactacttattactttttattttttttaagagagagagagagagagagagacagggtctagctctgtcccaggctggagtgcagtggtgcaatcatagttcaattctccctcgttggcctaccaaagcactagaattacaggcgtgagccaccatgcccagccagaactacttattgttaatcaaacttatgaaataaagatttaatgcctatgtcctacaacagacctgccatatcagggtctccaggagcaagaaccccaccaggcccctgtcccaaggtggagacagacacctatatcaaagcataaaatagatctcattgtgctaagtgttaataaaggtctgaataataaagtgctgtggcatgcctgaggaggaagtggttaagggttaagtccaagcctgtttctgaatcctggccctggggctgaagcctgccaccacctgtcctgcagcccaactctctgaatattgccacgtctgtctgcctgtcagcacagcgttggagccccttggtagacttacttgatgccaagtacccccctggtgtctgtggtcattgtgcatagatcttggtctaaaaggctgcctgaacttcctccatacgtgtcaccactgccaccctccctcaccccaccccaaacacacacacaggccttatctctaaactaaaagcctgtctagttccacctttcccactgcagtcaaccctcccataattataataattgtggccatcactgaatggccacctctgtgtaccaggccctgggtcagagcatgtcataagcgttatgtcttggaaggggctcttcatttctccttttttttttttttttttttgagacagagtttcgctcttgtaccccaggctggagtgcaaggcacgatcttggctcactgcaacctccacctcccaggttcaagcgattctcctgcctcagcctcccaagtaactgggattaggtgcccaccaccacacccgactaatttttttttttttttgtatttttagtagagacagggttttgccatgctagcyaggcttgtcctgaactcctgacttcaggcccacctcggcctcccaaagtgctgggattacaggcatgagccaccatgcctggcacatttctccatttttattgaaaaggatactgaagtcagaaagaagaagtcacttacttaccccagagcacacagctagtaagtggcagaggcaggacttggaccccagctggctgactccagagaccatgttcccacagctggtggggatagcaggtccagccacaaagctggtagcactcggcccctcccgtggagaagctcccagtctggcagagcagacacggtgcagcacaaagcctctagctgagatagtgaagtaaaactaacatgtacagggacatctgaggaggaagggattytaagtcaaagtggtggggccaggaaggctcctttctggggtcagaggagactccaggaccatccttcatgtaatatacccattggtgctggttccttatctaaataaaggtatcagccaacattgagcatttaccgagctccaggccctgtgctaggtgcttagataagttacctcctggagtcctcaagccagtaggcctagatactcttattttctaccatcttacaaacgaagaaactgaaggtccgagaggggaaacaactggcgtgagtgcgcatgcctctgaagtgatggagctgggatttcatttactcacttgcccatccgatgagtttattctatccctgccacccgccaggccctgatctggatgatgaggggccagcagtgagcagcacagacaggcctttgcgtcatgagccttagatctcatggggaggggagccacagggaacaaacagacaagagagcaccagagggtgagggacrctctgcagagagcctaaaacacagggcatgataggagccatggggattattttggatttgacaacccccgggtctgtccaatgccagtgctggagctcttggccactggtcctcactgtcactccctgctgagctcctgcaacttttggttgaggcatttgccccattataccttgttttatgtacttatgtgcttttctggktttttttcttaaggggtcaacctcaccttattcttttctgtatcctagtggcactgaatacagtgctagataatgacagatgggagagagctggggattccattggaaggggcacccaagcccaggcagtggcactggctgaggatggccagttggggccttggcaccataatgagaccttttagaggtgaaggctgtgttctggtgacaccagtgaagagaagggtcagccagtgcagggccagtgggaggagcacagtgtggacggaagggctgggacagaggagccagcaggagcccacaacatggtgctcctgygaggaggtcagggcttagcctagaacagcagcaggggcacaaaaaaacacctgagaaactgtatgaagaggctgctgctggacttgggttggaggtggccctgagactttgagaatagttatgctaacaaaaaggaggagttttagaaggaaagctggttgtgtgggagataaaaagccaatagccttcactgagtgctcatcatgcatgaggccctgtgctaaaatctctgccttgtctcactgaattcccattacaatccagcagggtcagtgttctcatkatgcctgctttacagacgaagacctaaggccagaggytaagccatttgccacacaccacagaggcagtaagtggcctagacagggcttgatctcccatctgtctgcccagtctgtgcccctccaaccaccccacccccaatccactacctcctgcttttaatgacttggatgtggaatcagttacatctgagaacaaacgacatagtctaggggctgcagccctggggagaatgtgtgcctgagcccgtgaatttagggttttgggcacaaagcaaaatttggagctatagaagtggggttttactaaggagagaagagccaagaaattgaagaataatctgaggtgggagagagggcaggaggcagaagatgtcacccatcagaggctgcagagggcaggatggatagatgagcagaggccaaggccttcggttggggagaaggagatcttggctgagctcaaagggtggttttcctggaagcacaggaggccaggctctaagggttgagaatacaagtgaggaagtgaaaggagcaggaggctcttagagggctggagttttgaaaatcaagaaggaccaaggacaccatcaggttgagtgccctcctctcaaatgcagaaactgaggcccagagagaggagtttgccccagaccacggaactaggtgttctgacacccttttcattgcaccatgctgcctctcttgacatgaagaacagagaaagaataaagtgtgaagacatgccgtggcgattttaaggtgcacagactttatctgttggaggcagaaggatgcctcgctggaggtacgagagcggtaaggttgaaagagaaccagaacattagttcagatgttggctgtggcgtgtaccagtcaagggayttaagtgacttcaccctgagcctcactttcatcttctgtaaaatgataattataccataatgtcaataatattaggttgatgcaaaagtaattgcagtttttgccattggaaataatggcatataaacctgaggcatttcaatagagagaggagacataccaaacacagagcttctcaacggctatgaaaagatgatgagaaagtcccagagaagaaagaatggagagacttttctttcttttttttcttttcttttctttctcacttccattgtattataatcccagcccccaatgtgcattgtgggtgctggtggggcagacatgaccctatggcacctgcatgacagagggcctcggcctccacaaatgctcacaacttgtaaaagtcttttcacagggtcagcatccagcctgcccactaccgttgcccgttatcattgcaggttaattttgttgcagctattgatgtgtacgaagatggagaagctggtttgctgttgtgttacaactgtaagttaaggatgtgcttttatctttatttgcttaaatggactgctttttttttttctgggcaatttaaaaagattgtccttagatttacccagtgtatcattcctgggtttgtaattgccttccaggaaggaactgaaaaataccttcctccctgagtctcccgctgcgcaccaggcctcttggtgacacagtgcaagaactggcacttgtgatgctatctccaggatgcgccagtgatgacaatggcttccagttaggaggcccttactgtgtgccaggtgccgtgctcggtatgctgtggtcattgtctcacttgattctcacaatgaatgcccgcagcaggctcggttattatccccagtttagagatgaggcaactgaggcctagagaggtgaactcgtcaaggycttgtggctactaagcagcagggccagggtttgcatcgggtgctctcttgactccagcacccacaattttaaccactgtcrctattctacattttgctgtttctcaggtattaatgaaatcagcctcaacccagggtatccagcctcagttggcctagtttggattaggtggcagggtaggtgttgggcagaccaaaggtatcaaatgggatctttaaggattttcagcatttcaaaagctaataytataatacattttcataaaaatgatgttttaagggtaaaagaaaagaagtaagctattttcctagataaagctgcccagtctaacaagacataaaacatgtttttcggcctaggattttatcaatttagagtggtaatgctgggtcagatgttttgattaattaatctttgattaataagtataagaaagctaattattagaagagaaggttgttttataaacatcatctttcaaaattcgagatttatggggaataaattaggagaaggtggttaaacctcttcaacaataaattgctctttggggacattttatgcacagaactgtgcaccctcctcagaacagcaggtctttaatggcccatgtgatgagaagggccccatcaaggcagcaggaatgggccactctcccacaccccatgggccaggccactgccactcctgctgccctgcatccccaggtttatggctgcatggtagaagtcacttctgtaagaaattcacctttctaaaataaagtatgctcttttttctgagacatctatagaataacttgtggcagagtgttttaaaaactgatttggattttttttatcctttaaccgtgtgaaaggatggaagggattttaggtggaagagaagttaagaacagaaagatagagcaggtttttagagtgggagaattaatcccaaagaaaaagagggcatggaaacaaatgtggatgccatgggctctgtgccagacttgccagtgctgactggaacaggccgggctcctcactcagcggctcctgcctcagctgtggttcccgcagcctctgggtctcacggaacccttccttgggagttccatttctcatggctttgctcatcttccggcttcaggctctgacttcatctcaggatgggatcggtgtgtgtctgttttcatagatccactacatcagaagtatctttacatctctgtatctttacatcccaaggtcaaggccctggcaacctcagaggttcccatagcttcagtcttccccaaaccatgccacttcctcccatttctttgggtcaggaatctggcttttgttttccatatttctttttcccaagacattgggaggcatctggtgaacaacaccaataaaayagttctctccccacggtcatccaggtcacttctctaactcattcctgcacacacagcacacgtggaatttgcctgtttagtctatgttcttgacttgatcacagacgcctgtacaataaagccccttttcaacaaggtgctgcagaatgataatgctytccccaaaatctgaaactgatttgtatcattgaagtttttttctgtattaaaaataaagcaaaattaaaaataaaytttatgtggaggaatttttatctcagatatgttagagttgaaaatattttataatggagattgcaactttcagttatgwgttatttgaaaaaaatatatattcacttggtaacctttaggggaaaaaatwgtataaattgttcaatatgctactaatattgggttttttaaataattaaactctatttttattaccagaatctgtctttaactgtttaaaaagacaaagaaaaagaaaacttggctctgcccttagcacccagtaatcattcacctttaatgcaagtaatttcagtgctaagggcaaactcttgtgtttgctgatgatgctttaaagataatcatgccaggaaaactagaaaagctcgcataagtgccccttgtttttgatgcgatcatatttaacctcactaagtcttcactttcagataagtaatagtaagaatacaaaacctgcttcttaacaactgttgtaagtactaagcaggatgatacatgtaaagcccacaacacattgcctgacatgacaggattttattttcccactatttattccagaatcatcagagtatttattcagaactcagttttttaaccttcatagactttcttttttttttttttttttttttttgaggtggagtttcgctcttgttgcctaggctggagtatggtggtgtgatctcagctcactgcaacctctgcctcccaggttcaagcgattctcctgcctcagcctcctaaataacagagaggcgacgggatccacaaggttgaagaggagcactctggctgctgtggggcattcgccgaaggggtaggggtagggagaccagggagaaggtgactgcgtatgtctgatgagaggacagcagtgggaccagaactacagcagtggagatgctgagaaggtcaggtccaaaatacatttctttttttttttttttttccagatagagtctagctctgtagccccaggctggagtgcagtggcacaatctcggctcactgcaacctctgcctcccaagttcaagcaattctcccgtctcagcctcctgagtagctgggattacaggcacgtggcaccacacccggccaattttgtatttttagttagagacggggtttcaccatgttggtcaggctggtctcgaactcctgacctcaggtgatccacctgcctcagcctcccaaagtgctgggattacaggcgtgaaccactgtgcccaccccgaaatgcatttcaaatataagggccaagtgcagtggctcacgcctgtaatcccagcactttgagaggctgaggcgggcagatcatttgaggtcaggagttcaaaaccagcctagccaacatggtgaaaccccgtctctactaaaaatacaaaaatcagccaggagtggtggtgcgcgcctgtagtcctatctactggggtgactgaggcaggagaatcgcttgagcccagaaggtggaggttgcagtgagctgagatcacaccactgcactccagcctgggtgacagagcaagactgtcaaaacaaaacaaaacaaaacaaaaacatttcaaatgtaagaaccaagatccagtactcatccctcaaatctgctgcttcccctgccttcagcttcccagcagcaagcaccagccttccacggcaacacggtatcttcgtgcagctttcctgtttacactactgcttttttattaaatggtgttcagttaaaaaaaaaaaaaaaaaagaaccaagctaatttgctgattaatcaaatttgggatgtgagaggaagaakwaaaaaaaaggaagactctgcagtttggagcctgagcagctgggagaatggagaayacggcttcctgaatraggaaagctcggccaagagcaagtttgaggaaaagctcaagagtccagcctggacccatcagtgccttcctgtacccccrtggagatgcccagtgacctggatgtgcaagtccaaggcactcaagaaagagctgtkcctggaactctttcattagcatataaatgatgtttaaagtcatgaaactaaagaaattaccaaagggaagggagagacagaggcaccagcaaagtagactgaggaagagtgcccggaaaggcagggattaccaggagcctgcaggaaggagggcgtccccacctgtgcccctgccagagcaggcgaggcctgtctgagagggacccttggacccagcgaggtggaggtcatttggaagacaagagcgggcgtctctggaaagcagggggagcactttttcacaggggttgtgaggcggtgggagaagagaaagcagactgggwgcacagatgactcttcagagacttgctttaagggaaaaagagaggcgggatgtaatagctacaggaagggtctttttgtttttctgaagtgtgggataaatagtaagtttgtaaggccatgggggaagctccaatagggaagggaggactagtggtgccagggagagggggagaattgctggagcaagtccctgcatctgtggaagccatcaggacacagtgggaagaggaaggattggccacacctgagagcatcagagccacaggcagccgtggcagtggtgcccaaggtgtcctctctggagcatttgttctctcgggaagtaagggctctcttgactgtggttagctttttgtcttaattcactctgtcagatacacaactgtaagacactragataactgttttacaaggcacagtggtcgcatcaaaggagtccctaagcccgatgggccaggacattccaaaaagattggacatggtgggagaggtacttgtttctggagcttctgatggcgctgtcacctcccctgttcctgccccgcagcrcaggccttgatccgaagctctggctttctacacctctctctcccacggaagtgggaaatatcaggagtttaaaaaaagaactgttaaactgtacaggattccatatgacaggatgccgttgaaagtgtgctgcccagagagaagggaacaaggaagcagatggcatgaaaagaaggggagagcctccttcagtgaaccacaaacacccagaaggccagaccatggcccagctctctggcccggaccccaggacccagctggcacagtgcttgtgtccataaactttgctggactgagccaaacctgtgccctgtatcagagagmcatatcagaggcagatctatccaaggagacttttctgtccccacctttctgacattgctgtccactctccttttcagacttccttctctcccagcttctgtcccatcttcttgctttctttctgcccctctggccctcttgtctcagtactgtgccgttcacagtctcttctccagtcaccccttaaacgctggcattccagagggccctgtcctcgcctttccatctggcgtgctcattctcccctgcaagcttgattgccagtgtgctgctgctgactcccaggtctctccagtccagacccactgctgaactctgcaccaatgtgtcacactccttactgtacagcccacttcagcagctcaagggcacctcggactcaacctgtccaccctgaactcgagatctttcctcctcacatgtgctyctcctctgatgtgccccaccccagtrcaagggcagcaccttccacccatcacccaagccagagacacagttggcacaatggacttctccctgcctttactccccatctccaagctgtcttcccacacagctcagattcattccaaatggcctatcttttatggaccagtcactcctcacctggtcggtgtagcacgcacggaatttcttggactttggctccgtcttagagcaacccacctctcccctctgcactgctgctggagtcagcttcctagaaccctgatgctatcctctcactttccctagccaggactccctttcccaagccagcctctgccttcctctgccttccttcacgtaggaaatctctatgtgatttccagagattcctggagacaggagaaggtgtgccctgattctgtgggaagcacggaaggaactggtgcaggctgtgtgygtcacagtgttgggtgacaacgggagcagctcaccagtcttgttctgagcaagaggctgaagattgagggatacattccccatctgtttacctgccagctgtgccttggttcaaggcaaattttatgtagaatataaaatgctattacagaaaaagtgtcataagactttattcaagattttcaatgtcatagtttttggtttcataatgayaaatatattttaaatgttttttaatcaagtgagtcacataataacatatcattaatgtgttatatattttgttatcacatataattacataaacaaattggtcaattgaacaaaataaagaatccagaaatagatttacacatatttggtaaattgatttttgacaaaggtgcgaaggcagttcaatagcaaaataagagtcttttttaacaaatgataccagaataattggatagacatgtgcaaaaaaaattttttttgagaaggagtttagctcttgttgcccaggctgaagttcagtggcgcgattttggctcacggaaacctccgcctcctgggtccaaatgattctcctgcgtcagcctcccgagtagctgggatgacaggtgcatgccaccatgcccggctaaccaaaaactttgttccatacctcacattcattcattcattcattcatttttcttcaaagcattcactcatttattcagaatatataaataagaagtacaatatgtcaggtattgttttagaggaggaagacactatccttgcccatccccatcccaggattcttgacacataaacaaattggtgcaatgtgctataagagatgtgtaggggaataagagtaccaagaaagaagccatgaggttatgggtgtttgtggggctgaggatacaagaagtgtttcctgtaggagataatgataatatgtgtttagtctactatgtattcttaatctatatttgtaaaacaatggtccacataatgatatctgacttgtacaaaatatcttttagggacagtagtttttatgctggcaaattaaaattatgcaagaactctgggaccccttaagttttcctgggtcttacttactttgtaaattttagctctacatagtgtaatatatgttttatctgaatgttgagacacactaaggaacaacacacttctttttgcacagactggtggcaacagctttggaatgtgtttatcaaattaagagacaaaaacacaaaatgctacagttcaaaactggctttttattagatctgctactttgcttcaaactttaaactmtacccagataatgcaagaaacagagaagtaccagttgcagaaaaccctctgtgttgattgccttttgggaattttaacatttgaatatacttcccagtgtggaagcttggagtcaggggtggactccagaagatacaggggcctacctagctgtaaccacattattatgaagaacaaaattacagctgaattaaattttgaaggctgtccttgagaatatgcatagaaagttttgtgttacctaatagataatttgtgagcctgatgtcattcaaaagccagagaagaaatattcaggctaaaacaaaacttcctactttcttagaacaaagagaatgtacttcttgttgggaagctaaatcctaggaaagggaaaacaaatactcatagattgcaagtcccagagaattttaaagtgagtaagatcgaaccaccagatgaaccagggaccttcctagagaactgaaaagaagcctcaagtattgctattgctgtagcgtacaggcatcagagtgggtgttttagtgagttaggttgagatcaggtggcctacatgagctctgggaaccaaaacaacaacataggaatataggttaaatgtgtaggtggtgctataactttaagtggctgagttcaagataatttacagtgatttggtcctagatgctgttatactggcacccacccagcctttttaaaaagataaaatcagccgggtccgatggctcacgcctgttttcccagcactttgggaggctgaggcaggaggatctcttgaggccaggagttcaaaaccagcctgagcaatatagtgagaccctggtctctaaaaaaaagaacatcaaagcctaaaagtacaaaagaggtctttcaggttgcagagataagacatggtccatcacccccttggtggaagagtgaatgaaaatattggccactttgattttgctgctgtttagaaggactcctggctgggcgcgatggctcatgcctgtaatcccaacactttgggaggttgatgtgggcagatcacttgagtctggccaacatggtgaaatgctgtctctactaaaattacaaaaaattagctgggcatggtagtgcacacctgcaatcccagctacttgggagaccgaggcacaagaatcacctgaacccaagaggcggagactgcagtgagccaagatcaggctactgcactccagcctgggtgacagagtgagactccgtctcaaaaaaaaaaaggaggctgggtgcggtgcttcacgcctgtaatccaggcactttaggaggccgaggtgggtggatcacctgaggtcaggagttcgagagcagcctgaccaacatggtaaaacctcgcctctactaaatacaaaaaattagccaggcgtggtggctcatgcctgtaatcccagctaattgggaggctgaggcaggagaatcmcttgaacccaggaggcggaggctgcagtgagctgagattgcgccattgcgctccagcctgggcaacaagagcaaaactctgtctcaaaaaaacaaaaagaaaaaaaaaaaggaaagactcctctcacatcagatttaaaaattcattcaaaatggatcataaaactacatgaaaaacctaaaacctaataaaaacttctacaagaaagcatagaagatatttatgagcttggattggcaaaagtttcttagatattgcatcaaaagcataatccataaaagaaaaaattaataaattgaacttcatcaaaactaagaacttccttgaaaaacacaagcaaatgaaaaggcaaggcacagacagagaaaatatttgcaaatcacctatctcatacaggactggtaaagggaaaatataaagaactctcaatgataagaaaataacccagttaaaaagagggcaaaacacttgatgaggtagtccatcagagaagatttatggatggtaaataagcacatgaaaaggtgttcaatatcattagctattagggcaatgcaaatcaaaaccacaatgagggctggacaaagtggcttacacctgtaatcccaacactttgggaggctgagatgggaggaacacttgaggccagagttcaagattagcctgggcagtatcatgagactccatctctacaaaaaaaaaaaaaaaacaacaaagaaaaacttttttaaaaaactataatgagataccaccacacaactattaaatggctaaaatgaaaacgattgctcgtaatcagtgttggtaaggatgtgaagaaaatggctttctcatgtgtggctggtggaaatgtaaattggtataatcactttggaaaacagttcttcaaaaagttaaacattcgctcaccatatggcccagccgttccacttctaggaatggatgcaaaagaaataaaagcacaggctgggtgcggtggctcacacctgtaatctcagcactttgagaggccaaggcaggcagatcacctaaggttaggagttcaagaccagcctggtcaacatggtgaaaccctgtctctactgaaaatacaaaaaaaattagccaggcgcggtggcaggcacctgtaattctagctactcaggaggctgaggcaggagaattgctggaacccgggaggcagaggttgcagtgagccaagattgcgccgttgcactccagcctgggtgacagagcaagactctgtctcagaaaaaaaaaaaaaaaagaaaagaaagaaatgaaagcatatgtatgtccccacaaagatttgtatccaaatattcatagcagcattatttgtattagcccaaaactgaaaacaacacaaatgtccattgtggaggttttaaaatatgtccacaagttctttgatacttcttccctcaagaggtgaagatcattcctcttcctttgtaggcaggctggacttagtgattcctgtctaccaaacagaatatcgtagaagtgaaggtatgcaacttctaagactaggtcaaaaaaggcattgcgactgccttatggttccttcttgtgtcactcactctggagaagccagctgtgatgtcctgaggacactcaagcagcccaggggagaggtccttgtggtgaggaactaagtcctctgccaagaagcatgtgagtgcaccatcttggaagcagacccaagtcaagccttctgatgactgtaacctccaatgacatctttttttgtttgtttgtgagacagagtcttactctgtcacccaggctggagtatagtggcgtgatcttggctcactgcaacccctgcttctgggttcaagcgattctcatgcctcagcctcccaagtaggctgggattacaggcacacaccaccacgcccagctaatttttgtatttttggtaaagacagggtttcaccatgtcagccaggctggtctcgaactcctgacctcaagtgatccacctgcctcggcctcccaaaatgctgggattagaggcgtgagccactgcacccagcctcttaacattttttttttgagacagtctcgcttactgcaggctccgcaccccgagttcacgccattctcctgcctcagcttcccgagtagctgggactacaggcgcctgccaccttgcccggctaattttttgtatttttagtggagacggggtttcaccgtgttagccaggatggtctcgatctcctgacctagtgatccgcccgcctcggcctcccagagtgctgagattacaggcatgagtcaccgtgctgggccagcctcttaacattttaacgtctctgaatttagcatgcatcttataattatagtggacagctttctttctttctttctttctttcttttttatgggacgttttaaaggatgtcttattacttttgccagaaaaacagtacatcttttattcagtgacatcctagattcaatgaaatatggtaagttttgaaatctaggtaagaagaacaattttgtagttgaaaataaattcttaaaattgtcctaaaaaatggcagaaaacctgaytgagtcagtaagtatagaagatattggaaagttttttaaaaactagcctccacaaaagggttccaaccctcgtggaatttgggacaaggacaatccaacatcactgtagaatctaagaaaaagtttgaacaaatggacaaatatactatgctactgaatgggaagacttcatcttgcaaagatgtatatttctcctcagatgaaataaattaatgtgattccagtcagaatcccaattcttttctctttatgcctggcatgtagtaggcactccataaatatctgctaagtgattagatgagtgatttgccaaaaattttttaaaagatttgtcatgaaggatgattatttctttaacattataatttattgcaaagctacaataattaacacagtatgatgctggtgcaagaatagacaagccactcaatacaacagaataaagtccagaaataaactcaagtatatataaaatgtatacgatgaaagtagcatttcaaatctgtagagacatgatgaatttttttaaagataacgttaggacaattggacaaacttttggaaaaagtaaatgtatgcctctgtttttagttctaaataaattaaaagtgaaatataaaaagtcagtgtctgaaatttataaaagaaaacatggaccactgtgtaccaagtcttagcggtggagagagcctttataaggatgacattaaagcagaagccggccaggaggggtggctcacacccgtaatcccagcactttgggaggctaaggcgggcagatcacttgaggtcaggagttcgagaccagactggccaacatggtgagaccctatctctattaaaaatacaaaaattagccgggcgtggtggcatgtgcctgtaatcccagctacttgggaggctgaggcaggggaatcgcttgaactcagtggggcagaggttgcagtaagctgagatcgtgccattgcacaccagtccagcctgggcaaaagaaccagactccgtctcaaaaaaaaaaaaaaaaaaaaatgcagaatccatgaacaaagtttgaaagatctgattacacaaaacttaaaatttctatgccaaaaagaaccataaaattaaaagagaaacagcaaactggggaaaatatgtgtgagtttccaaaagggccaatatcattagtataggctgggcacggtggctcacaccagtaatcccagcactttgggaaaccaagtcggacagatcacttgagctcaggagttcgagaccagtctggccaacatggtaaacccagtctctactaaaaatacaaaaaattagccaggcatggtggcacangcttgtaatcccagctactcaggaggccaaggcacaagaattgcttgaaccagggaggcacaggatgcaatgagccaagattctcgtgccactgcactccagcctgggcaacaaagcaagactctgtctcaaaaaaaaaaaaaaaaaaatcattaacataaaaagagatcttacatatcaaaaagataaagacggctgggcaccatggtcacgcctgtaatcccagcactttgggaggccaagagggcagatcacctgaggtcgggagttcaagaccagcctggccaacttggagaaaccccgtctctactaaaaatataaaaatcaactgggcttggtggcccgtgcctgtaatcccagctattcgggaggcttaggcaggagaatcgcttgaacccaggaggcggaggttgtggtgagccgagatcgtgccattgcatttcagcctaggcaacaagagtgaaactccgtcacaaaaaaaaaaaaaaaaacagataaaggcatgagcacccattaaaatatgagagaaggatatgagcagataatttacaaaagaaagaaatccagttacccaataagcattgttaaaagataaattttgacacattaaaatttttaagagtttgagcagtgatttttatatatatattttttgtttgtttgtttgtttgtttgttttgagatggagtctcactttatagcccaggctggagtgcagtggtgccatctcagctcactgcaacctccgcctcccaagtccaagtgattctcccacctcagcctcccgagtagctgggattacaggtccccaccactaggtccggctaatttttttgtatttttagtggagatggggtttcaccatggtggccaggctggtctcaaactcctgacctcaagtgatctgcccgccttggcctcccaaagtgctgagattacaggtgtgagccactgagcccggacaacagtgatttattaatcaggcagctccaaacctgagggaacaaagggaggcttttatagggtgaatgcagaagcaaagcaaagcaagtatttgatttgctaaaatggagcagtagctttacttggctcattccaatggaaagtccttggttagaggttagttgactgtttctggttggctcctagaatatgaccttttacactgagttgggttttggtttgcttatgtaggaactcacagcactgggaccacctcgttctaatggccttgcaattattttaacatcatgggaaaaactgtgccccactgagaattttaatatgcaaattatcattgtaattatttggtcactcagactggctgagactgtcagagtcatggattctggcaccctctctctgcactgctagaagtggtctagatggtacagccttctggggaagaagttggcaggatgtgatttttaatggacacagcctgtgtactcacaggcaattattttaagacataatcagcaaactgtgaataatgagttcttgattgtctgttacaacatcatttataaagcagaaagctttggaaactaaatggaaacaggaggaaactggtaaagatgttttgttacattcaaatactgaagtgccatacagtgagttaaagttatgttcttgaaaaatgcatagaagaaaatatacaatatagtgaagaaagcaaattatatgttaaagtccaattctgtttttctttataacatttatcttgcttattcattctgaataaaaatacttgaaggagaaataccaaaatgctatcagtactggccgggtgcggtggctcacacttgtaatcccagcgctttgggaggccaaagcgggtggatcacttgtggtcaggagttcgagaccagcctggccaacatggtgaaaccccatctctaccaaaaataaaaaaattagccaggcgtggtggggcacgcyttagtcccagctactcgggaggmtgaggcaggagaattgcttgaacccaagaggcagaacccaagaggcataggttgcagtgagccaaaatcgcgccaccgcactccagcctgggtgatagagcaagactctgtctcaaaaaatatgkgtgtgtgtgtgtgtgtgtgtgtgtgtgtgtgtgtgtgtgtcagtatttctccctgggacataaggttgcagatgatttttaaaattttcttctttatgtttttctttgttcctcaaatattctacaacaaaacacagaaaaaaataacaaagctcataaagatgtagatatagatacaaagtatttaacagtaaataacattctgaataaaataaaatcatgtgacttacatataacccagcaatctatacaagagaaatgaatatatgtccatgcagacttgtacaggaatgttcatagcatctttattaacaatagcaaaaagcagaaacaacccaaatgcccatcaaatggtaagtagatcaacaaaatgtaggctattcatacagtggaatattatttggccataaaaaggaatgatgcactgacacatgggtgagcctcgaaaacatcgagctcagtcaaagaagccagacacaaaaggccacatgttgcatgatgcaatttatatgaaatgtccggaaaaggcaagtccacagacacagaagcaaataagtggttgaccagggctaggggaagaaatggggagtgaggtttcattttaggatgatgagagttctaaaattagatcatggtgatgttagacaaccctgtaaatatgctaaaattcattgaattgtacattttattttatttttttgagacagtctagctttgtcaccaggctggagtgcagtggcgtgatcttggctcactgcaacctctaccccccgggttcaagtgattctcctgcctcagcctcccgaatagctgggattacaggcatgcgccaccacgcccagctgatttttgtatttttggtagagatagagtttcaccatgttggccaggatggcctcgatctcctgacctcgtgatccgcccacctcggcttcccaaaagtgctgggattacaggcgagagccactacacctgcccgaattgtacctttttaatggatgaattttgtggtctataaatgatctcagtaaagctgttatttttaataattaaaaaataaaattggtttcattatttttcaaacagtaaacatactaatacagccaagacccaattgcaacaaaactctatatctacagactcatcaagttgctaattatatcattttttattcctttttttttcagaaattagaaatgtgattctaaaatgtaggtggggacattttgtgaactaaaatgcattagcagaatccaagatactggtcctacatgtcattatctcttctcagagtaacactaccatctttacctctaccctctgtagacagttttaaacatttaaacgaatgaaattatacagtatgtactcagatatctagcttctagcttttcttttcttttcttttcttttttgagatggagtctcgctgtgtcacccaggctggagtgcagtggcgtgatctcggctcactgcaagctccgcctcccgggttcacaccattctcctgcctcagcctcctgagtagctgggactacaggcgcccgccaccacgcccggctaattttttttttttttgtatttttagtagagacggagtttcaccgtgttagccaggatggtctcgatctcctgaccttgtgatcctcccgcctgggactcacaaagtgccaggattacaagcgtgagccactgcacctggccgcttttctttttttgctcaatattatgtctgtgagtcatccctgttgttgtgtgtcaataattaacattcagatgtttagtaacatccattctttatgatgttaataaaaattcaggccagctcggtggctcatgcctgtaatcccagcactgtgggaggctggggcgagtggatcacttgaggtcaggagttcgacaccagcctggccaaatggagaaaccccacctctactaaaaatgcaaaaactagctgggcatggtggcgggcgtctgtagtcccagctacttgggaggctgaggcaggagaatcgcttgaacctgggaggcagaggttgcaatgagctgagatctcaccattgcactccagtccaggcaacagagcaagactccgtctcaaaaattaaaaataataataataataactccatctttcattgagaaagaaatgtatggctaaaacatgatggtttgggaggctgagacaagaggattgcttgagctcaggagttggaaaccaggctaggcaacatagaccttgtctctactgaaaaaaaaaaattagctgggtgtgctggtgtgcacctgtagccccagctactgggggatttaaagtaggaggctcactttagcctgggatggggaggctgcagtcagctgtaatcatgccactgcactccagcctgtgtgacagaacaagactctgtctccaaaaaaaawtttttttaatttaaattttaaaaatgtgatggacctctgtaataaatggggcctttgtttctccactgactttctcactctaagagggtctgaaccacgtggacttgtgtttagagcttgcagcaggccaggaacaatgtacttgaatgaaccttgtgttaatctaatactggttgaggttcaccaagaggatacaagcgtatggcttcaagtcctcttgaataataataaaatgttagggggtatctggctcccaccatccttgtcctgaatgaggctcaaggtgtgatccaccttgcaggagggcattctccacccaagggctgccgtcaggtgtcccttcttgaccgttcacaagtgtgggagacagtagggcataggcattcagcacacgggctctgcagtcacgcagacctgtgttcaaaccctgcttcccccacacagtgcttgtgagactttggacaaactacttcatctctcctaacctcaattttctcatctgtaaagtgagtgtaataatggtatctactttgtgaagttctacagattaaatgggataatggctttaaagctcagtgcctggcacatagtaaattctcccaaaacagcagctcttattatttgtagtagtaatattattctggctcagaatgcctttgaccctaagtatccagcatcatggcggtattcatactggctatttataaagaactagcagataggrtactattcttgttgcctgtttttcatttctttaattacagtcatctaagtgttgtctctaacaaaaatgagttgctgttgttttcattgcagacagttgcatctataaaaaggtttgcccctttaatggtggctcttttttggttcaaccttctgcgtcagatttccagttctgttggaaccagkctccctatgcaattggtaagaaaagtctttatcataatgcttttctccttcatggatatgtctgaactattgtaagcaaatcctatgtaagcaaatcactggcttactgcgaaattgctataaattatacgcgtatgatgaatattcacagcgttctttttctttttcttttatttttgttccccttttgggactatcgtcttctactgttcttcctagtttctctcagtgcctgagcatgtatgcatttgagagcaattaaatgtcatttttcagtacttggttatcatttcagcacctcagttcatttctgggcctcactttcctttttctaaaattcaagtgtaaggtctccagcctcaaaatgctgactgacctcggggagaagcacagtgctttcagggccattggtatatgtttcatagaaattcaggtacctgcctgccactaaaatgtcaggacatgagcggcgatgctttgtgtttgtgattcaagatccacaactggccattgccttttggaagtcagatcagagccaagaatgttccagttcattcttttgtcctcacaataaaactgtgtgttaataggtccacaggacagcattttgagaggaaggcagagggaccaacctaagatcctgggaggaccagttagacttgatgacagattagatctggtagacaggaaagggagattttgaaccacgttgctggaggggcttgaaagtcatggctggaggcatagatgtggtaggcacagtcaccaggaaagccaggagagcagatgcgctcatccatggaaagagtgcagagagagccagtgcgaagaaggggacaacacgaagtgccaggaagaaagaggtgtgccccagggcagccagggcaggcacagtgcctggaagccagtgtgtcatccaaatcatttcaagcagaggggccagcccttaacaaataactcagcaaaccccttgatgccgagggacactgcgagggccagtgaggaataagatgcagccccggctcagacgtgcagctggaggagcacatgggaggagcgaggagcactgagggacaccagggctgggccttgaagagcgaccaaagggaagggtcccaggcaggatggcctgggcctgcagacagaatgtcaggctggcgtctgaacaacagaagggactccccacaggactatggcaagtgagctgcctcgctggaagatcaggcagtggggtttccatgggggaaaatggcagcaagcatggtgacagtgcacacctcctgggaggcgcagtgtggcaaccgaggggaggctgtcttgggaacccaggctaccttaggatcagggtgacttgcacatgtgaaggaaggagagaagcagccagaggaatgagagatggaagtttctagagaagtgagtgtgactatgacacagtcacagccccttcgcggccaccaagccagcagctgggaggtgacactcccgttcccttgcagtctgtgcyttcccgtatctcctggccttcaccaccgactccatggagatccgcctggtggtgaacgggaacctggtccacactgcagtcgtgccgcagctgcagctggtggcctccagggtgagtaggactgggattttatctctgagtggtttgggggaccccggcactgtgggatttcaggtgagcacagaagccgcctcttgtcaagttaggctgatgaagaccggtgtcagaatgccagcacgagatggaaagcctgaaaccagactgatctgttgggttttcatgtgtgatttctgtgggctttcagaacactcctcagctttgttaatagtcattaactggtgctggtggcagctggggagcacttagctgaaaagagatatccccrctcagagactgggtcagttattcatgtcactgctgccctggaggacagtccaagtctagaaaagtcagagcttgcaatctttcttcctttcccaccctctatcctcagtttgaattcttagcctatgaaacatggctaattgattaatccctgcctcataacccacagctagggcaaaacggagggatgcaggaacaaagatgccttccaagatgtcttttgtcgctggcatataatctggggggtcttgttctagtcccctcccctgagtcaggcccacraagtcctccccagccctgccagactgggctggctcccccgctgtgtcccctgttcccttccctggtcctgacatccatcacatttggtggtaggtgactgcctatttgttcatctttgctgctgcactgatggttctgtgagagcagatgccatgctgtcttaccatcatagtaccagtggtgtgctcaatgcttcagtcccgcagtgctctggaaaatgtgtgtgtgtgcacatatgtgcatatatgtatgatatgtgtacatatctgcatgtatgtatcatatgcgtgtacattagttgattgtaaatagcttacaatttacaaataataaatatacaatgctgtttatcataaaaatccacttagccaattggttcttacaraatgtttttgttaatatttgctgaactcttgtatccatagccaacctacagttgcagttcaaccatgattttacacttggagttatatctcaatccactcatttttttccaatgtatattgtcatttaatctgataggtaatctgctataaaactatttttcaccctcatacaactcatagtcattaaactgaaacttctttcagcttctgtaccagactaaacacacttctacgtttcttgttcattactagtactttctccatcactgtaagtctagacaatcaacaaaacaacaaatcaaagtcaaactgatagtctttgctggattccatggtgtaaagagtccctgcatgattgatttcaagctgccagcgtgacgccactgcaggtggtgctggggagacgtgcattatcccccatggtgcagtatctctcccccaagccccacacagacactgttggtgtcaataactccagagcagatgtaatagtaagcacagtcaaataattaggaatggctggatttggatatttagggcctttgtttttttaggtttgtataatttaatttctaatcatgtgtgtttaacagccagtttgcaaaattcctgaaaattggatttcatagatcacatccagcacaccactgctgttagcagcagcgccagcgcatcacgggtgtgcctgagtatctgctggatcagtgaatgaagaatccatttccccatctgccaaatgggcctaactgaatccctaagatctttcccgttctaacactccaggtgcctgagattcctgttagggaagtgtgtgctgtgtttgtgattgcagaagatgtgtggtggaacactgactgttttctattgtggatcaacaaatagatgatgaaaagtggcggggagtggaatactcaggaaaagtgtaactagccacgctgggctttcctccagaaggctctctccatccctcgccccggcatcccgcactgcactgtatgctccaaggatggggaccagttggagggtttgcagtgatgrcaggagggccagtggatgcaaggcctagaacaccaggcagcccggtaatgctctctcttcctttctagtcggatatatacttcacagcaactgcagctgtgaatgaggtctcatctggaggcagctccaagggggccagtgcccgaaattctcctcagacacccccgggccgagatactccagtatttccttcttccctgggggaaggtgaagtccaagttttactgttttattaatatttgtaattcactctaatttctctagtttgttgtctaatatctacatgtgattactgtttaaagaagttactatttaaagccattaaaaaaagaaactagctgagcgtggtggctcacccctataatcccagcactttgggaagctgaggcgggcggatcacctaaggccaggagttcaagaccagcctgaccaacatggtgaaaccccatctctactaaaaatacaaaaattagccgggtgtggtggcacacacctgtaatcccagctacttgggaggctgaggcaggagaatcacttgaccctgggaggtggatgttgcagtgagccgagagcacgccattgcactccagcctgggcgatagagcgagactctgtctacaaaaaaaaaaaaaaaaagaaagaaatcttgcagtctgaatacatggttgtgttcttaagaaacctggtgataacaacgacaaaactccattataaaaataataaataaataaataaactgggctaggcgctgtggctcacacttgtaatcccagcactttggcgggctgaggcagatggatcgcttgagcccagcagttcaagaccagctgggcaacatggcaaaaccctgtctctaaaaaaaaatacaaaaactagctgggcatggtaacatgtgcctgtagtcccagctacttgggaggctgaggtgggaggatcacctgagcagcggaggtcaaggctgcattgagccgggattgcacctctgcactccagcctgggcaacagagtgagagaccctgtctctacaaaaactaaaattaaattagctggctgtggtggcatgcacctgtggtcccagctactcaggagactgaggtgggaggatcacttgagcctgggaggtcaaggctgcagtaagtcatgattgcatcattgcactccagcctgagcgacagaacaagaccttgtctcaaaaaaaaaaaaaaaaaaagtttcagtggggaggagggagttaaaggctatagagtttccaacttgcaacagcagttatttttccttcagggctgttaacagtagtgggttttgaaagctaaaagaatagagtcatcaagcctagacattccccagcacatgcagtctttcactctatctggctttgcccgcaaaccccagaggcctctgctgtggttacctcatcgctttgaacacagcgcttttcataaattcttaccacatcactcatctttattgcacgcagttaagataaagcacagaattccccaagcagggcagctttttgcttttcttgtctagtcttttttcctgtgcagtcacgagtgcattttacctaatttacacatgaaaatgctcttagaaaacgcaaagccatcaggcaccctcaaatcagtgstcctggccagccctcccagtgggacattacagatcagtgtgtgacataacgtcttccttcatgctatgttaaggaacaagaaattactctcttgtaaataatgtgcacttttcttaaagttctgatgttctttttgaaatcacatttcaggtgaaattcaatcaaaaaatctgtacaagattccacttagaaacctcgtgggcagaagcatcgaacgacctctgaagtcacccttagtctccaaggtcatcaccccacccactcccatcagtgtgggccttgctgccattccagtcacgcactccttgtccctgtctcgcatggagatcaaagaaatagcaagcaggacccgcagggaactactgggtaatggttctcaatcctggtttccactgtctgtgaacagaccagctggttttatctttggatatgaattgtcctcagaaacaatgagtttaaaaggaaagtttccttttaagaagggatttttaagtaagttctaatacctctataccaaggaatacactataatgtagccaccaacagtgatgttgttgatctatatttattggtgtggaaagctgctcaagccatgtgaaggggggaaatgggcagtttataaaacactatgtctagtctgataccatttttaaaaataaaagtaccaatctatgtatgatttcctagaaaggtgtctagaaggatttatatcccacagtcctcagacaacattttatgttggtatgtcccaaagtggaaatgtaccatgtttttacacgtgtgtgttcagttcccttattacttctcccagccctagacagtgggggcaggtctgtggatagaacagatgcaagatatgtgttgagctcatttctctcagtataactatgggactgggctcacacctgttatctcagcattttgggagaggctgaggcaggcagatcacttgagtgcaggagttcaagaccagcctgggtaacatggtgaaaccccatctctataaaaaataaaaaaattagccagccatggtggcatgtgcctatagtcccagctactcaagaagctgaggcaagagaatcgattgagtccgggaggtcaaggctacagggacccatgattacaccactgcactccagcctgggtgacagagtgacaccctgtctttaaaaaaaaaaaaaaaaaaaaaaaaaagatgagaggccaaatcagagaaacataaagcccctgataagtgtgaaaaggttagactgttagaaacctttttgttcagatttgtggaaacaaaataaggaaatatggaagtgacatgttaaaccaggagaaactggtttgaaaacttagactgggacctgcatgaacgttggcctgggcacacccctgccctgcagtaatattccctgaacaactgcaggaggggattcaggccacctgacagggcaggactagacactaacaaagtccattggtttttcaagttggtgccttccactgtgttttgaaaataaatgtattgctatttttaatgcagccttccatatcaaagcttgatctgcccaccactgtttacaaaccactgagcttttgcaaaacggaacctctgaattggagaattacagggttatcaacggtaggactgtaaatcatctgtcctcattaggctctttgagtctaatttttttgcaaagtgtgtatactttataatcagaaaagaaaaaccttctaccaaccagaaaaccaataatttgaaaatatatattctatcatctttcttcctgactctagcacaacaatgcaccagttcccaaccaagaaaaaataagggtcttttctgtctccgtggcagccctgtggtagtgaccctctgacctatgattctcaatccaggcctctcggatgaaggtggacccaagtcagaaggagcgccaaaggccaaatcaaaaccccggaagcggttagaagaaagccaaggaggccccaagccaggggcagtgaggtcatctagcagtgacaggtaaagagarggagaggcccctgcttggggtggtggacctatgagtcacagcactgcccaggagrccccttctggggattgataatgccactagtggcccctggcagctacagcagagggccagcagcctgttcctctctgagggtccccagaccctcaggcctgccagggagggatctagacaaatgggcacacttaccagcagtcaactgctaattcaaatctattgagacctggccaggcacagtggctcatgcctttaatcccagcagtttgggaggccaaggcgggcagatcacccaaggtcaggagttcgagactaggctggccaacacggtgaaaccccatctctactaaaaatacaaaaagtagccgggcgtggtggcacatccctgtggtcccagctacttgggaggttgaggcagaagaatcgcttgaacatgagaggcggaggctgcagtcagccaagatcgtgccactgcactccagcctgggtaacagagcaagacttcatctcaaaaaatatatatataatatatattttatatttatatatttaatatctattatatatatatgtagagagagagagactttttcctcaccagattgacagagagtttttaaaataaaaatgctggctaggcatggtggctcatgcctgtaatcccaacactttgggaggatgagaagagaaggtcacatgagcccaagagttcaatcccagcctgggcaacacagcaagacccatctctacaaaaaaaawatatatatatatatatataggctgggtctggtggcatgagcctgtagtcccagttacttgggaggctaaggtagaaagatcaccttccttctgggaggtcaaggctgcaatgagccatgatcacaccactgcactccagcctgggtaacagagcaagaccccgtgtcaaaaaaaaaaaaaaaaaacacttagtaagactgcagggaaacaggtgctctctatgcagtaatgcagtactggtagcacatacacagtccagcctatccgaatgccaggtcagcatcacacgtcaatgaatagtagttaagtcacactgatttgtcctgtaaratctctgttatccttcaagcaacatcacacgtgctccagtgtggggagtgatagttcgtatgtccaagcttcattcattcactcaacacacattcttggagcacctaggacttagttgggtattaagatatggaaaggactaagcccccacctgtgccttcaaggggttcccaggccagtggcaaagaccaacaagcgtccagaaaatgactgcattccagcatggcaggtgatgtgtaaggagggttgccatccagcccacacctggggcagggagggtctcaaacatcaggggaggctgagcctcctctcagaagtcataacctgacaaggcccctgccctcagggactttgcattctagtgtgggaaaacagacagccaacctgtaaacaagtaagcaaataaaatcatttcaaatagtgacaagtgctacaagaaattgagaagaagtgacggggctggcacatagaaggtctactctgagagaggggtcaaggaaagctttttgaggaagtagcattgggctgggcttggaataaacggtaagaagctaggggaacagcccttctgacagcaactacctcagggcaagggccccgaagcaggcctagcatggccagttaaaaggcaggaggaagagtggacaggcttgagcatagagaacggagccaggaactgtgtgaggccgagagtgggcagcagctgagccaggtgggcttttgcaggccaatgagtatttgtggaatgcattaactctctgagaagtggaaaccaatattggtcaaattaatatgcagctattgagagagtcctgaggagctggaggaaacagagggagtcaggggtgccctgggaggctggagggatcacaggcctagtcccggaaccttggctatgagtttcagcctgatcctcaggccctgggcacccatgggagggttttaggcaggatgacattatctggatttgcactttagaaaggtaggtaaataatgcctcacaaacaccttccatgtgtcacacactcggcctttaatcctcaaaaccccctgaggtgatgggggtggcattccagcacttccccacctctaccacataacagtgagggtttggkgagccaaactcatgagctcagatgagcaggaaattgccagaaaaaaataggcccagttctgtggtactcccaargatcctcttacagtgacttttctcttctaggatcccatcaggctccttggaaagtgcttctacttccgaagccaaccctgaggggcactcagccagctctgaccaggaccctgtggcagacagagagggcagcccggtctccggcagcagccccttccagctcacggctttctccgatgaagacattatagacttgaagtaacagagttgaatctcatttgccatctttagttttcttatggaggtttatactctttaaacagttytgatgtaatttctcaacaaaatgtggcttttagcctgtcagtgatctattggaccaaaccttctgcacactcggccagttccctctccaatgtccggtgccatctttcctgacctttgtttctttctgttcaggaaccatcagtccccttgtaataaaggtggtagatttcattgaggttttagattgaaactttgaataaatcaaaaatactcattcttatttactgcaaccttctcatattttatatacttagatggaaaattattttttcattacagttttgatttatgtcacataatgtgtttcttttataaagaaaagtcgttgctttttaactttattataagtaagttttttttctgcacctttggccccggttgctgtttcagttcaccgtgattggaaccagctgcattcctgcctgtagacttttgagaaaagttgaatggttagatcttagaagctcctccttcttccctgcatctcatgaaaaatattaaggcataggagcttgtcaaaagtcttcagattattttgtgtggttttattgttactctgcaataatgtaaccagagaacagctactccttgtggttaaaagtattctcattgtaatcccagtgctttggaaggccaaggtggaaggatcccttgtgcccaggagtttaaggctgcagtgagctaagattgcaccactgttctccagtctgggcaacagagggagaccctgtctcaaaaaaaaaaaaaaaaaaaagaaaagaaaagaaaaaaaaaagaaagcattttcaaactcctccttctttttgagtccccctcactctttcacataaatgatatgaagataataatttggtttatctgcctttcctggctccctctccagtgtgaacagaaagaaatgtggactgggccaagtgcaaaagaaatagtgaaatctcagccactagccaaggggagatccagtttcactagcattgtttgcaaatattttaatctgtgtgaagaaggtattttacctttggctttagtctagccaattcaattttattctgtctcttcctacttatattattacattattcatcaaaggaaacttcctgttaccccgttaaagcagctcagaagagttcttctgcaggcttttttttttttttttttttagacagagtcttactctattgcccaggctggagtgcagtggcacgatctcggctctctgcaacctccacctcccaggttcaagccattctgctgcctcagcctcctaagtagctgggattacaggcacgcatcaccacacccagctaatttttgtattttagtagagatggggtttcaccatgttggccaggctggtctcgaactcctgacctcgtgatccgcccaccttggcctcccaaaatgctgggattataggtgtgagccactatgcccggccagcaggccttctttgtgagtgtggagaactgagtttgacaggaccttggtctgacagattttatagaagtttgggtcgtacctcctagtgggccttgcacactgtggggaaagttcccctctctgtcttttgtacaaacagatcagcatgatagcccaagctgaaggttgcttggttcatctttggcagaaggcaagagtcaagagtagtaaagacagtgctttttaggtatacccagatggggctgtttataaccaaatgtgtctgctcatattctttgcagcagttagcatgcccattcttcctttgtgtgttttatgcccttttcctatatagggggaaaaaaacactgtgtctcaaccccaccaacagtttaatgaattatgttttattattcttgcttttcaaataaggaaataggcttaggaaggggcaatggtttgaacctgcaagttctttgactccagagcccttgctttccccacgtctgccatgcagagccaggctcagtgccttgtgtcagctggatctggctggtgtttttcatgttaaactaatttgtaagctttatgagcttgtatctgtgtttttcctttttttctggaagtttcttgcttcacagtgtagcataaaaaaaacccaaggactattttagagcattcttccaaatcagcagcattagagccacccacaatttgacaagagtcacaggtctgaggagtgatgtagcaagggcaagaggtggaccctactgatcaggctgatggtgctttgcctatgaaaagggggcaggaggctgttctggcaacattatttgtctacaaaggccaagaagtgagttctgcacactcacgggaagggaagccatcggccacagggtaggagcaccctgcctacataatcctttctgtgtacccgactggctgagtcacacagaaaatcatctaactgcagtgtctgcctatggagttggaggcattgatccactctgcacacaccaagtgcctcctctccagaggaggtcatgtccattgggggaaggacggaagtaaacaagggatcacaaagcagtgataaatgctgtgataagaatacacatctagtgctcgagttatcaagcattagatgctgtgggagtacagaagggcagttgcctaagtctttaaggataggcttgtggtcaggactgaaaaatgttggttgctagaaccatcaagtgactgcaacatatcagatgactgtcttcatcataccggttagcctttgagtgcttcacatgtcttatatacattaccttgcttcacaactctcctggaagataatggtcatccccacttagagatgaggaaacacaaggcccagagagggattacaagccaagcctcttactcccatgccctggctctttccagaattacaccagcattccaccacagctgcctgcacccagagtgttgggtatgaatcgggtacaactggtgagatccaacagtgcctcatcattcgacttgggtgcacacgggagaaggtggcattaaaatccacagggaactcaaaatatggaggcaggtagatgaagattcaagagtcaggactccctgtgaagtgagtgacacttaagagggggagtggagcccagatctgtcacacatacggcgtgggggaccccacctaccactggtcctcagcacctggagacccgagccttcagcaatctgggaagcatgaaagtgggtttcggtgcacagggccacgcctccgccgccagcagcccagcgggagcgtctgaccagtctcgccctccgagaggagagagaggcggcccaggacggtctgcttagaggctctctcccctgcagagctgggcccaggcataggtcagacgcctccaatacagtccccagggcagcgattaaagcggagcaggaactgcagacccgaccgggcaggacaggtgcagcttctcggagttgggggcgggaagtctcgggctgaggcccacgtgcttcgccttcgccccgcctctaccctcattggttgaagccagattgagaggaggtgccagaaaaaaaactcctccctccaacctcattggccagctcagttctgaggcagctctctggccccgtctatgggctcgcactacactccaattgggtggttgttctcccagacggaaactccgccccacctgtaccttggaccgctccgccctaggggcggttccagcgcgcttcgctaatcggttctatgctcccattggtctgctttaatgtgaagggcgggtcctagctgattcgctagccccgccttgcgttcctattggctgctcctgctctgcggttccgatcccgcccagcaccgtcccccaccccccgccgcccattggctgcgagaggccggtgcgggccgcactcgcagggcccgtggcggttcaggcgccagagctggccgatcggcgttggccgccgacatgacgcccgaggacccagaggaaacccagccgcttctggggcctcctggcggcaggtgagctccggggaacccgggcccggatgcggcctcgccctcccgcccctccgcgtccgctccgctcaccctcggccctgtccccccagcgcgccccgcggccgccgcgtcttcctcgccgccttcgccgctgccctgggcccactcagcttcggcttcgcgctcggctacagctccccggccatccctagcctgcagcgcgccgcgcccccggccccgcgcctggacgacgccgccgcctcctggttcggggtgaggccccgggctcgctcctcccgccctgggaccccacgccctcctctcgggacgggcatcgggaccctccgccccccacccttcccctcgggacaggcatcgggccccgccgccaccacctttccccacgagacaggcattgggcctctctgccccccatcccttccctcgggacgggcatcgagcccctcagcccccacccctcccctcgggacgagcaccgggcccctcagccccctacccctcccctcgggacgggcgcggggccccggctcttttacctctgagcccgcggggagtgggtggagggggaggatgggctgcggcttcggcgccccctcctcagcagccgcccgcctccaggctgtcgtgaccctgggtgccgcggcggggggagtgctgggcggctggctggtggaccgcgccgggcgcaagctgagcctcttgctgtgctccgtgcccttcgtggccggctttgccgtcatcaccgcggcccaggacgtgtggatgctgctggggggccgcctcctcaccggcctggcctgcggtgttgcctccctagtggccccggtgagtgtcccgtctctcgagtgtcctgtctcgcggcctgagaccgagggggagtgggacaaaccgctccccaggcctgggggcgcggctccccctggcgggaccttctgggtgccaggcttgaagtccctgcgttatctcgcggtccctcccgtcgaccctgggaaggatcctactgttctctccattttacactgaggtcatgacatgcagtctcggaaaggtgaagtcctttgcccaggcgaggtccacagctagtcagaggggaagcagttgcaggaacccagggttgtcccacttagccgtgcccctcttttgctctgcaaacctgcggatgatccacaggagcccactccctacattttggttttcatccctggcttcgggtcaatgactgcaattagcaggaagttcctgtcctgatttctcttggggcaaaggctgctggcctctgtgttccccttcccttctcacaggccagcccctctggcttccccatcttccccctttccccctcctgacccaggctgcccacttgggagccccgaacatctgggtcaaatcctggttctgccactaacctgagcagagtgcctccctgggcctcagtttccttctctggaaaacagggattatggcattagcccctgaggtagtggtcaggattcagtgggactttggatagacagcccctggcatggcttgtagaggactggatcctgacagcttggtgacccatgaactgcccccagccatgggcttggacaatatctcccccaagtgaggttgaaagcagccactcaggcccctccctgggtgctcatttcaccaacgtttgctaaccggcagcagcagctggaccagaagagggtggggaagaagctgggccttttatgtctttggtttttttaactgggcagaaacacacctgtgttaggggcctaagctatggaataaccttagatgcatgggtgagggcctggtggcctgtgggcccaggagggagctagtggcagccactggtagtgaccgaggcagagagttcgtgcttctagtccaaggccaccactcaaagcgtgggccctgggctaggatcctgggtgggcgtcacgtggagctggttaacaaggtggaatctttcgcctgtccagacctactgcatcggaatctatgatttatccagggtgtctgtgcacattaaacgaaggcttgagaagctctgtgcccaccgcctctcgtcatcatatgcagccctctccgttacccttaatcccctttaaacacctgccacagatctttcagtggtggggacctggggatggctctgctcacctaggcaggttccactaaggggcttcagggcctgccgtaaccccctgcaaggactttcctcagctctgaatggctgagacctttccattttaagaactcttggagcctgagtaaagcctcatctttttttttttttttttaatttttatttaaaaatttcggagtttcgctcttgttgcccaggctggagtgcaatggtgggatcttggctcaccgcaacctcca

SEQ ID NO: 12563 - DNA, 46215 bp, Homo sapiens
  misc_feature (1)...(46215): n = A,T,C or G, or insertion/deletion polymorphism (see Tables 1-2)
aatacatatttatccaaagacgatatacatgccataacaatataacaagtatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctaatctcaggtacccagggacacagacgctgcggaaggccgcagggtcctctgcctaggaaaaccagagacctttgttcacttgtttatctgctgaccttccctccactgttgtcctatgaccctgccaagtccccctctgtgagaaacacccaagaattatcaataaaataaataaataaataaataaataaataaataaaaaagatttctttggggggtgctgggaatgttctggaactcaatagtggtaactgcacaagtctgtaaatatactaattttgaatcattaaaactaaaattcattaacaatcattgaattatacacatgaaaacaagcgaactttatggattgcaatttttttttttttttttgaggcagagtttcgctcttgttgcccaggctggagtgcaatggcgcgatctcagctcactgcaacctctgcctccagatgcaagcgattcttacatctcagcctcccaagtagctgggattacaggcatgcaccaccatgccccgccaatttttgtatttttagtagagacagagtttcaccatgttgcttcgtctggtctcgaactcctgacctcaggtgatccgcccgcctcgacttcccaatgtgctgggattacaggcatgagccagcatggtggccatggagtgcaacttttatctcaataatgctgttttgaaaatagtacagagagttcttgtgtacccttcacgtagcttgagaactttttattttattttatttttgagcgagagtctcactcggtcacccaagctggagtgcaatagcatgatctcagctcactacaacctccacctccgggtgcaagcgattcttatgcctcagcctcccaagtaactaggattacaggcatgtgccaccatgccccactaatttttgtattttagtagagacaggttttcaccatgttggctaggctggtctcgaattcctgacctcaaatgatccacctgcctcagcctcccaaagtgctgggattacaggcgtgagccaccacacctgccccctgcccaccccccagaacttgttttttttttttttttggagacggagtcttgctctgtcacccaggctggagtgcagtggcccgatcttggcttactgcaacctctgcctaccgggttcacaccattctcctgcctcagcctcccgagtagctgggactacaggcgcccgccaccatgcccggctaatttttttgtatttttagtagagatggggtttcaccgtgttagccaggatggtctcgatctcctgacctcgtgatccaccctcctcagcctcccaaagtgctgggattacaggcgtgaaccaccgcgcccggccaccccccagaacttcttatacaaccatagagcgacaatcaaaccaggaaattgacattggtacaatactctttttttcttttttgagacggagtcttgctcttttgcccaggctggagtgcagtgactatctcagctcactacaacctctacctcctgggttcaagcaattctccttccttagcctctcaagtagctcgaagcacaggtgcgtgccaccatgcccggctaatttttttgtatttttagtagagacagggtttcaccgtgttagccaggatggtctcgatctcctgaccttgtgatccgccagcctcggcctcccaaagtgctgggattacaggcgtgaaccaccgcgcccggccacaatactcttaatgaaactacagaccatagtaggatttcaccagggcttagagcaatgtctggcacgtagtgaaccttacacaggtgaaaggacttcactaccatgacgatgatgatgatgaagatgataatgatgatgttggactttctagcacagccagattgatatggtgcctattttcagagcatgccatgttagtttctatatctaaaccttttttggcctggcacggtggctcacgcttgaaatcccagcaatttgggaggctgaggtaggcagattacttgagctcagtagttcgagaccagcctgacaaacatggagaaacgccatctctacgaaaaatacaaaattagccgggtgtggtggcacatgcctgtaaccccagctactcaggaggctgaggcaggagaatcgcttgaatcctggaggcagaggttgcagtgagccgagattgtgacactgcactccagcctgggcgacagagtgagactctgcctcaaaaaacaaaaaacaaaccaaaacccccactttttttctatgaaaccagcctcgctctgtcacccaggctggagtgcagtggtgccatcatgatcctcccacctcagcctcccgagtagctgggactacaggcatgtaccactatgcctggttaatatttttattatttgtagagatgagggtctcagtatgttgcccaggctagtcttaaactcatgagtttaaccaatcctctcgccgctgcctcccaacgtgctaggattacaggtatgagtcacggtgcccggcttctttcttaactctttctagtagttctaccacttgggattacctttttccttcctctccatttacctttatgaaatcctcacatccatccatctccatcaaatctttaacaattctcctctgtcttttttgactgtagggacctttagaacacccagcattaaaaaatagatttcaggccgggcatgggggctcacgcctgtaatcccagcactttgggagggccgaggcaggaggatttcgtaaggtcaggagtttgagaccagcctggccaacatagtgaaaccctgtctctactaaaaatccaaaacttagccggcagtagtggcgcgtgcctgtaatccagctactctggagactgaggcaggagaattgcttgatcctgggaggtggaggttgtgatgaattgagatcgcgccattgcactccagtctgggcaacagagtgagaccctgtctcaaaaaaacaaaaggaatattttttaaatttttaccgttctgaaagcacattgacatcctttgaatttttttctaattatttcactttgatttgtaaattctcaactagattcaggggctgtatgggttacaattcctctgcaccctccacggaatttcagacttttttttttcccccgagacagagtctcgctctgtcacccaggctggagtgcagtggcgcgatcttggctcactgcaacctccccctcccgggttcaagcgattctcctgcctcagcctcccgagtagctgggactacaggcgcccgccaccacgcccggctaatgtttgtatttttagtagagacggggtttcaccatgttggccaggctggcctcgaacttctggctttaagtgatccgcctgcctcggcctcccaaagtgctgcgattccaggcgtgagccaccgcgcccggccaaggtcttaattcttgcctgcctttctgctcccctgtgaactctactggttgtcttttttcctgctttatccctcgtcctcggtagacagtgatggttaaatgaatgaatgcatgaacaaatgactgtccaggagctagtactgcattgcatgtacacattgatgacaacagacatcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggcctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttagtttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcggtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaaygatattaacaagattatcatccggcagcctatccgsactgagtacaagattgcttttccttacttgtacaacamtcttccacaccatgtccacctcacctggtaagagacctggaacacaacatttggaaaggagaaggctgctgtttaggttgggccarggcgggaaaactttggctgactcttcctttcrttttaggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataaccyccacgaggcrctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacrtcaaaaatctcatctgggtagcaygattggtttactctcttgatgcgtggtagtaaagggaagtagtgttcgtgttaaactgaggaaaagcccrtrgtcaaagcaatccaratgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccastgcactctcagcctgggtgactgagcacaactccgcctcrggagtggaaaaaagtagaatttgctgaggggagaacaaaagaggttaacyctggagaatcctggggcatggctcacattcttaagaattgtagttckttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttccyggattcctagccttgcagggtactgaggcatrtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgagattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggtctggtgtaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcggccgggcacggtggctcacgcctgtaatcccagcactttgggaggccgaggctggtggatcacctgaggtcaggagtttgagaccagcctgtccagtgtggttctgaaacctcgtctctgctaaaaatacaaaaattaaccgggcctggtggccggcgcctgtaatcgcagctacttgggaggctcaggcaggagaattgcttgaacccaggaggcggacgttgctgtgagtcgagatcgtaccattgcactctagcctgggcgacagagcaaaaactctatctcaaaatacaaacaaacaaaaaaaagttaccttactctggtttccattagagtaactcttagctataacatttttcttgcattccgaccttcatatctctaaatgtgcggcatttgcatgcgcagaatgttttctgttttttagttaagtctgttaaggatacgttctgttatgttttagaactattgcattacggttgagtttcctttatccaaaatgcttgggaccagaaatgttttggatttcagattttcttttttaatattttcattatttttattagagacagggtctcactgtcacttaggctgaagggcagtggcgctatcatagctcactgcagctcaagtgatcctcacacctcagcctcccaagtatctgggaccacaggtgcatacgccaccatgcctggctaatttttaatttttttttttttttttttttttttgagatggagtcttgctctgtcacccaggctgcagtgcagtggcgcagtcttggctcaccgcaagctccgcctcccaggttcacgccattctcctgcctcagcctcctgagtagctgggactacaggcgcctgccaccacgcccggctaagtttttgtatttttggtagagaaggggtttcaccgtgttagccaggatggtctcgaactcctgaccttgtgatccgcctgcctcagcctcccaaagtactgggattacaggcgtgagccaccacacccggcctgatttttaaattttttgtagagctgggatctcactctcttgtccaggctggtctcagactctggattcaagcagtcctcctgccttagcctctctaatgctggattataggtgtgagtcaccgtgcccagccttgaaatattttcattatacttacaggttcagcatccctaatccaaaatttgaaatgccccaatgagcatttcctttgagcgtcatgttggtgctcagaatgttgggactcagaaagtttcagctttttgtgagcattttgggttttagattaacctgtatgtgggaatctgtgagagcactagagttagtgattgctctagcccagtctggaagtggaagaggaaaggattcctgaaagaagtagcatgtgatgagacaggtgagggagagcattcctttagccagaagtgtggcgatgtaactagcttgtgtacatgggaccatggaaagttcaaggtttgctggagtaaattgtggaattgggaatgttaagagatgaggctggataaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaaaggataggatgggagaccaggtttggggaccactgaagaagtccagataaaaatgatgagagcaggccaggcgcgggggctcacgcctgtaatcccagcactttgggaggcccaggcaggtggatcacctgaggtcaggagtttgagaccagcctgaccaacatggggaaaccccatctctacttaaaatatgaaaattagccgggcgtggtggtgcacacctgtaatcccagctacacaggaggctgaggcaggagaatcgctggaacccgggaggcggaggttgcagtgagccgagatcccaccagtgcactccagcctggcaacagggtgagactctgtctccaaaaaaatacataaatcaataaaaatgatgagagcactgaaagtagaggtaggaagaggggaacagatttgataagaagttagcagataaaatcagcagaactttgtggtcctgggatgctcaaagaaaagtcaaaaatgatgtgcagattttggcatgggtgactaggtgggtgttagtgccaccaactggaagaccacatgaacaagaacaggtttaggatcgaagataaagaaatctagtttaggatatataaagtttgaagttcctgagaacattcagatggagatttccccaggtatttatttataccttatttcttcagttccaagatacatatttaagtacatatatacacatgtgtagattcctgattccttctgctcccttagtggtgcctctttaattgatgatctgttagatttgatttaaaaagtatgagtgagacattccagggagagaaatgaaactagaaaggtaagagcagtcagggatagcttagaggttcctaggtgagaagcaatctgaagaaacatggagaacaggtctggattaaagatgtagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtgggagggtgccgggtcttggaaccaaggccttcaggaacacgtgtccagaattggggtgatgctgagcagtgtcagttgcctaagagcatttcagttagatgaggactgaaaagtatccattggatttgacagttaggacgtcattggtgaccttagcaggagctgttacagaaatagtagggatggaagccagatggcagtgggtgaggcttcatgggaagtgagtgagtggagacagcaaggacaatctgtttgtcagttgaagagaaggaaggacatcagatgccacctagagggagctgtaagtcagtgcaggtgtttttgaatgacagtgacttgagcgtgttttaattaaggagcccagtagcagttgagtgtacaagagaaaagtgtggaattggctggacacagtggctcacgcccgtaatcccagcactttgggaggccaaggtgkgtgaatcaccaagtcaggagttcgagaccagcctggccaacatggtgaaaccccgtctctactaaaaatacaaaaattagccaggcgcggtggcgggtgcctgtaatctcagctactcgggaggctgaggcaggagaattgcttgaacccgggaggtagaggttgcagtgagccaagatcgtgccactgcaccccagcctcggcgacagagcaagactccgtctcgaagaaaagaaaagtaggtaattgatgagcagaggtgcagagggtctccctagggatagaataaagagcaagcagaggaaaaatcctctgaacctgacaggaaagaggtctggaaagatgtggatatagatgaggttagtgggaagctataacaggattttgagtttttcagcttttcttgggctgcagttaggggaaagagttgtgcatagtgaatttcatggtattagggtatgatgattgctgaagaaactgagagggattggaaggtgtgttgggagctcagctgggttttgggaagacaactctgagcatttgtttttcccagaatcacccagctactcagtgacagggatgcagaaggtggatagattacactggtgattaaggaatagagctctgttagaagacagttgtagagtggtaaggcattgaatgcaagggaatcaagagtgcgggacccagccggccgcggtggctcatacctgtaatcccagcactttgggaggccgaggcgggtggatcacgagttcaggagattgagaccatcctggctaacgcggtgaaaccccgtctctactaaaaatacaaaaaattagctggatgtcgtggcgggcgcctgtggtcccagctactcaggggggctgatgcaggagaatggcaggaacctgggaggcagagcttgcagtgaaccgagatcgcgacactgcactccagcctgggtgacagagcaagactctgtctcaaaaaaaaaaaaaaaaaaaaaaaaagaatgctagaccccattgagatactggaagaggggagaggagagagagcagaagaggccattggcctgggaaagaattgtaggcatcagggaactggatatcagaagttagaggctgaggagtggaggagtgtctgagagggtaaggatgcagttgactctagtggttagaagcacaggctctggagtcagatggggttcacatcatatctttgtcatattactagttgggatcttgggaatattgcccatgctgggcctcaattccctcatctgtaaaatagggatactgataggacctaggtcagacggcttttgtgagaattaaatgaaacggggtatttagtaagccatattacttggtaaattgcatgataaagctgggcatggtggcttatgcctgcaatcccagcacttttggaagccgaggtgggaggactgcttgagcccaggaatttgagaccagcttaggcaacatagcaagatcctgtttatatttaaaaataaataaataggccgggtgcggtggctcacgcctgtaatcccagcactttgggaggccgaggtaggtggatcacgaggtcaggagttcaggaccagcctggccaatatggtgaaaccccatctctactaaaaatacaaaaattagccaggcgtggtggcacatgtctgtagtcccagctactctggagactgaagcaggagaaccacttgagccccggaggtggaggttgcggtgagctgagattgcgccactgcactccagcctgggtgacaaagtgagactccatctcaaaaaaaaaaaaaaaaaaaaaaagctatgtcatgggcaagttctataacttgttttttatgaagacataagaggtataacatatataaatttcttaccatggtacctagtacacgtagacctgagtaaatattattttccttcttgcctccccttatcccccaggaatttctgctatttagtaaaggaacactgggctcctcaggaatttatgcctcctccccttcagggatagagcactgttaactacaacagaaatactgtgttccattacacacatcagcaattccaagtgcagtccaagaatttactaaacctaatgggaatcatccacttgcctttaccccagtatctagcctatcctggcccctggccctcctttttttttttgagagggagtcttgctctattgcccaggctggagtgcagtggcacaatttcagctcactgcgacccccgcctcccgggtttaagtaattctcctgcctcagcctcctgagtagctgggattacaggtgcctgccaccatgcccggctaatttttgtatttttagtagagacagggtttcaccatgttggtcaggctggtctcaaactcctgacctcatgatccaaccgcctcggcctcccaaagtgctgggattacaggcatgagccaccgcacccggcccccctcctttctgtagatctgcctggttgtctcatcctgtggacatgcgagatgctcagtctagctttcatagtagggtttgagctgttatctcacctgcagtcttttctccttgcttgtctgaataccatttgctcaaggcagattactatagtaactccagccaacgcactctttcacctcaataattgttcagaagacattttttgccttaaagtcttgactatatcatttggtattttgtggtttgctatcttgttttattcagcttttcaaagaaacagctttggtttcattaatttttatcgtttttctcttttttgttgcattgattttttttttttttgagatggggtctctatgacccaggttggtgtgcagtgtcgcagtctcagctcactgtaacctctgcctcccaggctcaggagaccctcccaccttagcctcccaagtagctgggaccacaggcacatgccaccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaaggtaaaaggttagattatcaattttggacctttctctttttttttttttgagacagagtctcgccctgtcactcaggttggagtgcagtggcgcgatctctgctcactgcaagctccgtctcccgggttcacgccattctcctgcttcagctcccaagtagctgggactacaggtgcccaccaccacacccggctaatatttttttttgtatttttactacagacgcggtttcaccgtgtttgcgaggatggtctcgatctcctgaccaccacctgatcagcttgcctcggcctcccaaagtgttgggattataggtgtgagccaccgcacctggcctggacctttctctttttctttttttttttttttgagatggagtctcactctctcacccaggctggagtgcagtggcgcgatctcagctcactgcaacctccgccctctgagttcaagcgattctcctgcctcagtctcccgagtagctaggattacagatgcctgccaccgcacccggctaatttttttgtgtgtttttagtagagacagggtttcaccatcttggccaggctggtcttgaactcttgacctcgtgatccacctgcctcgtcctcccaaagtgctgggattacaggcgtgagccaccgtgcccagctgacctttctcgtttttttttgtttgagacggagtcttgctctgtcgcccaggctggagtgcagtggcgcaatcttggctcactgcaacttccgcctcctgggtttgtgtcattctcctgcctcagcctcctgagtagctgggactatagtcgcctgccaccatgctcagctaattttttgtatttgtagtagagacgggtttcaccgtgttagctgggatggtcttgatctcctgacctcgtgatccacccacctcagcctcccaaagtgctgggattacaggggtgagccaccgtgcctggccaacctttctctttttctaatagtattattcacttctgtaaattttcctctcagcattgctttagctgcattcctccctttttttttttttttttttttgaggcagagtctcacattttcgcccgggctagagtgcagtggcacgatctcggctcactgcaacctccgcctaccctgttcaagcgattctcctgcctcagcctcccaagtagctgggattacaggtgcccgccaccacacccagctaatttttttttgtatttttagtagagacaggtttttaccatgttggccaggctggtcttgaactcgtgacctcgtgattcacccgccttggcttcccaaagtgctgggcttacagatatgagccatcgtgcccggccccattcctcacattttaatatgttgtgttttcatttttatttagttaaaagtatattctaatttcccttatgagttcatatttcaccttaggttgtttcaaattatgctgtttacatatttgggggtttcccttattagtttctgctttgattccattatgattaggaaacatgttgtatatgatcttagttttaaaaaatgtatcaagattttttttttaataattaattcatttagaggtgggatctcactcttgcctaggttggacccaaactcctgggcgcaagcgatcctcctgcctcagccttccaaagagttgggattacgggcatgagctactgcacctggctgaggctgactttttgatgtcctagcgtacagtctctcttggtgcctgtcctatgtgtgctggaaaatatctgttaatctgtattctgctattgttaggttgagtgttttacaaacattaggtccagtcagttggttacattgcttaagtcttctatatccttagtgatattttttgtatacttctatcgattactgaggagtattagaaatctctagtaatcccagcagtttgggaggctgaggctggtggattgcttgagcacaggagttcgagaccagcctgggcaacatagcgaaaccccatttctacaaaaaaaatacaaaaattagctgggtgtggtggtacacgcctgtagtcccaggtgcttgggaggctgaggcgggagagtctcctgagcctgggaggtggaggctgcaatgagtggagatggtgccattgcactctagcctgggcaacagagcaagaccctgtcttgcttgagagaaagatccaactacagctgtgagtttattgtctttcaggtccatcatttttgaaattctgttattagttacataatgtatttaggattattaggtcttctgaacgagttgactactttatcgtatcaaatatccctctgtattcctgataacattccatggtctgaagtctttgtcttaatcagtagtgccactccagctttgttttgtgtttgcatgggtgtatttttccatctttttactgttaatctgtgtctttgtaactaaagtttatttcctatagacagcatatagttggctctttttttttttttttttttttttttttttgagatggagtctcttccttggttgcccaggctggagtgcagtggcatgatcttggctcagtgcaacctctgcctcccgagttcaagcgattcttctacctcagcctcccaagaaactgagactacaggcgcgtgccaccacgctcagctaatttttgtatttttagtagagacgggggtctcaccatgctgtccaggctggtttcgaactcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttrctttttttyctactacctttagattgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgagttgaggctcaggaccatgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgtkgcctcttattcttggggtggacttggyaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacgccattctcctgcctcagcctcccgagtagctgggactacaggtgcccgccaccacgcccggctaaattttttgtatttttagtagagacggggtttcaccatgttggccaggatggtctcaatctcctgacctcgtgatccgcccgccttggcctctcaaagtgctgggattacaggcttgagccaccgtgcccggcccagcaacgcatattcttgaaacatccactttgaccaaatctcttctctacctcacaactcttgctgaattaactcttctttagcttcctagacgttcaacatctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccraaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggccggcagggccgaagcctgagacccgggtctccccagctgcaggtgtcggcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggacgcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccgggtccccggccttctgctcgaggccatgaaggtggctgtccggaagcagcggaagaagatcaaggccaagatgttagggacaccagaggaagcagagagcaggtaggtccctgcctgcattcccacggagccaggcctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccacccccggagtccaaaatacagagtttgtatgttggggaaaggggaaaggcaagagtgtggggagggaggaagggccctggctggtccttctcaggatcccctttcccgcttctctgcccatcaccctgctgtgcttggctctaagcacaccgtcccctcctgcttctctggccctggcccccatcaccttcacactccctcaggctgccctttcttccccctctccccttttctcaccatcccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctccggcctggtttcctcaggaaaagccctgagaggaagcagggagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgataccaggagtcagggtttctcctgtgacgcacccccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatcc

SEQ ID NO: 12564 - DNA, 67858 bp, Homo sapiens
  misc_feature (1)...(67858): n = A,T,C or G, or insertion/deletion polymorphism (see Tables 1-2)
gaagatggaacagcatacacaaaggcccagaggtgagagggatgtggctgtgtgccattgaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccctggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgcctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttctttttttttttttttttttctttttgagacgaagttttgctctgttgcccaggctggagtgcagtggtgcaatctcagctcactgcaacctctgcctcccgggttcaagcgattctcctgcctcagcctcctgagtagctgcaattacaggtgtgtgccaccacacccagctaatttttgtattagtagagatggggtttcaccatgttggccaggctgttctcgaactcctgacccgcctcggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatctagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgctgtccaaaatgaggctatgtcgcgagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaactgaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcaggctgacagctccaagcgttgtctgggggaggttgccctcgccaggtggcccgggcggattctagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtccctgggagaggcagccctcggatctgccsctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaaggggctggggtgcagcaggagaggaagtggccttgcctccaccccagggagggctcatctagaatctagacgttcctcaggccattgtggagtctcctaagtgcttgctggacacaatttcttgtctatttttgctgccttatgattctccaaaggacatttcccccacgggctctgaggacatctccgtggctttccaaccccatggggatgaaggggaagagaagaaaggaacgtttatggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctctagcctcctaccctccttcttaggcaaccttgacaggaaattttccctctgccttctccttgatcccaacggtagctgcataatagctgagctcacataatccctgtcgccagtgctagagtgcccttagatggaggtagcccaggtttgacttcctgaatccccagcagcaggccttttctttctagagctctttgcaggaagagaaagctttggaccagctcatgctgggtgtaatcctttgtggaagcctccctgtttcccttctctgatctgccccggagattcctgtgtgtcccagtctctagggagggaggcttagctggagaggttcagggcaggagaaagcaggagaatgcagaggccgcggggagaggacagaaagtatatcatttataactaacctttagcctttagccactcaaaaatatttcctaatagcctaagggttcttggcaggtctttccccacatcagcaagaaatcttgggagttgggaagagtcagaccttgttccctgaacaagctttctgctttggccaagagttgttaggagattaatgcctgtccccgaaaggcacaggttggagtgtttacttcttcctctcctttcctctctccyccsttagagatcgtgacccttcctgcttgcytccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttgtgtgttttttttttaacccaccatgatgtcggaaggtcagattctaggtgttttttgtttgttttttgttttttgttttttttttaatagaatgtccacggatttaattgattgtatggttttggcagaattgggtctggtcctttcattcctgcctcaacctcagcttcctcctctgtctaagtgggaggagtcccagagattgtgccagcgcagtgctgagttggtgttttaagccctgggcagacttgacaggtaactccactaaaccaaagtgaaggtgaagggtcaggattgtgggttgaacatcaacttcttatcccgaacttttgctcctgcctccaattttggtttttcttattatctggcaaacatgctgagcccacgttctgggcgggaaggctgctgattccacacagcttatctctctggtcacactgctccttgattcttggagtctgcatcaccagttttctttcaggccagaaatccccgcatttggctcgtctgggagtgcctggcgaagttagggtgaaggtttctgcttcagtctaacattttcaaacttggtgcatggctgaattgcagagaagcagataggccatttttgaatttattgaattagacttgtgaaagcctgagcagtgtccggctgattgagatgcaaatttgtcagcttcgtgtcactctaggacgatgctttagtttgttctctaaagaaaatttgcctgaacctgttgaaaggttcttagaactctttcttacgactccagccagaatctcgccacagacaccgtgttgggttccagcctggtgaggtggcagaaggaaggaaacagctcatttctcggctgccccgcagtttgttcttccttgcctgctgggagacgtggcaggctgggtttggggacctgggtgcgggaagttggcaatgggttttgcacaacgtcctccaggtgttggctgctggatgcctccctcgtccccctggtgagggcaggagaccagttgggttctcagcccgagaagcacggggcttcctggagctgtgtcctcttggcctctgggatggcaacgtgacggcccactcctgagctctttcttcattttctctgttgtccagtggcccccgcttcaacagggtcagggtcagcctggggggctgcggctacctgtggatggtttttttttatttgagacagggtctcgctctgttgcccagtctggaatgtagtgttgcaatcacagctcactgcggccttgactcctgggctcaagcaatcctcccgcctcagcctcccgagtagcagtagctgggactacaagtgtgcgccaccatactcagctaatttttgtattttttgtagagacagggtctcgccatgttgcctaggctggtctcaaactcctgggctcaagcgatcctcctgcctcagccttccaaagtgctgggcctgcaagcatgagccatcaaacccagttagttttttgtttttgtttttgggattacaggtgcccaccaccacgcccggctaatttttgtattttttagtagagatgtggttttaccatgttggcctggctggtctcgaactcctgacctcaggtgatccacccgccttggcctcccaaagcactgggattacaggtgtgagccaccacgcccggtcaaattttttgtagagatgagggtttcatcacgttgctcaggctggtctcaaaactcctgggctcaagtgatccaccagcctcagcctcccaaagtgctgggactacaggtgtaagccaccatacccagttaatttttaaatgttttgtagagataggggtttcaccatgttgcccaggctggtcttgaactcctgggctcagtcgatccacccacctcgggctcccacattgctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagctagaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattcccaagacaggaggaagccagggagatagaggagggcgaccatccaattcccctgttagaggcttgtgtgaattgctgagggcttgccacatgctggtatgtttgggtggcatagaaaccagaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccaccttggggaagcaggcccaggcttgatccccacgggctgagtgaagctgcagatgtggacaggagatttctctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctcagctcaccgcaaactccatctcccgggttaaagtgattctcctgcctcagcctcccaaatagctgggattacaggtgcccaccaccacacccggctaatttttgtatttttagtagagacagggtttcaccatgttggccaggctggtctcaaactcctgacctcaggtgatctaccagccttggcctcccaaagtgctgggattacaggcgtgagccactgcgcccagctcaagggcctctctttttagagtctctcctcacacccacaggcaagtgtggatagtttttttttttttgagacagagtcttgctctgtcgcccaggctggagtgcagtggcgcgatctcggctcaccgcaacctccgcctcccgggttcacgccattctcctgcctcagcctccccagtagctgggactgcaggcgcccgccaccacgcctggctaaatttttttgtatttttagtagagacggggtttcaccgtgttagccacgatggtcttgatctcctgacctcgtgatccacccgcctcggcctcccacaatgctgggattacaggcgtgagccaccgcgcccagccggatagctttcttaaatccagcctttcacttttattgctataaatatgacttttaaacttttcccccagtttatttggaattttaaaaattccatagcaatgggtaagaaggtttaaaggctggggccggcagcctcaggatgcgtctcagagaagagctggtggccttggctcttcccaccgccccagcctccctccttcttggttcgtgacctcatttccctcacagacatccactggccacccctggcttctggtgtccatgaaggtcctgtccagcttaggctggctctcagggacctcgtgggagagtcttagtcccattcccaccaagcgatattcagggcctcctggtgttgccggcacatgggcagccttttcccggctctgttctctcagcattttctctctgggatatgagcctctagcccaggtaggccagcatcggcacagaccgagtggtaagagcgggagctttggggtctgacagcctggagtcaagcccagcttccccagggacccccatgagaccttctgcaagtgacttacctgctctgagcatccctcggggacactctgacagtatcctcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctcccctgccggactgaggactgagatgctgcttcctgttgccggatagactaaggatttgagagacgggagatcctgggcaggggccatcggtgggctgtccaggggcccgcaccctggagggggggctcggaaagcgactagtcagggaagggggcagctcaggaatttagaggggacctcaagccaggtacttcttggccccctcaagcatcatcttggaggcccccctccctttgtctccccggggtgtggggaggctcctctttgcctcaggggagcctggggggccacagcaccctcttttctccctgattcctctgtaaagatcttgtgcgtcttctgtgagtggggctgaacggtgtacgtcctccctggccctgggtctcctcctaagcagccctgttcctgttcttggcactcactggccacaccaactcttgcctgtcttctcagttcaccttctctggccaggctgggctgggccacttctggccaccccagaggaggcatctgtttaataaacaggtgcaggtgaggagcagagcagcctggccgggggtgagcagagcaggctggcccggggtcaagctccaggctgggagcagagggccaccccacgccttggcacttcctgggtgcttaatctgtttgtctctctcctgacccacggtggcccaggtgggagcagagggagaggaacagcctgggtgtgtctgtttgggcatctgctgggtgcatgtgggctgtttactgtcaacagagcttctgggctcaccaagggcttccttccctccagcaggagggagactctcaaattgctccacaagcagaaggagaagccgctcacctccccggccccaggcgcctctgttgctggacgggacggcctggaggcaggcggccgggcagagggcctggtggccccatcggcagggatttgtttaagacgagaaggctgttggcctacgtgcaaggtccctgcccctgtgtgtagtcgctccagggtaaaagatgggaaggacagatacccttgcctctaccctgaccttgcctcttccctatgtggttaaaggggtgaccagatctctaatcaatttaagacttttgtttgtttgtttgtgtgtttggagacagagtctcactctgtggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaagtggtccgcctgcctcggcctcccaaagtgctgggattacaggcgtgagccaccgtgcctggcctagccttgggatttttatcttctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacstgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttccagaagctgccccactgtggatgggcgmgtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggccgaggtgggaatctggttggtgacgttgtatttctgtggctccacatggttaacctcgtggctctgatctccttaaatcccccctcgattcaacgtggttctgttgattcctctctcgatctttttggccattgtgatctggtgccattgtttttgttttgttttgttctgttttgtttttcgagacggggtctcactctgttgcccaggctggagtgcagtggtgtgatctcagcttaccacaacctccgcctcccggcttcaagcaattctcctgtctcagcctcccgagtagctgtgattatagacgcccaccatgcccggctaatttttgtatttttagtagagatggggtttcaccatattggccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctccgtttaccgggttcaatgattctcttgcctcagcctcctgagtagctgggattacaggcatgcgccaccatgcctggctaatttttgaatttttagtagagacggggcttcaccatgttggccaggctggtcttgaactcctgacctcgggcgatccacccgcctctgcctcccaaagtgctgggattacaggcatgagccgccacacctggccctgttgtttttatttattcagtaaacagctattgtaggccaagacctgggtgagatactggggacacagaagtgaccacagtgcaggccctgcccttcggggctcacagcccagtgggggattagacatgtctttgcgcttccacacacgctgacgggactgtgctccccacagccactgcatccggctctgtgccagctgatggtgccgtgattccccgccggagcctccaatagcagcaatgatcatgataaccacgagaacagcagcaacttgtagctattcattattgagtgctttctatgcctgggtgagctccagaaggttttctgaatttttctcattgatcttcccccacactctaggaggtggatcttatcattatatgatgtccatgttatggacaaggaaactgagctagagcaaggtcatgcaggtagaaagtggagaaacaaacactggaagctagaaaccagattccagttccacgctcttcatccacacggccccggcggggctccttggccacacgttggcatgaagcacgagtccacctgtgcgcatcctttccagtaaccttggaggaaccccgagaggcctgagcaagcttttgcaaacctcggcgctacagccctggcgccagagggctgcaattggaaggcaggcagttaccggaagaagagcgtttccttgactctcccagcgtgacctcatgtctaatcaaagtcggctcctgttttctgcaggattagtcagcatctcttaactagcagtcccggccaggagagctcctcagccacgttcccagcccgtcctccaccctcccatcttcagctgccacagcacttttctcttcctttctgtgttgttttggtgctgggtggactttgaagggggccattaagggctgggtgtggcaaacacaccagactcagcacccagcgaggtctaggcatggccacgggatggcaccactgtgaccccggcaaggaaaataagaaaggtgcatatcggctgggtgtggcggctcacgcctgtgatcccagcactttgggaggcagaggtgagaggatcacctgaggtcaggagttcgagaccagcctgggcaacatgatgaaaccccatctttactaaaaatacaaacactagccgggcgcggtggcaggtgcctgtaatcccagctactcgggaggctgaggcaggagaattgcttgaacccgggaggcggaggttgcagtgagccgagatcgtgctactgcactccagcctgggcaacagagtgagactccgcctcaaaaaaaaaaagaaaaagaaaatatcagggggagaaggtggcatctgttctatgtttgagaaggcagctggacttcccattgaaggaggcgccgcagtctccccacatggacagaggagaaccaggctattggggtgagaccagtgcttgtgcttcccaagtggtctgggttctgcctccatactggctgcagtctgtccccacggacatagctgccgtgagaaggttctcaccagcctggggccccacagccaaggctgggccctgaggtctgccgttctagggtggcggatgctctcgaatgggactctcagcctgggcttcgttgctcttcaagggacacacaaagctcctgaaactgtggataaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggaytctgaaygggcacctgcccttctgatctttgggaatccctgtcatgaccctgaggtcagggtttccttccctcttcacacagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcaggtcagtgtgggtcccttagggggcagggagtgggcaggtggacccyctgggctgagttccccacagaagggtatcctggtygtacctgatatcaggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataattggggtttccctcgcatgtgtgagacatgcttccctcaaaccttgttacgaagctggcacagtatccatctgatgagaaaaaaaaccaacaacactggtttccacagcccgtttgaccttatagctccaccagaaaaaagattttcaacacgtacccccaatataataagcacatggaattataaatgatgtatatctgtgctctttttttttttttttttttcaagacggagtcttgctgtgtcgcccaggctggagtgcagtggcgtgatctcggctcacggcaacctctgcctccccagttcaagcaattctcctgtctcaccctcccgagtagctgggattacaggcgcctgccaccacacccagctaatttttatatttttcatatttatttatttatttatttatttatttatttatttatttattgagatggagtctccctctgtcgcccaggctggagtgcagtggcgcgatctcggctcactgcaagctccgcctcccgggttcacgctattctcctgcctcagcctcccgagtagctgggaccacaggcgcccgccaccacgcccggctaattttttgtatttttagtagagacggggtttcactgtgttagccaggatggtctcgatctcctgaccttgtgatccgcccgcctcggcctcccaaagtgctgggattacaggcgtgagccatcgtgcctggcccctatgccattcttttttttttttttttccttttgagttggagttttgctgttgttgcccaagcaactggagctggagtgcagtggctcccggccccctatgccattcttaatgtgctttataatacatatacaaaaatataaatgaaaatgggctgggcacggtggcttacactggtaatcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagtgagccgagatcgcgccactgcactccagcccgggtgacagagcaaggctctgtctcaagaaaaaccaaaaaccaaaaacaaaaacaaaacaataacactgaataaagtcataatggtaaataacattgcgtttctgcttggttttagcgcctgcttcgcggtttcctgcttgctgattgcgtacggagcaagtaaaccaaacggtgagtgtcctctccctccatcttctgtcagggaccggggagagagtgccctgagctgctcccaggcccacctgctcttggacactgtcctgggcctgctgctccctgctcaagttagaggggacacctgttacgcctctactcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccattctcctgcctcagcctcctgtgtagttgggaccacgggcacccgccaccacgcctggctaattttttgtatttttattagagatggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcctgcttcagcctcccaaagtgttgggattctaggtgtgagtcactgcgcctggacactgctaatattaattggagaaaagaagatgggtgtgcagctttttcaagagcccacgctttgtgaaataggcaagaggaggctgggcatggtggcttatgcctgtaatcttagcgctttgggaggctgagatcggcagatcacccgaggccaggagttcgagaccagcctggccaacatggcaagacatacaaaaattagccgggtgtggtggcgcatgcctgtaatcccggctacttgggaggctgaggcaggaggatcacttgaacccgggagtcagaggttgcagtgagccaggatcgtgccattgcactccagcctgggtgacaagagcaaaactacgtctcgattaaaaaagaaaaagaaataggcctagaggagggggtgagaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctcagcctcccgagtagctgggactatgggcgtgcgccaccacacccggctaatttttgtatttttagtacacatggggtttcgccatgttggtcaggctggtctcaaactcctgacctcaggtgatccacccgccttggcctcccaaagcgctggggtgacaggcgtgagccacctggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaactgcctcaacctttgcctttgtccggagccagatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaaggggctgggcatggtggctcacacctgaaatcccagcactttgggagactgaggcaggcggatcacttgaggtcaggagtttgagaccagcctggccaacatggtgaaaccccgtctctactaaaaaatacaaaaattagccgggcgggtggtgcatgcctgtaatcccagctactcggaggctgaggcgggagaattgctggaacctgggaggcggaggttgccgtgagccaagatcaagccactgcactccagcctgggcgacagagccagactctgtctcaaaaacaacaacaaaaaagaaagtcaaaagaggaaccaaaaagtctctcccagagggaagaagggaactctctgtgggctcgcccagttgggcaatcgtgccattccgagctggccattgggaaagaagtgagaataatagcttcttcagagaggcttctgtccatcaaggaaacctcgcctgcatcagtttaccggtgaaaaagtttctaagacacagtacctaccattactatttgtggtacactctggtttctgatttcccttgtcgtgccattgaagggttcttgtttagctttgagggagctctgggggcttctggacctcttcttttttcctttttcttttttttttttttgagtctgctcggttgcccaggctggagtgcagtgacgcaatcttggctcactgcaacctccgcctcccgggttcaggcaattctcctacctcagcctcccgagtagttgggactataggcgtgcaccatcacgcctcgctaatttttgtatttttagtagagacggggtttcaccatgttggccaggctggtctcatacccctgatctcagccaatctgcccgcctcagcctcccaaagtgctgggatgacaggcgtgagccacggcgctcggccgaaaaccagcagctctttcatcagcatgaaaactaaaaacctggcctcacctccattattttagtcacgcgacgcctctgtcacggcaggcctgaatttcagggataaaggaacgagatggtccttgagcttgaggacctcacaccccgaaatgccgagaggtgttttgtctgaaaaacgaccaagaatccctgttaagaaagactttaggccgggtgcggtggctcacacctgtaatcccagcactccgggaggccgatgggggtggtggatcatgaggtcaggagttcgagaccagcctggcccaagatagtgaaaccccgtctctactaaaatatacaaaaattagctgggcacagtggtgggtccctggaatcccagctacttgggaggctgaggcaggagaatcgcttgaggccgggaggcggagtttgcagtgagccgagatcgcgccactgaactccagcctgggtgacaagatcaagactccccctcaaaaaaaaaaaaaggaaaaaaagaaagactttaaaagggaccctgcggttggagctaataggccagtaagaattctttgtctttttttatgttttataattataaaacaaaatttttttcattacattttttattttcattttttacagatggggtcttactatgttgaccaggctggtctcaaactcctgggctcaacagatcctcccaccttgacctcccaaagtgctgggattccaggtgtgagccaccatacctggcccaaaaatgattttattttaaaaattcaggttgggagcagttgctcacacctgtaatcccagcactttgggaggctaaggtgggaggatcatttgaggccagggttgagaccagcctgggcaacatagcgagacaccttgtctctccaatttttttttttttttaattagccagggcatggtggcagttgcttgtagtcccagctcctcgggaggctgaggtgggaggaaggcttgagcccagaagttccaggccacagtatgccacaatgacaccactatattccagcctgtgtgacagagcgagaccttgtcccaaaaataaaagtaaaaatttaacatttcagaaatatgaattgtagactaaacttctatgagcctgccaggcgcagtggctcacacctgtaatcccagcactttgggaggctgagaaggttcccatcacctgaggtcaggagttcgagaccagcctggccaacatggtgaaatgaaaccccatctctactaaaaatacaaaaatattactcgggcatggtggcacacgcctgtaatcccagctacttgggagactgaggcaggagaatcgcttgaacctgggtggcggaggttgcagtgagccgagaccgcggcattgcattccagcctgggcaacaagagcgaaactccgtttaaaaaaaaaaaattctatcagcctgtcttcatcagtttggaatatatttcttcagtatttaaaagatctgcatgtaccagtgttattctttttttttttcttaaaaaaaaaagaactgtgataacttgccttttcccttaatgtatcttttacatcctttcctgtcagtacttagagatctgccttattattaagcagttctgtatattattctttaatatagatggaccatcatttattcaacctgtttccaactaatggacttttggcttggttcccaatttttccaatttatgaatgctgctgaagtgagcatccctgtacatgtatttctgtaaaataagttcctggcagccctgggccacaggattagcatgttttaaaatttaatatgtactgttaaatagtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcctgccaccacaggcccaccagcacgtacacgagtgtcttttcctccatgtcccttccagtgccatgtcattcctctttaaaacatagccactctgatcctatgaaaaacgacatgccatttttaaaatttatttcattattagtgagacagagcattttttctcctctttattggtaaattgcatttcttctgtgaattgcttctttgtgtcatttgtctatttttctacagtgctcttgattttattattattagtatttagtgactcgtaagagctctttcaaatacaaagacactagtgttctttccgagtgagcaggagatcttaccctggggttttcaggtctctacatggtccatgagtaagcttcaggagagccgtgcacacccttgaaattccatgccaacaaagcgtgtgtaggtgctgctcagctgtgtctttctggaggggagggtccattactttcactggcctctggcaggtctgtgtgaaggctaaaaaccactgcggtggccgggtgcggtggctcacacctgtaatcccagcactttgggaggccaaggtgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactccagcctgggtggcagagtgagactccgtcttaaaaaaaaaaacaaaacacacaaaccactgtggcaggagcgtttctattcactctttgctctcccactggaggcaaaaagctacacaggctagagagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcctgtttgctcctgtctgtggctgcttttgtggtatctcatcagagtcaacgcagtcgtgacagaggccatatggcttgtaaagcccaaaaggtctactgtcttagccaggcacactagctcacgcctgtaaccccagcactttgggaggctgaggcgggtggatcacctgagctcatgagtttgagagcaggctggccaacatggtgaaaccccgtctctactaaaaatgcaaaaattagccagatgtggtggtgggcgcctgtagtccccacgactcaggaggctgaggcaggagaattgcttgaacccgggaggcagaggtygcagtgagctgagattgtgccactgcactccagcatgggtgacagagcgagactctgactcaaaaaaaaaaaagtctattgtctggccctttatggaaaaagtttgccaacccttggtccagaggccccaggaagctgctacgtcactgttcctcgtctgagggcatgtgctgacacccaccattcacacccacaccctctggttgcatgggccagctctccttctaagtcatctctttctgcctccccccagggtggagggagttccatgggcattcccctgccccctgaggcctctgatgagggctccagtgcctgctccttgagaacagaccccaaaagggaaatgaggtcagtgaggacagggctgaagcagttaagcaacactcttgggctgactggggcttctgctgagcagagccgaatctcattctgatacaacccaggacttcagaaagcagaactgtcgggatcagctcccagagacgccaagctcagggcacaatggcactttctgtttgtgtctcccacccgtgttctaatttgggggacaaaggagtctccagggtcgcctttaggaatttctaactccaatcttcaacaaccatgttggggctgtggataatagctctgtgataacccaggactctaggggacggcgttgctgtggaagccttaattcggggacttcctgggtcccggggcctttgtgctgcatgggctgtggtctaaatacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggctgcccagtagccagtgctggctctcccagggccctgcagcacagggcctgggccatcgcgtgccatccgtggagggcggacgccaggtcactccatgggggcagagcactccccacggtgtggatcctcagcctcccccgggacatctggacggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacccctgtccccgtgggtgggatggggatttctcagcagaagccacacagaaaagcgggtttcaaaatgttgccaggctccccgatgagacatttctctgtggattttcccttttgattccttcaagtctgactttaaacctgaggaaggcatgatttcatgggaggtgggatctgagggaagtgaagaggataaacatccctcttcagatcctggagaggagggcaggatggcagatgcccccagagaggggacaggagtttagtgccgtggctcagtagaccccgcgtctgcagccaggagagggtcccacggtggcccccggccagctctggagggtccaggagagggtcccgcggtggcccccggccagctctggagggtctaggtgcctggtgagcgggacttgccagtgcccagtgcctgctgtgcctccccaccttcctctctttctgtcctgtaccttggggaagctcaggcagtcagctacttgccattggtttggggagaatttgccatctgagggttctgcctcatgaatttgctgcagtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcaggttgtacagaactctgggtgtgtactccagccacttggggacaaggctccctctggaggggacccgagggccagaatgccagcccccacccaccacccagctccccagcccccacccacctcccagctccgcagcccccacccaccacccagctccccagcctcctgcaggccagggaggactcgggagtccgtggatgtggaaagtcagggccgggggtgccacggttgccccttgtttctgcctgccagcaatgccatggcctgccctgggccaaaaggcacgtacgtccggcatcttagagaagctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccagggggctgaaagagagagagtcacgggcttccctgtgtgactgaggctgcgtggaggcagtgagtgaacagcccgggctggcaggacaggttgacccgcacggaggcagaggcggcgagggggctgtgggaagcacctgagggcgggaagaggggcttgcactcccacctgtgagtgtggtggtgagtcaggaaacagctccggcttcctgcttggcagcaaagctggtccttcccctcctggggtccttcccctccgccagccctcgaggcccgcgctagggcgctctgctcagcgctcagccctcactccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggaggtgagggcagggggcagatgggtctaaaaggagcttcagaaggaatgtaagccatctctagttggggactgggcattgtggtatccccctgtagtctcagctgctcaggaggctgaggtgggcagatgagttgagcccaggagttctgcacaatagcgtgctgtgttgatgagatgtctacactaagttcagcatcagtgtggtgacctccggggggtgagggacccccaggttgcctaaggagggctgaaccggcccaggtcagaaacagagcaggtcaaaagtgtcctgctgatcagtagagggatcatgcctgtgaatagccactgcgctccagcctgggcaatacagcatgacctcatctccaaaaacaaatttaaaaaaatgaccgggcgcggtggctcacgcctgtcatcccagcactttgggaggccgaggcggatggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgtagccttggcgacagagtgaggctctgtctcaaaaaataaataagtaaatgaatgaaaaataaacctctagttgaagggcgcagattggatcttaataaggcacatgtaaaagccgtgggatccaaactgaagtgtgtattggccggagccacaggagactccagagaggcagcgtggcctggggcctacacacagaggcttggcctggcttgaatccccaatctgaccattactagcttgggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccaccacgcctggctaattttttgtatttttagtagagatggggtttcaccgtattggccaggctggtctcgaactcctgacctcaggtgatcccctgcctcggcctcccaaagtgctgggattacaggtgtgagccaccgcgcccggcctcatggtgttttttgaccaataaaagtttttaaataggtggtcaaaagtgtgtttcagcttttagggagtacctagcatttgtgtcaaatgaaacctctctgaagagaacatgaaggatgaccttgaccagtgaaacccaaagcataaacatcctgacagcagtcaatgtgtggtcacaacagaataacaaggacaggagaagaaaggccatctctgtggacactaattatttatttaaaggggaatactaatttgtgttttatcctgtagtcggcttccttttcttcctcccagagctgtggttcctgccagaggacacttccctcgttggctgtgcccaggagcagcttgaccagaagattttccctgttatgaagtcataacacatatcataatagtaactattgttaatacctaccctatttatgatctttaaaaccctcggccgggcgcagtggctcacgcctgtaatcccagcactttgggaggctgaggcgggtggatcacctgaggtcaggagttcgagaccagcctggccaacatggtgaaaccctgtctctactaaaaatacaaaaattagccgggtgtggtggcgggtgcctgtaatcccagctacttgggaggctgaggcaggagaatcgcatgaacccgggaggtggaggttgcggtgagccgagattgcaccattgcactccagcctgggcaataagagcgaaactccatctcaaaaaaaaaaaaaaaaactgaaaaaacaaaacaccatgaattaagaagttaaatgacaaactaggaaaatttattcatagtatatagaactgtgaatgtcttcattttattttatttttattaatttttgagacaagagtctcgctctgtcgcccaggctggagtgcagtggcacaatctcggctcattgcaacctctgcctctggggttcaagcgatttttctgcctcagcttcccaagtagctaggattacaggtgcctgccaccatgtccggctaatttttgtatttttagtaaagacgaggtttcactatgttggccaggctggtctcaaacccctgacctcaggtgatccgcttgcctcggcctctgaaagtgctgggattacaggtgtgagccaccgtgcccggcctgtgaatgaatgtctttaatacataaagagccttcacaaaatcaatatacaaagattggccgggtgcagtggctcatgcctgtaatcattgcagtttgggaagccaaggtggaaggatcgctggaatccaggagttcaagaccagcctgggcaatagagtgagaccctgtctctataaaaataattaaaacaaagctgaaggagaccttgctatgcagccccctgccgcttgtgcacccttgtcgacccacacgcaccttcaggagggcggcgcacacctggggtagtcacagtgcaggactctggctcaatagcgcctttgcattggtttggaccttcgggagggcggtacacgtctggggtagtctcagtgcaggactctggctcaatagtgcctttgcattggttgggaccttcgggaaggcagtgcatgcctggggtagtctcggtgcagaaggactctggctcagtagcacctttgcatcagtttggaccttcgggagggcggtgcagaaggactctggctcaatagtggctttgcatcggtttggaccttccggagggtggtacacgcctggggtagtctcagtgcaggactctggctcaatagcacctttgcattggtttggaccttcgggagggcagtacatgtctggggtagtctcaatgcaggactctggctcagtagcgcctttgcattggtttggaccttcgggagggcggtgcatgcctggggtagtctcagtgcacgactctggctcagtagcgcctttgcatcgttttggacctttgggagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcgggatccagggaacatttgggttttcccagctacacctggaaacttggcgggcatatgggaatgagattctaccactctggaagattcatgcccacaggtttcattgcagtttgctgatggtccgcaagcctgaaattagcgtgtggaacagacccctttggtagcagtctagtgccagctcagacctacgaagaattaaaaatctgcaaacttccactatttcaatgtttaagggaaataaatgcagcatttttgcatttctgacattttacttaaaacaaacaaacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcacccaggctggagtgcagtggcgcaatctcagctcactgcaagctctgcctcccaggttcacgccattctcccgtctcagcctcccgagtagctgggactacaggcgcccgccaccacgcccagctaattttttgtatttttagtagagacggggtttcactgtgttagcgaggatggtctcgatctcctgacctcatgatccacccgcctcagcttcccaaagtgctgggattacaggcgtgagccaccgcgcctggccaaataattttttaagttgtagaaaaatgttgaaagtcattagtaaaagttttttgtttttttgagacggagtctaactgtgttgcccaggctggagtgcagtggctcagtctctgctcactgcaacctctatctcccaagttcaagcgattctgctgcttcagcctcccaagtagctgggactacaggtgcctgccaccacgcccagctaattttctttatttttggtagagacagggtttcaccatgttggccaggctggtcttgaactgctggcctcaagtgatccacctgcctcagcctcctaaagtgctgggattatagatgtgagccactgcgtctggcctcagggtgatttttaccttattctttttatactttgctccaaacattttgcaatggatatgcttttcttttctttttttgagacagagtctcactctgtcgccaggctggagtgcagtggcatgatcttggctcattgcaacctctgccccctgggttcaagcaatcctcctgcttcagcctcccaagtacctgggactacaggtgcacgccgccacacccggctaatttttggtatttttaatagagatggggtttcaccatgttggccaggatggtctcgatctcgtgatccgcccacctcagcctcccaaagtgttgcgattacaggcgtgagccaccgcgcccagcccaggcattgccgttctaaggaaaagatcataattaaaaatacaagatgtcagtgttggtttgaaggctacctagtgtggttcccctgaggcactctactccctaaggaatggccctgctgaccagaataacatgttgggaagaattttcttggtgctggtaagaatgttccaggcggcaagaggcagggcatcaaagggagcagctgggaggcccctgccctgtccaggcctgagggcaaggcctcatccatggacagatggagagtcggcctcttccccaggttctgctcttccccatcctggatctagtgctggggagaagactccagaagaccaggcagggccacatggtcaccccagggccctgtggctctgttggtctgtagcctaggttagggttaaggcaggcaggcttgagattaaaaaggtagaaggaaaatgcctagctagcaagctctctgcttttccggaacattctctagctctgttgaaaagtttgagacactctttttacccaaaggtgactgcagcaacctacatgttagcctcacctgaccctgcaccaagggagccaggctctgggcttccatttgcccttctggttgggttccaagccttctctgggcctcccttttttttttttttgagacagagtctcgttctgtcacccaggctggagtgcagtggcatgatctcggctcactgcaacctctgcctcctggattcaagcaattctgcctcagcctcttccccagtagctgggactacaggcacccaccaccacgcccagctaatttttgtatttctagtagagacaaggtttcactgtgttggccaagctggtctcaagctcctgacctcatggtccacctgcctcggcctcccaaagcgttgggattacaggcgtgagccaccgcgcctggcccctttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctacctgggaggcaggtacccagagagtaagattgctcacctgggcgtgcctgggcacgtgtgagcacatcacatttcttttgtcttctgttggaagggatttcttttcttttctttttcttttttcttttttttttctttttgagacggagtctcactctgtcgcccagggtggagggcagtggcgatatcttgactcactgcaagctctgcctcccaagttcaagtgattctcctgtctcagcctcctgagtagctgggattacaggtgcccgccattatgcccagctaatttttgcatttttgtagagatggggtttcaccattttggccaggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggcatgttccaccatacctcgctaagtttttgtatttttggtagagacggggtctcactatgttccctaggctggtctggaactcctgacctcgtgatccgcccgcttcggcctcccaaagtgctgggatgacaggcgtgagccaccgcgcctggcctcactgtgactttttggtgtcctaatgggtatcaagtggtatctcattgtggctttgatttgaatttcactatgattaatgatgttgagcatctttccatatgcttattggccatttgtatatcttctttggagaaatgtctattcagatcctttgcccatttaaaaaattggttatttcaaaaaatagctgggcgtggtggcacatacctgcaatgggaggtgccgctcgggaggctgaggtgggagaatggcatgaacccaggagacagaggttggagtgggccgagatcgcaccactgcactccagcctgggagacagagcgagactccatctaaaaaaaaaaattggttatttatctttttattattgagatgtaggggttctttatatgttctattttttgttttttgaataactgttgggcactatgtttatatattctagatgcaagctcttgatctgtgatttgtaagaagtttctcccattctgtgcattcttttcactttcttgaactcctgccctcaagtaatcccgctgccccagccttccaaagtgctgggatgacaggcacgagccaccactcccagcctgttttcactttcttttttttttgagatggagtctcgcactcttgcccaggctagagtgcagtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctcccaaagtgcggggatgacaggtgtgagccaccgcgcccggctctcttttcactttcttgatgccatcctttgaagcacagaggttttaaattttgctgacatcccttactcatttttaaaagtgggcaaaacaggcagcagtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccgggcgtgatggctgatgcctgtaatcccagcactttgggaggccaagatagatggatcgcttgaggtcaggagttcaagaccagcctggcagcatggtgaaaccctatctctactaacaatacaaaaattagccgggcatggtggtgcacacctgtggtcccagccacacaggacgctgaggcaggagactcgcttgaacttgggaggtggaggttgcagagagccaagattgcatgtcagtgcattccagcctgggtgacagagcgataccctgcctccaaaaaaaaaaccactagctggggcatggtggcgtgggcctgttgtcccagtgacttgggagctggggggggaagatcacttgagccaagttggaggctgcagtgagctatgattgcattactgcactcccacctgggcaaccgaatgagaccctgtctctctctctctttttttttttttgacacagagtctcgctctgtcccccaggctggagtgcagtggcgcagtgtcggctcactgcaagctccgcctcccgggttcaagccattttcctgcctcagcctcccaagtagctgggattataggcgcctgcccccgcttccggctcctttttgtttttttcgtagagacagggtttcgccatgtttgccaggctgatctccgaattccctgacctcaggtgatctgccccccttgtctctctctcttttttttaactttaaaaagatacagaggcagggtttcgccatgttgtccaggctggtcttaaactctgaggtcaaaggcagcactctgggattgcaggcgtgagccactgcgtccagcagatcctgtctcttaaaacaagaaaaaaaggccgggtgcggtggctcacgcctgtaatcccagcactttgggaggccaaggcgggcggatcacgaagtcaggagatggagaccatcctggctaacgtggtgaaaccccgtctctactgaaaatacaaaaaaattagccgggtgtggtggcgggcgcctatagtcccagctacacgggaggctgaggcaggagaatggcgtgaacctgggaggcggagcttgcagtgagccgagatcgcgccactgcactccagcccggccgatagagcgagactccgtctcaaaaaaaaaaaaaagaaagaaagaaagaaaaagattcaagacaaatggggagtggtggggagggtggaggggacatagattaagtccccataagcagcctgaatttaatgaaataggttggcatggctatccagagggcagcccccaaggccagggacgctgggtgtggacaggaaaggtttgctacacacagtgtgatgtctcttgaggttagagaacctgtgcctctttgggaggatgtagtttgccctaggcctggatttcggtagaatgagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccgaacatcctgtgggaagataatcccctgcttgtactgagaaattcagaagcaggaggccgggcgcggtggctcacgcctgtagtcccagcactttgggaggccgaggcgggcggatcacttgagatcagcctggccaacatggtgaaaccccgtctctactaaaaatacaaaaattagccaggcatggtggcgggcatctctaatctcgcgacttgggaggctgaggcaggagaatcacttgaaccagggaggcggaggttgcaacgagccgagctcacaccactgcgctccagcctggggaacaagagcaaaaccccatctcaaaacaaagaaaagaaattcagaagcaggaatcctgggccagcttcatcctcagaccgaagagaactgtagaattctgattgacatcttccaaaaacctaccctctccaaaccaaaagcagtttttgctgacatctggtctttctggaatgctgatatttttatttataaaatgatgctattatccccaaatagattcttatttttaacaggctttctccctttgagggctgcctgaggctcataactttgttctctggcatctcagtgttaccctgaaaagacaagaaggctcctgggctctgccaggagcagagagatagggagggttgccagccggaaagtcagacaactgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactgaggtttctctgcttcttatctctcagctgcccaacatgttcggcgaccttcggtccacgtttattgccttgatgattgggtcctacgcctcctcggcagtcacctttccaggaatcaaggtgagcacgtgtattttgcactggtgtctgtgcagaggcctgctccaggctccttccaccctctctgaagagggaggcaattgtgggcacccggggtggcccctctccaccacccccacccgggcaggatgcacctgggcatcacaggggcgacaaatgaaaaccgcggggcctcaggggacgggaatcacgcatktggctgcaggatctgccgcaggtgcctttgcatttcrgggctggggcaggggaagggcggtgggtgagtctgtttccagttgtgagtcttgcccccgtctcctccgtcatcctggtctcccgctgctcccctgctccccaacccccagcctgctgttattgtaccgttactccccgccagccaaagcactgctcttggccaagtgtttcagctgtttccctcctaggcaggattttgagcctgtggaagtcacacagggtcaggacgaagcaaacacctcacagtccatcagcccaagttccccagaccctgtgggtctgccagggccccgtaggggcttctccracctctgaccctcacactaagtaaaagcccctttcctcggtggtgtgtgtgggaatgctgttggcgaggagagggggwcacggtgtgggctggccacctgggcatcgaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctcccaggttcaagtgattctcctgcctcagcctcccaaggagctaggattacaggtgcccgccaccatgcccggctaatttttgtatttttagtagagatggggtttcaccatgttggtcaggctggcctggaactcctgacctcatgatccgcccactttggcctcccaaagtgctgggattacaggcgtgagccaccatgcctggcttccttgagcatttctttggcctctgccatgtgagctctcagaggcactggggaagcatcagtggacggggctggccggttcccgccttcagggagctccgctaataccagacaagccgacggaccaggagcaccgtcccctctgctgggccgatcactatgagcctgcaagacgtgccgtggtcatggcggggcggtcaggaaggcctccgagtcggggggctaatcacacgccaggcccagatgaccagcagggcaggcacggtgggaggactggaaggcgggtgcctgatgccccaacgcccaggctggcagggctgtgcctctttgcgcggctcagcacagggacagcaggggtggccagacgcccctgcctgctgcggctctggcctccccgggctaactctgcccccyccccyccccaccccgtccccgcggtgcctgtcagctcatctatgatgctggtgtctccttcatcgtcgtcctcgtggtctgggccggctgctccgggctggttttcctcaactgcttctttaactggccccttgagcccttcccggggccggaggacatggactactcgtaagtagaggtgcccccgtcccgcctgcccccagcccccgccccccagccggggtcccgggcagcacccacagacactctcccggggccccagggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgctgcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcytgggggagggaaagggatttgcctgatttcacccaagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacaggtaggtgccccgggcagcctcggtcgctgtcactccccggcctgagcccagcccactggccaccgsccrgaatgtgttaagctgagccgggccagcsgggccatggaaaggccgcatcccaggmgctgtctgcccgtcagagctattgcatcactgccagccccaactgtttcttcgtgtccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcacggtgggtgcgtggacaccctgggcatcgaggtcaggacggggctggagacgctggggcaactggcccacactgggatctgcatccctcaccgagaaacagggcagggcagagacttcctcggagcttgcgaacagttgaggcttgtcagctccaacaaacacagctgataacccacagtccacttttccaaacagggcaggtcttcagctgattagaggttttgattctacagagaaagtcaggacttccccggggcctgagctgagtcagccttagtcatccccaggcgggacaaacactccaaatcctttttattggcagcctccctggtgtgccactttttccgatggtttccttgtttttatcaaggtgaagataccctaggacttgtgaagaatcagttatcaggtttttaggggatgagaaatccagctttatcaaaaggaaaagatagcaaagggaaccagataacagccagttctactgtgaaaatggtagtctaggccaggcacggtggctcacgcctgtaatcctagcccttttggaggctgaggcaggtggatcatgaggtcaggagttcaagaccagcctggccaagattgtgaaacccccatctctactaaaaatacaaaaaattagccaggcgtggtggtgggcccctgtaatccctgctacttggaaggctgaagcagagaattgcttgaacccaggaggtggaggttgcagtgagccgagattgcgccactgcactccagcctgggcgacagagtgcgactccatctcaaaagaaaaaaaaatatctgtggaacacactttggggaaccctaatctatcatgtctctttctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctgggctcaagrgatcctcccctcttggcctcccaaagtgctgggattacaggcgtaaacctccacacccagcctgataaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccaggccaggaaggttggtctgtggcagacgaggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcgaccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtcttgctctgccacccaggctggagtgcagtggtgcaactgatagctcaccacggcctccgactcctgagctcaagggatcctcccacctcggcctcctaagtatctgggactacaggtgtgtgccaccatgcctggctaatttgttttttttttttttccataaagacaaggtcttgctatttttcccaggctggtctcaaactcctgggctcaagcagttctcccacctcagcctcccaaagtgctgagattataggcatgagccacaatgcccagccaaaaatacagtcttttttttttgacatggattttcgctcttgtcacccgggctggagcacagtggcatgagctcggctcactgcaacctccgcctctcgggttcaagcgattgttctgcctcagcctcccaagtagctggggttacaggcacctgccaccatgcccagctaatttttgtatttttagtagagacggagtttcaccatgtctccaactcctgacttcaagtgatccacgtgcctcagcctcccaaagtgctgagattacaggcgtgagccacgatgcccagccaaaaagccagtcttgagatggggaagacgtggcccatgctgtcctcagcagtgcccagtcccagccaaagtgggcactgctgcctcactctcccacccaccctcagggtgtggcacttactgggaagaagcaggcattgagaaacagaattgaggaggggaaacagtccagggccaacagtgcttggggattgaggcctgaaaatgggagcagggtacagaggctgtggctggccagatgggtcgggtgccccctgcacccccaccccctagtcaggggccacctgtcctaccctccctttgtaagagttgacaggtgacatgttttcctattgttgtccttgacttgataacaatctaggagttaaatagatactatcatctgtttacgtcatcatttatgatagatactatcatcatatacacctgaaaaacgaggcctggagykatggaggagcttgttcaaggtcagagccagcactcacatatgggtcttaagacactggagcagccaagggcctctagaccaggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcgtcaggggcaggttctttgacctttccctctctctgagcacagcaggaggtagatgtgacagagccgcttcccgcaggcagtgtggtgacagggaccctgattgcaccaggtcttccgcatgcccgccacttccccatcacgctacccgccaacgtcacaggcctgattcaccagtccgcctgtgacccggcaccagcagacaggagaatgtcagcaggggcccgggctgggcattgtcccaagtccacttccagaggcctggctgcagctctgcctcccctgagcgccccgagtcacgcttggtgggaaatgcagtgcgggaaacgcagtgcgggaaacgcagtgtgggaaatgcagtgcgtgctgggcatggagtgagcctgcctcctctcccatctctctgtagcactgagatttctgccactaacctctcttctttctgctttttcacttttgctttcttgatgcagtgatggccacgggtaagcggggggtgggggggattgtcagggaatgctgtgatgtcccctcccagccagtctctgttcaacccagaagctcctcacctcaagctccagacatgcctcctggctagagccgtgggggtaaaactggggcaatcaacattcctcgtctgcttccctggaaaatccactgtcattttaagtctttgaatatggaagccctgacatcagagccccgtgagcggtgcctttctgggatatttcttttttttttgagatggagtcttgctctgttgcccagggtggagtgcagaggcatgatcttggctcactgcaaccttcacctcccgggttcaagtgattctccttgtagcctcctgagtagctggggttacaggtgcctgccaccacgcccagctagtttttgtatttttagtagagacggggtttcactgtgttggtcagtctggtctcgaactcctgacctcgtgatccgcccacctcgggctcccaaagtgctgggattacaggcatgagccaccgcgcccagccgttctgggctatttctagagrcagaaactaacggcccgtcrcttagcctccgtcacaggagttcccaagttatagcgacttcctggagctctgggaaggccattgtgacactctgggtttcattagctgtttcttagaaacaagcaggggatttggaaccgagaagaaggtgacctgccccgtgctccatcctcaacttcagagttaaggtctccgggctcctcgcaagacccatagtgacagggggttctggggcagaccccagaagagcctgtggggaccagccccttcccagctggtgcccagtccctgctccagggctgtctgccaggcgtccccatgacgcagcgccttcctccacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggcagggccggtgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagaccagcctgggaaacatggccagcccccactccccgtctctacaaaaaatttaaaaattggccagggagggtggttcatgcctataataccaacactttggaaggttgaggtgagtgaattgcttgagcccaggagttagtgaccagcctggccaatgtggtaaaacccggtctctactaaaaatacaaaaaattagccaggtgcggtggcggcgcgcgcctgtaatcccagctactcaggaggctgaggcgcgagaattgcttgaacccgggaggtggaggttgcagtgagccgagatcacgccattgcacttccagcctgggcaacagagcaagactgtctcaaaaagaaaaaacaataaagaagaagcattgagtaagaaggaagaaaaagagacacaggtgaaagtgtacagacaatggctagcagaccattttgctcctaagaccaccctccctccaccccttggcagtggctacaccatcttaaagcctcccaaagtactgggattaacaggtatgaggcaccgcgcccggctcagatggtgactttcattcattgcattcaatcatgcagcccaccaaccctttgttatctgcctgcaaggtttattccggtcagtttgagtagtaagttgctataaccatattatgtgttaatagagttgttcatgattgtgaagattaaacaaggtactggagtcctactttatgtaagggatgggctccaagatcagaggatgagttaaacgctgttttcttttttctttttctttttttttttttgagacggagtctcgctctgtcgcccaggctggagtgcagtggctctatctcggctcactgcaacctccgcctcccgggttcacaccattctcctgcctcaggctcccaagtagctgggactacaggcgcccgccaccacgcccggctaattttttttaatatatatttttagtagagacaggggtttcacagtgttagacaagatggtcttgatctcctgatcttgtgatccgcttgcctcggcctcccagagtgctgggattacaggcataagccaccacgcccagccaaacgctgttttccatggctccacaccttaatataataagctacggtttattgcctgaggccctccaccgaggactccatgcacagtatctcagtgaagactcccagcaccctggcgaagtggggaccagtgttatacccattttacagatgagggagctgaggctgggacttgcagtagtttgcctagggccgcacagttaggaagtggtgggcctgggactccctgcacatctgtgagcacctggggtccgttcttggatcatccagggtgtctgcgtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggcyaacayggtgaaaccctgtctctacaaaaacgcaaaaattagccgggtaaggtggcgcgtgcctgtagtcccagctactcgggaggctgaggcaggagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagttccatctgctgcctgctcatttcccctttaccctctcctgtccccacaaggggaaacccattcactcccctatttggcttgtatctggcttcttatcagcgtcctgcaagatttgggtgaacttgaagccagtggtgaagtgaggctttgccatgtgccagctcaggcacacgctgctacttctctccccgtcgtcttagctcagccttcacagagcactgcagcatatggatggccatcttcttgtasccgagaccccctccgagagtcacactcagcttgccactgagaagggccggggagtgtccgtagtgctggtccagccccgacacagtccctaaaacgtgcctgggtggcttctgagtcttgcgtcagtttacctgctgcgacgcttgaggcctgacttctcaggagcacccggcttcctccggggagccctcccacccctgcacgttctgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgattctcctgcctcagcctcccgagtagctgggattacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcasatgatgactttcattcattccactcaaccgagcagcccaccagccctttgttatttgcggagggcctgttccctgccaggctctgtgcttgctgctgcaggtgagctggacacctggattgtcttctgcaaagggactcctccccggaaggcatgtcttggttttgggggcgtcttgcataaccgtggataccaccatcatgccatttcccggaagtgtgtggggtcgctgtagagttccttgttttgtatcggctcaagcagctggaatctgacgtccaaagagatctggccaatctgtggtgttggtgggagcatctgctcccctgtcaccagagtctcacggggtttctacactgaacagagtggaggaagaccttgatggtggcttcatatctggattcaaaagcttcattccaggccggtggctcatgcctgtaatctcaacactttggtaggtggaggcaggtggattgcttgagctcaggagtttgagaccagcctgggcgacttggtgaaaccctgtctctacagaaaatataaaagttagctgggcatggtggcacactcctgtaatcccagctactcgggaggctgaggcaggagaatcatttgaacctgggaggcggaggttgcagtgaactgagatcgcgccactgcactccagcctggatgacagagtgagactctgtctcagaaaaaaaaaccaaaaaaaaccaaaacactttgggaggctgaggcaggtggatcacgaggtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagtgaggctgtgtctcaaaaaaaaaaaaaaaaactgaatttctttgccaaacttttgaggcttctggaacctgatttttgacagagattttgagtaaggtggcccttgtcacctgcctggctccacccactggtctgtgaaagtggtctagcagtaggttttggcccaatccctaaatttacaaatggtggagggacgcaagtgtggcttttccttccagagaggtgtagcctgagtccagatggcatcttgggtcaagtccaggagggaagtaagagtccctccctttttacaggaggccttgaggtacgttgaacacccaggtgtgccccaccgtgggaactgttgtgtgtacgtgccaacactgggcgtgcagagcgcagcgggccgtggaacatttgtgccggccccagggggtgctgcatccctccggccctccctggcctcctgggctgctttctctgcaagactggcagacctttgccctaaccgccttgtccagtcgaggggcagtgctcagtggggacagtcatctttttgttttatgtaggtctcactgaaagaaaagttgtaaaaaggcaacaaggcatttgaggtggggaggcctgcacagcktsygtgtgtgtgtgtgtgtgtgtgtgtgtgtgtgtgggcactgggcacagccctctttcaacactgccaagagcagcccctgcccccccaccacccacattcctgggaacaggtcctggctgctgagcgggatggcagggctgtgtacagaagacaaggcgaccacagggacctggtggccaagaggatggctcttaaaaagtgcctctcagagttggcggagtccgccagcagcagccttcctgggcagggggcctcccacagacagcgacagaactttactaggaccagcctgggcaatatggcgacaccctgtctctactaaaaataaaaattagccaggtgttgtggagtgcacctgtagtcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacaccactgcactccagcctggggtgtagagcgagaccgtcccaaaacaaaaccaaacaaaacagaacaaaccacaaaaagaaaacaaaacaaaaagcgaagaaacacttcacgagggaggtgagagggcagccacctgctgggagggccgggtgaccaggcttgggagaccctggagcacagtccgaggtgggcaaaggcagctcgaggccgtggtcagcaacctcttgctcagtgctgtgcccatacacgtctgtcagcagggccctggttctagtgtttgccgacttccacggtgcacrtgcactcaccgtggctgatttccagctgccyatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaaaaatacaaaaattagccgggcttggtggcatgcacctgtaatcccagctactagggaggctgaggcaggagaattgcttgaatccaggaggcggagcttgcagtgagccgtgccactgcattccagcctgggctacacagcaagactctgtctccaaaaaaaaaaaaaggaaagcctgatgcgtgcacaggctctagtgaaccaagtaaaataattaggaagggatgaggttttccatggttttgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgctatctcggctcaccgcaacctccgcctccccggttcaagcgattctcctgcctcaccctcctgagtagctgggaatacaggcgcccgccaccacacccggctaatttttgtatttttagtaaagatggggtttcactgtgttggccaggctgatctcaaactcctgacctcatatgatccacccacctcagcctcccaaagtgctgggactacaggtgtgagccaccattctcggcttataatttaattattattattattwttwttttttttttgagacagagtctcactttgtcaccaggctggagtgcaatgccgtgatctcagctcactgcaacctccacctcttggttcaagcgattctcctgcctcaacttcccaagcagctgagattacaggtgcccaccaccacgcccagctaattttttgtatttttagtaaagacagggtttcgccatgttggccaggctggtttcgaactcctgacctcaggtgatccacctcctcggcctcccaaagcactgggattacgggcgtgagccaccttgcccagcctataatttaatttttaataatgactcggttaggctgggcgcagtggctcatgcctgtaatcccatcattttgggaggctgaggcgggtggatcacaacgtcatgagtttgagaccagccgggccaacatggtgaaaccccatctctgcttaaaaaatacaaaaattagccgggcatggtggcgtgggcctgtaatcctagctactccgaaggctgaggcaggagaattgcttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactccaggctgacactgcccctggggtgagggcccccargaattggagggcgggggctgaggggacggtcccytaaggccttatgcccacagtcgccttttcctcccccagatcctctccttcatcctgcacacaatcgtgcgaggattcatccactccgctgtcgggggcctgtacgctgccgtgtaagtcctggaagccgcaggtggcctggtgggcgagggtgtgggaatggccggggggaggttgctggtgggactgagactctgaggcagggtcagcctgtcccagaagggctcatcttcctgcttcaggggacaggtaccagggtttctgctgggtgtttcagggaaaggccatacctcgtgggaagcaggtcagtgggcagacagttgggtgctcacaagccttggcattcaacacgaagtcagttcccccagccagggtcaggcacctgtgcagctcattatggcctcaggggccactacagccgagtcctggggctggccctggctgctcactgggaaggatgggtaggttctggctgcctgaagctaaatgcggaagttccagttgccctcatcacgggcagcaacatgggtgactgagtccagaatacaccagacgggcccatccagagcctcagtgcgcccagctctggccatagctttctccagccctggctaaaatgaaacctgtatctttttccaagaagccccagaaacataaaaggaaccacagtggttccttcttctctggctcaggccttgacccaaaaactgaaactcaaacatcatcatccacagtctctgatgtgggaccagctcatgtgttgctgggattcctttcccacctctgggccagcagagcctgacatgtgctaagatttagcccggaactctctcccaattcccgcaacagcccctggggtaatcccagctccgcttgccctccgcctgcccctccccaggcctggaggaagctgtggctgtcctggcagggtctgagggaggggggcgggatctgtggtgctgagtttccgcgattactcaatgcttctctggacgagggcactgcagagccaagcccagcctccacactcctctctgggcctgtttcccaaaccgcaggtccccgctggcaccacgctttccactcggctcagccagacacccacaggccctgggcacagctgagtggggtgggccctccccagagtctggggcctggagctggtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcctcacgggactgcagtctctgatcagcgcgctcttcgcccttctgcagcagccgctgtttctggccatgatgggtcctctccagggagaccctctgtgggtaagaggggtcgggggatggtgggtcatgggcgcctgcccccttctgctaactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcactttgagaggccgaggcgggagcatcacttgaggtcaggagttcaagaccagcctggccaacatggtgaaaccaggtctctactaaaaatacaaaaattagccaggtgtggtggcaggtgcctgtaatcccagatactcgggaggctgagacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccagaggttcagatcagcccgtgtttcctgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccrtacctgcctgaggacaaaggcttgcactgtctcgccygcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccagctactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcgggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggtttcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtgaagcttgcagtgagccgagattgtgccactgcactccagcctgggcgacagagcaagactccgtctcaaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgactgcgagcggcttcctccttggctcctgtgtctctttctccctagatcacacatttctcgcctcttgtctggtgcccaggttccctgtcccttgactgggatgcgttcctgacccccacccctgccaggctgcatttgctggttgatctgcattgccatttgaaggagtgtgggagggcagagcaacaggccttttgggtgggaagaccaaggctgctggtgaattctgcttataaaggaagccccctcggatcacctgaagtcaggagttcgagactagcctgaccaacatggtgaaaccctgtctcttctaaaaatacaaaaagtagccaggcgtggtggcgagcatttccagcactttgggaggccgaggcgggcagatcacgaggtcaggagatcgagaccatcctggctaacatggtgaaaccctgtctctactaaaactacaaaaaatgtccaggtgcggtggctcacgcctgtaatcccagcactttggaaggccgaggcgggcagatcacgagctcaggagatcaagacaatcctggctaacacggtgaaaccccgtctctactaaaaatacaaaaaagtagccgggcgtggtgacgggtgcctgtactcccagctactcgggaggctgaggcaggagaatggcgtgaacccgggaggcggagcttgcagtgagcggagattataccactgcgctccagcctgggcaacagagcgagactccgtctcaaaaaaaaaaaaagaaaagaaagaaaaaaacattctttgaaggctggcgcatgctctgccttggtccccactctacccccagtgcctagaatcgtgcctggcatggaatagctgctcaataaatatttgggggacgaagtttaaaaagagagagagacagaaataccacagaaaagaagctaaaatagactaagaggctgggagaagagcagagcggaagatggaaacagtgaaatacagtctccccaggacacccagagatgggttacagggctggctataaccgacgcagtaccaagggtcaaccacccaggggaaaccatgctgagaactggaaccgtgagatccacagacacaatgatgaaagagtggccgggtgccgtggctcatgcctgtaatcctggcactttgggaggc

SEQ ID NO: 12565 - DNA, 16082 bp, Homo sapiens
tcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtcccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccctttcccgcttctctgcccrtcaccctgctgtgcttggctctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctccggcctggtttcctcaggaaaagccctgagaggaagcagggagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgataccaggagtcagggtttctcctgtgacgcacccccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagt

SEQ ID NO: 12566 - DNA, 26462 bp, Homo sapiens
aacctctgcctcctgggttcaagcgattctctgcctcagcctcctgagtaactgggattataggcacatgccaccatgctcagctaattttttgtatttttagtagagatggggtttcgctatgttggtcaggctggtctcgaactcctgacctcaagcaatccacctgccttggcctcccgaagtgctgggattataggcatgagccaccgcgcccagccaaatttctcaattttaaactaacactgcaaaagagttatatttatgattggcaaaataattcaacatgagtacagtgtcagattgataattgaaataattttagcaatattattgtcaagcactgttgactagggcagactgcaggcctgttttcgggggagtggatctgagcatcctcaggtttgaaaaacactgctaaagactgcaattatctaatgaaagtgaaaaggttagagtagtgggagatgttacatgtctctgagagtcagaggcccagttatcctacttgttccccgatcttttgcacatctggacatcactggaagccctagaacctaccacagagggagcaacgttgccaggagaagtggcagctgatgtacccttggtcattgctttccaacttcaggagataggcctcatcaggcttctccgccgggagatagcagcagttttccaggacaaccgaatgatagccgtctgccagaatgtggctctgagtgcagaggacaagcttcttatgcgacaccagctgcggaaacacaagatcctgatgaaggtcttccccaaccaggtagggagcaggccccttggcatgggttgcccatcttccccccacccccaccagactcagacctcaccatctgctccccagtgatgatacttcttactcctcctctccatgagtcaccctctaatctggtgtctaacctatgattaggggctgagaagacccttgggttgcaccctcagcctaatgtggcccatgacccacgaggtagctcttcctcccacttgtccccgataagccatttttccctgctgttcccaggtcctgaagcccttcctggaggattccaagtaccaaaatctgctgcccctttttgtggggcacaacatgctgctggtcagtgaagagcccaaggtcaaggagatggtacggatcttaaggactgtgccattcctgccgctgctaggtgagcaagcacccctgccagttaggggtggggtgaagaggggcctgctgccatctgctaggcttgtcttggtaaaaccgtgaacgttcttggagagagcatcctttcacggatggagcctgagtaaacagcacatttattgagggccgactgtcactcccacacctgtgttgtctcactaccccaggtcacttctgcactggagggaagactaggaaaggcagacatggagcagggagagaaaatttagataccttgagtctaacagtggggtagtaggtgctgaaaccctcacagatgaagatatttaatacaagtagcccaagtaaagggtgccgagggccagtgaccagtgtttcccagactcccctgatgctgactcacttaaggggcagagaatactgcacatgtccttggaaatccagatttcacaggtctctgtagggagggggcgggacaggaatctgattttttttttttttttttttgagatggagtctcactctatcacctaggctggagtgcggtggcacagtctcagctcactgcaacctctgtctcctgggttcaagcaattctcctgcctcagcctcctgagtagctgggattacaggcacctgccaccacgcccagctaattttttttttttcgtatttttagtagagatggggtttcaccgtgttggccaggctggtcttgaactcctgacctcaggtgatccgccacctcagcctcccaaagtgctggggttacaggcatgagccaccgctcctggtgaatctgtgattttaataccccctcaacactccatgatatttattcaattttttaattgtaaaatacacacaaaatttaccatcttaaccattttaaatgtacagttccgtgttaagtacattcataatgctatgcaacatcaccaccatccatctccagaacgttttgtcttctaacagtgaaactctacacccattaaacaatagttccccgttacttccctccattccatgattcagggtctcactcccattgcccaggctggagtgcagtggtccggtcatggctcacagcagcctggacctccttggcttaatccatcctcccaccttaacttcctaagtagctgggactacaggcgcatgccaccatgtccagctaatttttgtattttttgtatttgtattcaccatgttgcccaggcttgtcttgaactgctagtttcaagcaattatgccaccttggcctcctgaagtgttgggattacaggcgttttccactgcacccagcctgattctttgtttttttgagacggagtttcgcagttgttgcccaggctggagtgcaatggcgtgatctcagctcactgcaacctccgcctcccaggtttaagcgattctcttgcctcagcctcccaagtagctgggattacaggtgcttgccaccatgcctggctaatttttgtatttttagtagaaacggggtttcaccatgttggccaggttgatctcaaactcctgacctcaggtgatccaccgaccttggtctcccaaagtgctgggattacaggcttgagccaccgtacccaacctcatcctgattcttttttttttttttttttttgagacgaagttttgctcttgtcacccaggctggagtgcaatggcacgatctcagcttactgtaacctctacctcccgggttcaaacgattctcctgcctcagcctcccgagtggcttggattacaggcgctcgccaccatgcctggctaatttttgtatttttagtagagacggggtttctccatgttggccaggctggtcttgaactcctgacctcaggtgatctgcctgcctcagcctcccaaagtgctgggattacaggcatgagccaccacacctggctgcctgattcttatttacaaggaagtttaggaaacactgacttaataggggtcagggccaggtggatatattaagagttttctgagggaagagtgaagaagtagggatcgatcccaagcagagtgggtgtggtgtggggcacagtggaacccaggtcctggggaaggcaggattttgagaagggcaatggagagcaagttactagggtcagaatattgttttcagagaagaaaggcaatctgcaaggagcctaactgaccctgtgttcttccaggtggctgcattgatgacaccatcctcagcaggcagggctttatcaactactccaagctccccagcctgcccctggtgcagggggagcttgtaggaggcctcacctgcctcacagcccagacccactccctgctccagcaccagcccctccagctgaccaccctgttggaccagtacatcagagagcaacgcgagaaggattctgtcatgtcggccaatgggaagccagatcctgacactgttccggactcgtagccagcctgtttagccagccctgcgcataaatacactctgcgttattggctgtgctctcctcaatgggacatgtggaagaacttggggtcggggagtgtgtttgtcacttggttttcactagtaatgatattgtcaggtatagggccacttggagatgcagaggattccatttcagatgtcagtcaccggcttcgtccttagttttcccaacttgggacgtgataggagcaaagtctctccattctccaggtccaaggcagagatcctgaaaagatagggctattgtcccctgcctccttggtcactgcctcttgctgcacgggctcctgagcccacccccttggggcacaacctgccactgccacagtagctcaaccaagcagttgtgctgagaatggcacctggtgagagcctgctgtgtgccaggctttgtgctgagtgctgtacatgtattagttcctttactgctgaccacattgtacccatttcacagagaaggagcagagaaattaagtggcttgctcaaggtcatgcagttagtaagtggcagaacagggacttgaaccaagccctctgctctgaagaccgcgtcctgaatttcttcactagagcttcctcatcaggttacccagaagtgggtcccatccaccatccaggtgtgcttggatgttagttctccaccctcgaggtgtacgctgtgaaaagtttgggagcactgctttataataaaatgaaatatattctacttcctttattttgtggtttacacggttgtcctccctctaaacttactctcaggggcttctctgtcatctgactttcctcactcttgcttcccttcctaggaaaatcctcttcccctatacctgttcccacaaatggcatcccgcgcatgcttgccctattaaaggcagctgacagctgtacccactagctaacgtgtctctggtggttctggacaaaaggcctgcgggaaaactaggattctctattaatggggaattctgagagctctagggtaggaggcctcatgcaagtcttcatgaaccagaaattcctaataaaggagacgggatgcttaactcagagtccaccatcatccttgactggagcacattctgggtggatgcaggggtgacccggggaaggtggctgttcaacattccttctcggacttgaagcaatgccaccgcttccttagtcttggacaggcactgtctggcagggatgacctgcagcagctcttttgtggcctgggccaggaccagcttcccccagtgcctcatcctgtgctgtatgcccagggatgttcaatcactgggaagtggcttaaaaggcccttgaggctcctggatgccagagcttgtctggtcagtgctgcccagtgctcctgtccctcccagaaccctgccaggtgctaacaacaccctcctcctggggtggctggagcagcactgaggctctgaataaaggcaagacagtgggtgttcccgagagatatgtgagaccctgaaacgtaaaccaagctcggtgaggatgaagtggaagggataagtggcccatgtcacttttggggtcagagaagaaacttgaatcacatccttcacctgaggccccacctacttctttccagaaaacttagctgcgcttgaaactgtaggtctatgccacattcatttgaatgaattttagatctttgttaagagccgatttttcattagaattgagcagctgggcacagtactccagcagaagggtaaagggaagggaggggaccagcattgcagcccttttaacggcagctgtgactgccccaggcctgctcctgatcagagactgcaggctgtggggtgtcttcatacacacaagcactttcagatctccatggggcctgacctagtggggcatcaccccagtgaagggcctcagtgtggggactgctggctgtccctttcctggcttgactgcccctgctgactgtgctcttggcactctcttatggtcccagagggggcatctgtccctccaccatcaacctgatacttttgctggctccaaattttgcagtctattttcagatgtaaaatgagaggcggggggcgggggttaattaggaattggccttgggtactaacagggtcactgccatgctagtctgaataaatcctttatcaccactggcgtacagccaacagttccccagtcctctgatctatctggaaccatgcccagcagggactgtgcccccactcccaagccacatcgatgctagggcagtctgctcagccctgagtcctccggggagcaggggggcagagctgagcggctgcccggagcttggcgggaggaggggacaggggagagggaggtggggagatccggctagaggggaggctctgacatctccttccttcctggttcctgcagcagctgctgccactgctcagcgcggtgaggagggagccggtgactcggagacrgtgactcagagrcagagcggcgcaagggccaagragtactggcgtccatggaccctggggtaagggggctgcgtggcagcagctgacattcctgagaagagcttcctcccacctgaagctggtgggtctgctcctgaatagaggtggagagggggcacccacctggctcacctagacccttcacctgcctaccgatagagcctccccctctacccacaagcagtgaggggccaggatccccacagggccgggagaagggcccagagatacctgaacaccggaagagtttgagaactttcaatggctgaatgcaggagtttcctcccaggtcagcctcttgcagcaagggtccctctgccccaacctcctgggcacccgttcctgccacatccctgtcccctctgggcctcagttcctcaggtgcttgctagctccattagaagatctgggctgcttcccccacctcaaaccagcctcgcccctccagtcccctcccccrtctcacacatgcagagcctcatgcattattgatctcccggtggagccaggatggccagggccagtgccaagggtgcctgtgggcactgctgcaggacctgtgcagacctgggcatgtcctgggccccctcttctctcatgaagtatctcctttagcccaatgtcctgccctctctgggtgggtggcacttctcagagccccaaggactgtgagggtagacaggggatggtgaggctttakggggtactgagggtccaaaaagggcatcctaggggcatgtttggtgggaggagacatgggaaaatgggggctatctcaggcctcagtttctccaagcactagataatatggagattaattggtgggaggctggggagttttctgcaagatcatggcagagaagtctctgagctacggtggcagggtggaggggtcctgaaggcagaggcagctggattgaggaggtctcgcttgtccagtctctgaacccctctgtctcttcttggagcctcttctgtcactcccttgcttcacctctgagcactcccagggaagcctctaaagaaagcactgaatgtttcttggagccccagagtatgtgcccaaggcggggctgggcatatgtcttgtggttttccctgggcacctgcccgtctgctgtgtgctagttcactctcagggcagtgtccatatcaggtgaaaatgggtggggtcgggacagaggggcagacttgggagaggcttggcaggtgagcagagggtatgttggggagcccttatctcagagggtgtgggaggggctggaggtggggaaggtgatagcagagtttgcgttaagggggtctttctcttgcttcaaggaccccgtcaggagcaggtgacatccttccccttccaccctgctccctgctctacatccccagcagggagtggcctctcccttctccatggacttccaagagagggacccgcccttcctgcctgagagcgctcagtcctcaaagcccagcagtgctcagcaggtcagagagtgggaaagcggtggtgggtgggccaagctkgaaccagacagggaggggccaaggcggacgtctcaccagtgctcccctccctctgtcctggactgcaggcctctgagctgtgggaggtggtggaggagcctcgggtcaggctggggacagagggtgtcatgcctgagaggcaggaaggtcacctgctcaagaagaggaagtggcctctgaagggctggcacaaggtagggtgggcaggcaaagggagggtccagacatggggggcggggtgggaatggggggcagctgctgggcagtccaatggtgtttgcatgatgagaaggaaaagaaaagctaatttgtgtggttgccttctccctcatgcccttcctctcggcctcccgggtcctgtcactcctgggcaacatcacagagatactttgtgctcgaggacgggatccttcattatgcaacaacccggcaagacgtgagcccgggcagtggcttggggttgtgggaggagtctggccccagtatgccctgggcaggcatggggtatctggaatcgaccagagcagggtctgaatcccaggtccaccacttgctgaatgtgtgatctcgggcaagttacatccctgggccatagcttcctcacctctaatgggagagcaccatcccccaggtgcagagctgtcatggtaagggaggtcatacgtacaaggctctctggacagggcagaataagtgcccaagaaatgggggctttaccaccctcatcctggtcccattctcaggctgggaacaaggaactgaaggcctgggtacccaggatctctctgggagggtgttgccttccacaaccctgcagacccctgagggtgggaatagtttttcttgatctgtgacttcttagagaccaagatgtgacttgacgtaggggagcgytctgcacatgggaggatgattgacaagtctctactgatagtgtgacttggacatgagggtgaacctgccacctggcccttgagcctagaatggcatcagggagatggtggctctatggctctgagagcctaaaacaggtcccctctccctctaccaacrcttcacccccagatcaccaaggggaagctccatggctccatcgatgtccggctgtcggtcatgtccatcaacaaaaaggcccagcgcattgaccttgacactgaagacaacatctaccacctcaaggtgacatccctgggaggcaggaygtgtgttggcccccaacctgacagaggcattggaacacacaggggcaggggctgagggtctgtggaactcagggtctgtctctgagtttgacaaraagtaagtttccatcctgtaaaaacagccaagggcaaacctgcacttcttggttgttgtatggacaggcacagagctaagggctcagacacctgggcgccttgcgctctgtctccctgcaagtgagccttgcacaaaccaggctctgtaagaagagaccctgcttgtctggggaccagagccctgacttcttgctcttggaaagtggtccctctcttcagatagccctccccctctccatcacttctgcagatcaaatcccaggacctattccagagctgggtggcgcagctgcgtgcccaccgcctagcccaccgcctggacatrccccgtggctcactgcccagtaytgctcaccggaaggtaaggtggaccctggggtgggggcaggtaatgtggcaattcaggggcrrgggctatggagaactgtgagacccagggaggtgggcatcatccttcctgaccctgggctcaccccacaggttcctggtgcccagctyccaacagmagctactgcctcagccctacctgggcttggaccgygggagaaagtgtcttcctggctgagggacagtgatgggytggaccgctgctctcatggtgaggggccctaggcrcagcacctccaagggtaggscccaagctggcaggtctaggaggggawaatgttacctccatccctgcctcagggagccccagtttaatgagacagcctctgcctccaaggagatccagtctacctgggccctgtctaggggagtcccagtcttacagaggagtaagagtctgcctgggcacatagacagacgtggatgcagggacaggagttgtgacaaagcagatactgagtgcccacacagggcaggggcctgaggagtagcrccagggaaggggtgtgctctaggaaagggttcctgcagtagggtctgtgaagttggcctggagggagaagtgtaaaccaagtagagagagagagagggtgagcacatccccagtctgctcaaaggcagcaaaggtgaggcatggtctagagacagagcagaaattaggcttcagaccctcccaggaaaccagggggcaccacaccaacaggggtagcgacctgagctcttgaacagggaacagggagcagtatcgggatctccatgaagtcagtgttgggagagtcatgtccttgaggctgggttcggtggctcatgcctgtaatcccagcacttttggaaaccaaggtgggcagatcacctgaggtcaggagttcgaggccagcctgaccaacatagtggaaccccatctctactaaaaatacaacaaattagccaggcatggtggtgcgcacctgtaatcctarctactcgggaggctgaggcaggagaatcacttgaacctgggaggcagaggttgcagtgagccgagatcacgccattccactctagcctgggcaacaagagcaaaactccrtctcaaaaaaaaaatgaatggtgttcttgttcttgttctttytccccgcagagctctctgagtgtcaggggaagctccaggaactacacaggctcctccagagcctggagtccctgcaccgaatcccctcagcccctgttatccccacacaccaggtaagatccaggggtacacacagggtcctgctcaggcccccgatcccatcacttccccaggatgggtcctattcctcctacatcgctgcagtttcctggagagccatgcatcgcctggtttcctccccaccccttacccatgtccaaactgtatcaagattgtctctgttcctccatgcccatgcctctgccagggtggctgtcatcttccactgggatgtcagttgtctctgtcgccctgcctgagcggccgcatcctctgtgctgggtaatctgcgccctcctccatggcgcaggaggccgtctacctctcccaggctgtgatggtttctgccccttttccccaccctgtgagtaaaattgcccccaccttgacttgccaggcctcagtgacaaccgaaagacccaagaaggggaaacggacaagccgcatgtggtgcacccagagctttgccaaggatgacaccattggacgggtgaggtcgggcatgcacctcacgtagctggggcaggatgctctaaggaggccggccccttcagcccttccccttcacctacaggttggtcgtctccatggctctgttcccaacctgtctcgctacctggagtctcgggactcctcgggcacccgtgggctgccacccacagactatgcccacctgcagcgcagcttctgggccctggcccagaagggtaagtgcctgctgggaggggctggtggggagcggacaggagcgagcgaggactctgatggtctgcyccactccctgtagtgcacagctccctcagcagcgtcctggccgccctcaccatggaacgggaccaactgagggacatgcaccagggctcagagttgtcaagaatgggggtgaggcctgggggacagggtgactggtgcggggagagggcttcaagctgaggactgccagcctggggtcygatagcagatctgggtcagggtggggggttggcagaggcagtctctgcagagatgcggcaaggtggggaggacctcatcctcctggcaccgtgtccctcaccctctccctgcaggtctctgaggcctccactggccagaggcgcctccactcactgtccacctcctccgacaccacggcggactctttcagctccctcaaccctgaggaggtgaggagccagggtgggctgtgggggccgattctcctgtgccttctctcccagcgaaagccaaggcccagggcagtgggcaaagttggtttttagtcccaaagacagcccaaaaatcctggctccattgtctttcccataaggtaagcggcagccccatctcgatcattgtgtaacaacgtgcagggtacttttacttttaattcggggtcctctgatgcagtgattctcaccctcagcataacaaaactgaggctcaaaggatctaatgggtgggctcaggctcctgcaattatagacgggctgaactgagactcgggctctgagcacagacgctggggctacgttccacgggttcaaatctggctctcctgcctgccggctttgtgatcctgagcctcagcattccaatctgcaaagtgggggtgataattgcacctacctcacagggtaggtgtcaggattgaatgggttagtgcacacagagggcttggagtggggctcagggtcagtgccaggaagtgtaaacagttataatggagcctgcgtcccctcactcccaggccagggctcattttactatgcctttgtcccgctctcactcctctctgcckcttctgctcagaaggtgtctgactcagcaaaagtgcccggttatgcctccctctcaagggaactgtcaggcaagcrggtgccctgcttgatccccccggcttggccccggagcctgacatccatctggctgctcccacagcaagaagctctgtacatgaaggggcgcgagctcaccccccagctatcgcagaccagcatcctgtcccttgctgattcccacacggagttcttcgatgcctgcgaggttctcctctccgccagctcttctgagaatgaggtgagggaggagagaagctggcagtgaggcggggtrggggggaccttgggaacagaagggtggggtccacagagaccatagattcctcagccccttctcaccacctcagctgctatctctgggactatgtccagatcagctgagtttgtgtggcccagctcagaaatctctgctagggactcttctcctagaggagtgtgacatttgtatccccattgggttctcctgaaactactgccatagttgcaaccccggtcatcttcctatgaccctgtctcagcttcagcactcccttgattccctcttccaaaaccctgaccctcagtaatccccaacttcccttccctctgtgtcccatcaagtccctgagctttttcccgccagccacagggcccggccctccccttcccaaggtggctgggcacactccgtgatgccaggcatcccggggcaatgtcttagggctcagagtgcccccaatacattctcttccccttcccaccaaagggctagttgggcagattcttgccaggccctgggcactgcccagctgcccgggggaggcccagtctgcccggcctgtcatctgtcctggcccagggctcagaggaggaggagtcctgtaccagtgaaatcaccaccagcctgtctgaggagatgctggacctcaggggagctgagcgctgtcagaaaggtgccagctgggtgggcaggcagggaggggtgggaggcgggtggaaaaacagggtttgtccatggcccaggcccatgcaaaggccatcccttgtggtgactgatgggctagtggctttggatgctgaccccaggagctaaggaaggccaggtcatgaactgggaaatgttccaggagcagctctgcyggggtgggccaggctcaggccttggggctggcctctgttgcagcaggcttgcctagggccttggagggaggcaagagatcccactttgctgcttgttagcagtgtggctctggacctctcattttacttctgagagcctatttcctcatccataaaatgggctggataatctgcaccctgacctctgtttctgtgtttataaagggaacaaaaggcaagggtgaggactcgggaggggctcctggggtgcagggtttctggcagtgggaactgtctgcccctttgcatggctcccacccctgccagccaactgagtccctgggaacttgtcagcagttagagccccagtcaccctgccctgctgtgagtcgagacaagggctcaggggcgaatgtcccaggggcttgggaggcagctgggccctggactgggctgtgggcttgccatgtctgggatgcctggtgcccagatggagagtgacatggcagggcggccccaggggggtgtgttccagggagacccatggggccaccccgccgtcgctgcctgccggcggccagcgggcctggggctgacgtgagcctgtggaacattctgcgcaacaacatcggcaaagacctgtccaaggtgtcaatgcctgtgcagctcaacgagccgctcaacactctgcagcggctctgcgaggagctggagtacagcagcctcctggaccaggccagccgcatcgccgacccctgcgagcgcatggtacctgcttcctgtcctcacgcccagcccaaggctgcttccttctccctgggaycttttctcccagaaaatcctggctgggctgttccttattgctgaagttccaccccaagatcccatactttgcttgcttggggtggcggccccgtcctcagtaccctgcaccttccttgccccccacaggtgtacatcgcagcctttgctgtctcggcctactcctccacataccaccgagccggctgcaarcccttcaaccctgtcctgggggagacctacgagtgtgagcggcctgaccgaggcttccgcttcatcagtgagcaggtatggccttgggagaagagggctggccttgggtgtctggggcaaggagggacctgggctttgggaccagaactggggcagagggaccagggcctgggagaggagcgtgggcagttggctctgtgccgggctctgcggtgctcctggcccacgttctgaggtccagccattggatcccaggagttccacctgggggctcacgctttagggggcaatcttgggctaggatgaactgaaggatgaattggagagagctgggagtacaggggctggggagaatgggatgttccttctagatggtgtagaggaatgcatggagcaggcttgggaaggttagagatggggctggaagacaaggtgggccagatgctgaggagccctgccagtgaagggaaagaggccttgggcttttgtatgtgtgtttttaaatcctgaaggcattggcaccatggaggatttgaggcagtggagtggctgctgagaatcacagtgtgcaaagcacacccgggtggtgtgtgcctggttggcggaggccgacagggtgcatcctgtcatctctgtagagctaatgagtccctgcacttaggctgtggtgtgtttggttcaagagctgtttatgtgctgccccggacaggggctggtcctcagcagcgtactctcccgtgtaggggatggggaggcttttgttgagagggagaagtctgggcggcctggtctggggaattcagtgggtgcatggtggtgccagttagtgaggtggacaatgtgtgtgggaacacactatgtgggctygacttccacaggagatggccaggaggctctggagtcgctggcctggagctcctccaagagcaccaggtggcactaacaggtcaaagagtggccagcttagagggaggaggacatcaagggaggactgccctcgggaggactgctcgcagtgtctagggaggagggcaggcaggagcgctgggggccccgaaggggaggggtcgcgggtccctgggacctgaggggtgtcatcggcttcctgcgtgaggaaggttcccgagacaggatggggacagagactggattacagagggtgtagagtgtaggttttatgaaaaaatagagaaaaaagcagactattttccaaaaattttaccatgagggacagaggagagagaagtggcagttggtgggggataaaggtcgaggcagtttgtgtgtttgtttgtttgtttggatttgaagtgtttttggaaacatggtgaagattgacacagtacactcgtgcgtayaacagaaaataagcctccctcccatcccaacactccgaagggactactgctaccagcttttgggattcctcccagaaatgttttacgcatatgtgaacaaygaagtgtgtgtctagaagagaaagatttactattttttaaggtggaagaaacagacaatctttatattcagagagaaagagaaataaagagggaaagactgaaggtgcagaaggaggaggagtgggcagcctggggggcatcagtgggagcaggctgactgcygccagacagaaggaatcgcccccctgacccacttctgttctgccacagactgtgggaggcgaatgaggttcgaagggcctggcttgtgcctgggtcctcagaggaggattggtgagggatgtcaaggccccagatacaggacattgtagatttagcagtttcttagtgtgggtcgtgtctgtgttttggcaacagagtcagagccagggatgcacagaggaggccggtgctggcatttctggcaagtgggggaggtggctgagggtattagctgagagtgctgtgaagggcaggatggggctggcagaccatgggagggcagtgcagtcggggacctggtcatcttggctggagctgtgggcgacagggaacggagagagaggcaaggcaggcaggctgtgggatgttggaattgaaggctccagatgtggagccattccaagtgggaacaaggccaagtgtttccaagggtgtggggtggaggttgcagggcgatgrtcagctttggggtggggtggggggagatggtggggaagagggtcatcagcaagggctgggtttcaggcagggcatggggtggaggccccacccatcactgttgcggggaacttttcaggcttgagcaggggttctggaggacgccatagacagggccagccaggggagcttctgaggaagagcgagtgagaagggagaacataggggcctcatgggaagaagggaggatgatgggtttaggaggtggccaagggtgatagggacaggaaacctggaaccaactggtcttgtggtacttaggggaactaggggtgggaataagggactttgggktascctaatggtgctcggggacagcctcaagataacttctttgctcaccaaggtctcccaccacccccctatctcggcctgccatgcagagtctgagaacttcgccttctggcaaggtgaggagtagagggcagggccggggtggccctgggcaaagggaacaccctctggccttatctctgttgttcactctccctcccctaatccaattccagatatgaagtggaagaacaagttctggggcaaatccctggagattgtgcctgtgggaacagtcaacgtcagcctgcccaggtgggattmttagactctcagcagccaggccaagccacaggcaatccttcaggctggagggggcgtggccttagggacaggataaggacgggataggaaggtctggcctgaagctgcttgcagtggcgtcagtgtctgtaggttttacacctatatttacagcagttgccaatagagaaagatgaaaagccttggaacgtagtagagctggaagggcccatcgaggtcatctgactcagcggttttcacacttttttgaccatgactcacagtctcacagtcagaaatgcctttgagacttcaagccaatgtgtacacatacacacacacagaaacctaaattgatctcaggactcaggggtcacagacaaaatttgaaaaactctcatctagctaattttacaggcagaggtctgaagccagaaagaaaaagggtattgaaagtggtctgggtgttgtggtagagatcctggattttggagtcagaagccatgagttctgccactcaatagtgatgcaaattagcaccagcctgtagtcccagctactggggaggctgaggcaggagaattgcttcaacctgggaggcggaggtagtggtgagctgagattgcaccactgcactgcactccagcctgcctgggcaacagagcaagactctgtctcaaaaaaaaaaaaaaaagaaaagaaaagaaaagaaaagaaaatagtgatgcaagcagcaaaaagacttgacacttcagagccttgagcctgcttgcctgtgacatgacagtaagaagtaatacccaagagaggtgaggattaagcaggataayggatgtgaacgtacacacggttcctggtgcccaggggcaggacactttgtgtattttcatccctgttgctcaggcactcaggggctttgtagatgagtggagatgttttcgttgaatacgttctgtgaaggccactcttccttgtgaatataagtcatccttcactgcagaactggagttgggaccccagggttcctgtcacaggcccacatgacctgcttcagcaagacaggaggcccctgactcacttgttccctggggccagccagctgcccttccataccttgtctttctcaggtttggggaccactttgagtggaacaaggtgacatcctgcattcacaatgtcctgagtggtcagcgctggatcgagcactatggggaggtgctcatccgaaacacacaggacagctcctgccactgcaagatcaccttctgcaaggtgtgtgtgccaccctgaccctgcccatccatccccggcagcctctgtctctggaggtcaccctggctaagggggaggggacacctccctaaaccctgccttccccaccccaggccaagtactggagttccaatgtccacgaggtgcagggcgctgtgctcagtcggagtggccgtgtcctccaccgactctttgggaagtggcacgaggggctgtaccggggacccacgccaggtggccagtgcatctggaaacccagtaagtggaggggtcacagagggctgggtgaggctggagcagctcaggcatggtgcacctgccccagccccttgccttcccccagactcaatgccccccgaccatgagcgaaacttcggcttcacccagtttgccttggagctgaatgagctgacagcagagctgaaacggtcgctgccttccaccgacacgagactccggccagaccagaggtcagtgccggatgggtgccggcctagaaccatctagttcactccctccacagagtacagagctggggctttgtccttccttcactgagtggcctcagagaagtggggcttgtytagaggacagagttgggcagagacagaggccttgggtttgggggcccctgcagatgggcagttcccctgagtttgatctggatcctcaggtacctggaggaggggaacatacaggccgctgaggcccagaagagaaggatcgagcagctgcagcgagacaggcgcaaagtcatggaggaaaacaacatcgtacaccaggctcgcttcttcaggtgcctcggcctcgccctccgccctgggtctccccatgagccctgcttggagcagggcaggtgtgggaggcagcaccttaggaccctagcctgccttctagatgttcacccctcactgccaccgccttctcccaccaggcggcagacrgatagcagcgggaaagagtggtgggtgaccaacaatacctactggaggctgcgggccgagccaggctatgggaacatggatggggccgtgctctggtagccctggccccgggggcaggaggctctggttcctcactcctcctgcctccaccccctaccatggacacatgggtgaggccgggctccccgcctcactgcccttgagaccaaaggggcagccctggccctccctcccctctgctggccagagggtctgcatctcagcccacccccaaccccaccgtttggggtgagaagcagaatctgtgcttccccagtctccttgccccagacaaccagcatgtaagacccttcccgcttcaccattccgattcctgtcccctttggggtacttgggggagactctggctcccaggatctgttccctatttcagtgccttcctaggacacaggggactccttgacgctccccaggctttctgtgcccaggcctctgtccccagcggtgaggttgcagtgagtgaaggagaggaggtgatctgttctccctccccttctgcccatctccagcatcttcttccccttccctggccctgcagggccttctccagctccctttggttagtccctggccatccctcctgtcctggatcccttctccctaactgcaaaatgcctgcagcttccagctccttcgtccctgatcctcaagcggttccctcccgtctcagctcagcggatcccccagagtggaggaggcctctccatgrggaggggagcagcycaaggcacctgtcctctgacccaccggcagcgagtgcgcaggtgtgagtgtaagttcatgtaggagagtgtatgcgtgtgcgcctgtgccctgcttgcaggcaagcagggctccctcatgtagcccsgccttccccctgctgggggtccaccacatcgctgctctttctcacagtctgcctctgatgagggcgaattgctatgacattccaagctccaataaagactgtcccagactttggcctgtgaccattcattgaaaaacatgtgggctcatggtcagtggaaagccctctgccactgtcatgggtaaaatgaattgtgtccccaagaaacgtttctagcccccaggcatgtgcatgtgaccttagttgcaaatagtgtctttgcagagacaagttaaaatgaggtcgcattggatttgggtggccctactccagtgactggtctccttataagtagagagaaatttgggcacgcagacgtacgcaagggaagacaagtgtgtgaaacagacacacgggagtcggccacgtggagacgtaggcagagatgggagcgatgcatctgaaagccaaaagtgccaaggctgctggcaaccacccgaagcttggagagaaacagagagattctcccactgagcctcaagaaggagccaaccctgctcacacctggcctcagctatgagagaatacatttctgttgttttaagtcacccaatatgtggtgcattgttacagcaacctcaggaattgaatacagccaccactaacctgagccaaaagcccagaggccatctgccctcccgcttgatgccctgtcacttctaccccaggtgtctctctgcactggccccttctctccattgcactggctaggctgggccctcatcaacacttgtctggactattgtggtggcctccagggtggtatttcttcttcttcttctttttttttttttttttgagacagagttttactcttgttgcccaggctggcgtgcaatggcgcgatctcagctcaccgcaactatgcctccccggcccaagcagtccttctgcctcagctcctgagcagctgggattacaggcatgcatgccaccatgcttggctaattttgtatttttagtagagacgaggtttctccatgttggtcaggctggtctcaaactcccgacctcaggtgatctgcccgcctaagcctcccaaatggctgggattacaggcatgagccaccgcgcctggcttccagggcggtatttcaagagaaaatgtgacacctcatgtctgcttaaaatacatcccctgcttcccagtgcctagaggaaaatccaaactcttcaaccggtagaaaaaccacatggcccctggccccctgtctggcacagagtgctggcccccacactcagcaccctaagtcaggtctgtgctagtactccactttgaccccccaggatcaatgagtgttcaagggcggaagggagggaggaagaacaggaccagctgcctttcctccccgctgccctcgcccctggggccagctctgattctgaagctgtgtgatcttggtcaggttgccttccccttctgtttagaggcttcagtctctcatttggctccttttgtgtcttaaagaagaacatctgtgaggtgacccaggctcctcatttcattcgttctctcttaacccctctcccccactcccaccccaccacctgcagcaacagcgaccccagtcctgctctggtccgatgagtgtcccaagaggaagtcatgctttctttgggggggtggcagagtggcaggaacagaggggacccctgagctacgacagcccttcgcattgtcatctttttcttcctcctcatcccctgcggaggagcagtggtccacatttccagtttatttacagagaatgtcaaagttaaaatgaacacacttgtcctgtcaccacatgccagaaataacctcaacccattccaaaaaaagccaaggccctcacacattcaggatatttttaaatagcatgtgctgccctgctccgggccctttcccctcagagcaccacagcacctgaccgaccagcccgtaacaaactgccacgtattttaagaaccagagtttaggctgggcacggtggctcacacctgtaatcccagcactttgggaggcagaggcgggtggatcacgaggtcaggagttcaagaccagcctggccaagatggtgaaaccccatctctactaaaaatacaaaaattacccaggtgtggtggtgcacacctgtaatcctagctactcgggaggctgagataggagaattgcttgaacccaggaggcagaggttgcagtgagtcgagatcgtgccagtgcattccagcctgggcaacacagtgaaactccatctagaaaaaaaaaaaaaaaaaaaaaaagagagaaccagagtttaaaagagaccaaattcccaagttattttttcagaggagacaaaaaaaaaaaaaaaactcaaaactcctctgcctctgtggctgtgccctctagaccagcatcctcccccaagtcctttcccaggcacagcccaggtgccacctcaacagctggaagtggtgggtaaggttgtttttgcttcttctggggcccagcagatgagggggcagtcccatctgaaggactgtggtctcagaaatgttccccatctggccagggctttgtgggtcaccgctgatgggagctcaggccaggctgaggggagcctggggttctggccccagtctgtgctccatggacagagtgtgaggggcccacaccagccaggggttcagggagcggtgccagctcctggctgccaagaatcccagggtggggtgctcaagtcactgatctgagaagggaatggtgggcccccttctcaagcctgtcagcctagtccagatgtcccacaggagtactcattaccactgggtcgtggggagccaagcacagacccagatctcctgccttggttggaggacatggtgggcttgggacaaaggggagaatttgggggcttaatggcccttgactaggcttggagtgcagtagtttggagaaccagggatccgcttccctggatgagcaaaggaggatggagcttggacagcaagggaaatggtcaggccaagcaatgctggcagagggagaggaaggtaggcaggaggtgtctcagtcctcattttgcctctttggaccctccacccccaaactgctccacccagagggatttaagtaactttaaaaaattttattaatcattattgaatagctgatagggacacctaggttggaaggagcaaaaaaaaaaaagtcaaatataaataaaacccccaattccttgcatcttctgaataaagtgtgtgtgtgtgtgtctgtgtgtttgtgtgtgtgtgtgtaataaacagagaagggaaagagtgctgaaccaggtgagaggcccaggcattcacattccctccatgaggtcaaagtggaggggtgttcagggcaggaggaggctgctgggccagcactgtgactcccagcttcacctggatggcatgcagcccagggggatgtgtgcaggggagtcccaccctccctgtttcggggaaaatgaaggtagtggggacagtggtggggtaacccccagcccctgaccaacacctgctgagaatgcagagatcttacgtccgacctcaattccaccggctccagtctgcccctggaatggtgcacagctctcctattctacgctgccctggtctagtcccagttctgacacaggcattttaaagatcctggattacattgcccggccatatccaatccctttagggaatgctcaagggaccttgccattgggtcattagtttaatggtgtctccttactgcaaaggacacgttttataagtgatttccccttttagagaccctctagtactagcaggggtagaaaaggaggagaggcttagcactctccccctgggacccatctctgttccccttaaggtggtcagggagggcagtgtaggacttcagagagacattcacaggctggcctgggccaggtctcgctcatccaatgacctatttctggtacagacacttaaccagatcacctggccttatgtggtggaccagggactggtcttcctgattcttgccacacataccctcatcttctcctcatctgtaccttaagaggcattaccatcagaggggaacactgagagttatcaagatcccgacaggccagagtcaggtctgcatgggactcaggcaggtggttccaggggctgggagagcatggctccacggttgggggttctagagcactactcgtgtctctctctctcttcttttagagacagggtctaacccaggctggagtgcagtggcacgatcatagctcactgcaaccttgaatacctgggcttcagcaatctttccgcctcagcctcccaattagctaggactacaggcgcacattaccacatctggctagttttttttgtttgtttatttaatttttagtagagatagggtctcactatgttgccaagtctggtctcaaactcctgggatcaagcaactttccagcgttggcctcctaaagtgctgggattacaggcgtgagccaccttgcagggcccacgtctcattaacacatgtcatcacatggtgcaaagtcttcaggttgctgaaagatgcctccaggccctaaggtatgtggaggggtggctttgatgagcaagtccaaaccatgggcactatggtccaggatgccaggcccctggggatgttgggccttgctgacccctaatatgagaggcccctcaaaatgaagcatctgtccagaggagggtaggtgggtgggctgggctctgggaggggtgtgggtgaagaagagattggaagggccggggcaggagcaggaagaagagagaaaagcctgagagtcagccacagtctgtctaggacgaaggtggtgagattctccaggcatcctcaagagggcaccccgggctcttgaaagaaccaatttagtctcatcccaagccccacctgacagctgacaggtggctgcaccaccatctgcgtggagtatcaggcctccaaggatgtggccctggctggacccagcccagcagtgatcaacagcagcagcagacactgttacagccgcattcctatggactgccggccatccctgcctgcccatcttcatcttcaaagagaatgcacaagtcaggaaacccctgttctgggagacccaggtgtccctagccactcccaaaagctgcccagatggtctgggggaaggaggtcaggccccctttgctggtgcctcttcacgtccaggtgacatccctcccaaggacagctggccaggacacccctcctccagagccctcataagatggtcttttccctaagtttccactagaacctctcctgcttctgtcaccccagagcccgtcacacactgggatgggaaaccctgcatttagttctgtaggctaacgttgggtgaagtgtgtgtgtgtgtgtgtgtgtgtatgtgtgtgtgtgtgtgtgtgcgcacacacatggtttgaaggagggagtgtccacggtgccctcctgggagggatgagaatgaggacaagaaggaagggagctattgagccagtgccagtttagcagagaagccttgggttctgtgggaagccatctgacctaggaccctgaggagggagggcgaaggtgggagatgcggaaggcaggtcacattggccttccctcccttctcctccatttagcaagatgttacaggcccaagagagacactctcctccaagctgggcctagtgggccgcagccctcacaggctggcacattcacctcccaccacctcccatgcagcctgggcggggaagagccctggaccaagagctaggaatcctgagttttggccctggctctgtcatttattcctttcacctcctgagcctcagtctcctcctttgtagcttggggatgatgctgctggccttaccccttcaccggtgtcttgtttgtcataggacagagaggactgagggttgttttagctgtggagcacaggacaagggtggcttcagatgacctgggccagggtcaccaccagctctgccactcccacacctgggggccttcccaaggcagcagcaattccccctgagagagacagaagcagagtttag

SEQ ID NO: 12567 - DNA, 17691 bp, Homo sapiens
tggagggaagtaacggggaactattgtttaatgggtgtagagtttcactgttagaagacaaaacgttctggagatggatggtggtgatgttgcatagcattatgaatgtacttaacacggaactgtacatttaaaatggttaagatggtaaattttgtgtgtattttacaattaaaaaattgaataaatatcatggagtgttgagggggtattaaaatcacagattcaccaggagcggtggctcatgcctgtaaccccagcactttgggaggctgaggtggcggatcacctgaggtcaggagttcaagaccagcctggccaacacggtgaaaccccatctctactaaaaatacgaaaaaaaaaaaattagctgggcgtggtggcaggtgcctgtaatcccagctactcaggaggctgaggcaggagaattgcttgaacccaggagacagaggttgcagtgagctgagactgtgccaccgcactccagcctaggtgatagagtgagactccatctcaaaaaaaaaaaaaaaaaaaatcagattcctgtcccgccccctccctacagagacctgtgaaatctggatttccaaggacatgtgcagtattctctgccccttaagtgagtcagcatcaggggagtctgggaaacactggtcactggccctcggcaccctttacttgggctacttgtattaaatatcttcatctgtgagggtttcagcacctactaccccactgttagactcaaggtatctaaattttctctccctgctccatgtctgcctttcctagtcttccctccagtgcagaagtgacctggggtagtgagacaacacaggtgtgggagtgacagtcggccctcaataaatgtgctgtttactcaggctccatccgtgaaaggatgctctctccaagaacgttcacggttttaccaagacaagcctagcagatggcagcaggcccctcttcaccccacccctaactggcaggggtgcttgctcacctagcagcggcaggaatggcacagtccttaagatccgtaccatctccttgaccttgggctcttcactgaccagcagcatgttgtgccccacaaaaaggggcagcagattttggtacttggaatcctccaggaagggcttcaggacctgggaacagcagggaaaaatggcttatcggggacaagtgggaggaagagctacctcgtgggtcatgggccacattaggctgagggtgcaacccaagggtcttctcagcccctaatcataggttagacaccagattagagggtgactcatggagaggaggagtaagaagtatcatcactggggagcagatggtgaggtctgagtctggtgggggtggggggaagatgggcaacccatgccaaggggcctgctccctacctggttggggaagaccttcatcaggatcttgtgtttccgcagctggtgtcgcataagaagcttgtcctctgcactcagagccacattctggcagacggctatcattcggttgtcctggaaaactgctgctatctcccggcggagaagcctgatgaggcctatctcctgaagttggaaagcaatgaccaagggtacatcagctgccacttctcctggcaacgttgctccctctgtggtaggttctagggcttccagtgatgtccagatgtgcaaaagatcggggaacaagtaggataactgggcctctgactctcagagacatgtaacatctcccactactctaaccttttcactttcattagataattgcagtctttagcagtgtttttcaaacctgaggatgctcagatccactcccccgaaaacaggcctgcagtctgccctagtcaacagtgcttgacaataatattgctaaaattatttcaattatcaatctgacactgtactcatgttgaattattttgccaatcataaatataactcttttgcagtgttagtttaaaattgagaaatttggctgggcgcggtggctcatgcctataatcccagcacttcgggaggccaaggcaggtggattgcttgaggtcaggagttcgagaccagcctgaccaacatagcgaaaccccatctctactaaaaatacaaaaaattagctgagcatggtggcatgtgcctataatcccagttactcaggaggctgaggcagagaatcgcttgaacccaggaggcagaggttgcgatgagccaagagtgtcccactgcacaccaacctgggtgacagagactctgtctcacaaaaaaaaaaaaaaaaaaaaaaaaaaaatggccaggcagggtggctcatgcctgcaatcccagcactttgggaggccgaggcaggcagatcacgaggtcaggagatcaagaccatcctggctaacatggtgacaccctgtctctactaaagatgcaaaaattagtcaggcatggtggtacatgcctgtaatcccagctactcaggaggctgaggcaggagaatcacttgaacctgggaggcagaggctgcagtgagccaagatcgcgccattgtactccagcttgggcaacaagagcgatactccatctcaaaaaaaaaaaaaaagattggagagatactctccccagccccacctgctagggtagctctcacacacacatttttggagacaagaaggaaattcaggaggcccacccaatccagagcccaaaagccaatacagaatcaagtgcggatttcatcttaaaatatctggatcaggcagtcaaactgaaataatgacgtgcatgacaatggctgagtgtcctacttcactatggccagagacaagattactttaatccaccatcccaccaccaagtgacatgtatccaaattcctccttacctcctgtggggggctgggaggagatggcaggcatgatgggtggatggctggtttcggggggatatattcagtcacagccatcagcttctgccgctgaaagtgcatcacacgacggtggcgggtaacagccttggagccatagcggacagtctggagggtaggcagccggcctgggagggcatatagcaacatggttagaggcaacctcctggaggccctagtttatcccaaatggagaaaaaacacaccctctagcagagaaaagcacagctcacagagctagactcaacacaagagtgggacaaggaattgtctgacaaaagtcctgaatttccaaagcttctctttcagtaagtgacccgaggtcaattacttaatctcttgaggctaccatttctctagctcttctcaatgtgcagaaatgtgagaaaaaaatgagaacaaaggagaaaatattttgaacacattaagaaaagtgggggctgagtgtggtggctgacacctgtaattccagcactttggtaggccgaagcgggcgagatcacttgaggtcaggagtttgagaccagcctggccaacacagtgaaaccccatctctactaaaaatacaaaaattagccaggtgtggtggtgtatacctgtaatcccagctacttgagaggctgaggcaggagaatcgcttgaacccgggaggtggaggttgcagtgagccgagatcatgccactgcactctagcctgggcacagagtaagactccgtctcagaaaaaaaaagaaggaaggaaggaaggaaggaaagagagagagagagagagaaagaaaaaggggataaggttaaataaactttttcttaaaatggtcaaacagtaaatattttaagtttggggcccatgtaatctgtctctaatgctcaactctgccaaaagcagccacagacaatatttaaagagacagcagaaactatgtaccaatagaattttataaaacacagtgactggccctgccataatacgccaacccctggtctaatctagtggctctcaaggtatgccccacctccaccccaaccagcaacatcagcatcatttgagagcttgttagaaattttgctgggtgtggtggctcacgcctgtaatcccaacactttgggaggccaaggtgggcagctcacttgaggtcaggaattcaagaccaacctggccaacatggtgaaaccccgtctctaactaaactacaaaaattagccaggcgtggtggcacacacctgtagtcccagctactcaggtggctgagccatgagaattgcttgaacccaagaggcagaggttgcagtgagccgagattgtgccattgcactccggcactccggcctgggtgacagagcaagactgtctcaaaaaaaaaaaaagaaagaaagaaagaaaaataaacataaattctcaggccctgcctagacctactgaatcagcaattctggggtggagcctagcaaatagtgttttttgtttgttttgttttgtagagaccaggtttcactatgttaccaagacgggtcacaaatagtgttctaacaagccctcctggtgatgctgacgcatgctaaagtttgaaaaccaccactctaaccgctgctctgacaccctgtcctatgatttgaagaggagaaaaaaatgttacaccattctcacagctctcagacaagtttctctttcctcctctcttcctgtttacagataatgctacagagcaccccacagaaaacaagggaggcactcaaaagccctgagacaaagtgaccacttaatcctcaacacaagggccaagactagaacttcccactttcagtcatttccaagactgggatgtgacctcagaaaaaggtccagatagaaggcggctctaacagtcagagagtatggatatttgctggggtaagaggtcttattgccagcagccacaaaacctaactgttaagactgcaggcaggctttggaatcaaattaaactggattttttttttttttgagatggagtctcgctctgttgcccaggctggagtgcagcaatgcgatctcggcccactgcaacctctgcctcctgggtgtaagcgattctcacgcctcagcctcctgagtagcggggactacaggcacgcgccaccacacccggctcatttttgtatttttagtagagttggggtttcgccatgttggccaagctggtctcaaattcttgacctcaggtgttccctccgcctcagcctcccaaagtgctgggattacaagcgtgagccaccgcgcccagccgaaactggattttaatctctcttccgccaattactagctgtgaccttggccacccaactggtctgaacttcagttgctgcgtctgtaaagaggagatgcgaatgtctttctcacagggtgctttagatttaaatgatttaaaagatttaaatgagctaacacatataaaaatagttatcacagtgcctggcctatattaagtgctcaaatccattcactaaacaaatatctaccgcacgcttactaacatccagcaccatgccacctgctggctatgctgaatgaacatggttctgcccttgcggagtttaatagaggaaacaagcaactaaacaaatgcaaaattacagattgcgacggggctaaggagtcaagggaagacctgaggtgacatttagactgacacattaagatggagacataatgcaaaggtctgggcgaggagtggtccaggcaaaagaaacgctggagacagacaacatctggacgttgttgctgtgattaccagtcgagtcacaaggaactggacggggtaaggaggccagcgatctagctggggtcagagattatgggaagaatcagtagtagaggagggcagatgaggactagagagcggccgcaagacacgccgtgaggacctgggccactccttacccgcctggggcaggagaccccctcgcagcatccccgccacggccgcagccatctccaccggaagaatggacggaagccgagtggagacggaaagagctaaggattgtggggtagcgaaccccggggccggaagcagtgggcgtacccgccggctgtagccgtaagacgcatgcgctaggccgggccaacggagcccgcctttacctccccactcggcgtccagtctcttagcaacgactccggcttcctaggaactgctcctttctcaaccattcctgcccacaacaccccagcttgctgccagcaaagcccctccacacccctcaaactccagacccttcacatcaatttactgttktcttcgacctcaccccagcaattttctctgaatcaaccccctttcctcctctcctaagtctctgagtttctctctcctcctgccatcctgagttctgccatccttaggggccgccaagacctctcttttcgttcctctcccgcctcagaccagcagccttttattttagatcatgtctggaggtgagtagggaggtgggacggtgggtagagcagttggaaaacagcggggtaaggcctccaagagtgaggaagtgtcacagttggactcatcttttcacagggaagtcagcccagggtccagaggaagggggcgtctgcatcactgaagcccttatcactaagcggaacttgactttccctgaagatggggaactgtcagagaagatgtgagtgcatgggggagaaaaggggtgctagaaggctgaaacactcaggatgaccaggtccctgacgtgtactgatttgtcaactgatctttgtttctctccttactccacacattcaatcagtggtaatgcccagctgattttcccttcttcaaaataattccatttctttttcaccatcctcactcaactgtcttagataaggccgtgttcacctctctcctacacacccaccactttgggaggctgaggcaggaggatcacttgagcccaggagtttgagaccagcctgggcaatagagacagaatcctatctctaaaaaataaaaataaactagctgagcatggtggtgcacacctgtagtcctaggtggctgagacaggaggatcacttgaacccaggtacctgtggctgcagtaagctatgatcatgccattgcatgccagcctgggcaacagggtgagaccctatttctaaaacaaacaaaaagtaaagtatttttaattacttttttagagatggggtcttgctctgttggccagactggtcttgaactcctcaaacaatcctcccacttcagcctcctgagtagccaaagtgatccttttaaataacaaatctaatcaggcattcactgatagaaacttcctcccaaataaatcccaatgcctaagcatgagttgacttctgcttttcagccttatttctggccactctccacaagtgtacaatttcccacactgtgtactcacaccttagtaccttactactcagagtatgtgtggatgggagggggtgcaggggtaggacagcagcattggcatcacagggggcttgttagaagtggagcatctcagcccctccacccgatctactgaattagaatctgcatgggcatattggagtttcggaagggctgtattagcatgtactattccttctgcttgaaatgccttctccccatatccccccaccttcatggctaatgcctactcatctgtcacctcctctaggaagcattccctgattcctcctactgtgaatttagtgcacagcctatgtactccctttgtcccctgtacttgcttctgttatccacttgtcagggatgtttggccttattctttctttctttctttcttcttcctcttcctccttctttcccttcttcctcctccttcttcctttcccctgtacttgcctctgttatccacttgtcatagatgtttggccttcttcctattttttttttttttttttgagacggagtctcactctgttgcgcaggctggagtgcaatggtgtgatctcggctcactgcaacgtctgcctcctgagttgaagcgattctccagcctcagcctcccgagtagctgggactacaggtgtgcgccaccacacccggctaattttttttgtatttttagtagagatggggtttcaccatgttagccaggctggtcttgaactcctgacctcargcaatccacccrcctcgacctcccaaagtgctgggattacagtgagccacctcgcccagcctcttttttttttttttttatgacatagggtcttgctctgtcacccaggctgaagtgcagtggcataatcatggcacactgcagcctcgacctcctgggctcgagcgatcctcctgcctcggcctcccaaagtgctgggagtacagggtaagccaccatggycagcctgccctgcttctttattagtggtgggcagagactctgtcatttgtctctagtaggcactcagcaatgttgtggaatgaatgaatgggtggatggaacaagtgcttttttctccatgaacgactcaaaaggaaggtgaggaaggatctttctgcagtgtctcatctctgtcccacccctgcctccaccatccaagctggccagaggaaggtttctcttgcctctgaatctctccagaaaccataagctgccatcccccaatttcccagagggcccttactcctctctctcacccttcccagtgctaacaatagagatacgagtctgcaagtcaagccggtttcatgatctagacaccacctcaagatgtcaagatgtttctcacatctgattaaaatgactcagccaactacccctccttgaaaccccttccctcctccgtctcccatcctccctgctaagagaccacatgagtggtgctctaacaccacccttactgactcttttcccaggtttcacactcttgatgaactgcagactgtccgcctggaccgggaggggattactactatcaggaacttagaaggcctccagaatcttcacagtctctatctgcaaggggtaacttctttctccacccttcccctccccttgacccctgtggacctaatctgtctcatctgaaaggagccaaccaggtcatcctgcccattccctggtgttcaggcaggcagaccttcatttaaaccattcccagacgaatgacatagggycctgaattgaaaaactaattccctcaaaatagatcctgaacatgacctgtgctccttccactgttctttaggcacttctcttgatctagaagttctttttggcatctactctaaatctttcacgttaaatagctccagcccatttcctgttttgaagaagaggaaactatgaagattcctgtacatcattcagatcctacttgaaggctgtttggtggtggtggtggtggttggttgatcttcagccttctcctggttgagtattcccagctcgcttcaactttccccatagaaactttaaccgtcaagttcctgtatgctcattgttctctctgtgtatgcaagccaccaccaaggccctttccgttttcctggtggcttcttagtttccttttctgattcccaggtcactctttggttgtggaatcagaagagtatacgtagtcaggtttagataccccaggtttacacccttaaccatccacatggggaaagaaaatcatctttcttaaggtagtggcaacctgttcaaggagtggggtgatcattcccaaagtgccagatctccagctgcagagtagacatggtcttggggctttgtccccgtaaagggcccctgacgcatctgatctcagcttggtttcyccacttcggtttcttcttgcagaataagatccagcaaattgagaacctggcttgcatcccctccttgcggtatgtggtgccagggctcaggcaggggaagagrggttgggggaacctagccatatcccaaagaactggttcagatttctccaagcctgggtccttgtcagtcaaggaccagcaagcctagatctactccctcaccccagaaggccatgtgtccccactggtcatcagctgcctagcccaggggccccggtgtcaggtgccctcctcttttcttccagctgttccatgattcagctctgcctctgtaccccttccttcccctacagcttcctgtctctggcaggaaaccaaatcaggcaggtggaaaacctcctcgacctcccatgcctccagtttctggacctttctgagaacctgatagaaacattgaagctgggtaggaacccactcgccctggctcaccaaacacatcccctgtggggcctgccctcccctctgcacccatctgcccatgcttctattagccatgcccctgcaggtccacatttcatcctcagggagttcaaggggttgtgcctagaggtactggctttggactagaaagtgggtatgagaaccccattcccatcgcttcatggtcttttggctaagatcaagtgagaaccccatttcctctctctttgctgtgtgcagatgagttcccccagagccttctcatcctcaacctgtctggaaacagctgcaccaaccaggatggctaccggtaaggagtggagggtgggaagaaaggtcatggctgagctctacctgctaactcagcccagacccctctcagcctgcaaacctggggtcctgtccatgacaccttctcccccacctcctacctagctcatgagccaccacccctccgggtgtgagtgctgtggtgcgtgtctttgcatcctccaygccagggtgccctcctgggtaacctctgctccttctgctctgcagcgagctggtgacagaagccctgccacttctcctggacctggacgggcagcctgtggtggagcgctggatttcggatgaggaggatgaagcctcaagcgatgaggagttcccagagctgagtggcccattctgctcagaacgaggtgacmctgctttccaaggttttcagcctccccagagcccacctctgccctgtgggacatgagggaagctaaggtggcagtggcrtccggggaggggagccccaagttcagatcaacatctgggccagagccaggtgtcagtcctgggccccagcctcaggctccttcccacaagrgacaaggggccagccagagacttccctgagcccagggaccctcctgctgagcccagggctccacccaccctgtaccctccacccccggcccctcccaggcttcctcaaggagctggagcaggagctgagcaggcacagggagcaccggcaacagacggccctgacagagcacctgctgaggatggagatgcagcccaccctcaccgacctgcccctgctacctggggtgcccatggctggggacagcagcccttctgccactcctgcgcaaggggaggagacagtccctgaggccgtctcctcaccccaggcctcctctcccaccaagaaaccatgcagtctgattcccaggggccaccaaagctctttctggggaaggaagggggcacgagcagccacagcccccaaggcctctgtggctgaggcccccagcacaaccaaaactacggccaagagaagcaagaaatgattctctgtcaacctttctctactagtggagaggagtggggcctgcccctcttctcagacctctgacctgtgacagaagcccatccccagtaaagtgtctctaggccctgagtatgcttttcatgtcacttggggtatctcaggggaagaaaccagtgaaagctccaggaaacaaaatacagagctcagtgagccacctgattctaaagagcgagtctggaatctttcgggagctacccacagggcaggcatgcctcaggcccccgctggcttcctggctcccacttgggcaggaagcgggcaccacctcatggaagaggcatgccatctcactgccacccctagcgagtgcccttccccggtccaagccaaggaccaaggagctgtggtcctagtcatccccaacagcagccagctcctgtcccctccctgtcctcctgcccagtccccatcactcacccactcataggaatgagtacacaaccacaggccccgcagccagcccacagctgcctttgggcctcacttggctctcccacccccactggtcctgggataaagttcactgaagagaaaataaagcacatttattaaggcaaaggccaagctggccgctcagaacatggccaaggagcgtgaagggattgctccactttaccaccactcagggcacccaggccccaggggtcctgggtccaccccaggccagcagaagctatgaagcttacgcataagcctggctctccctcttcacgaaggcctggaagaggctgcccagctcccagaggggtggggcccactcgccggccagcagcccctgtgtggcctcgaggccttcctgctccagatcctgctgtttctgctggagctgctgcccccgatcctgccccaagggaaagctgagatgagtctgtccgggacaggcttcccgccaggtgaaggggggactgtgtaccacctcacacaagcaggagaaaggagataccccccgacattccccaaaggcagttgctggctttgaagggaggaactcctctccccagctctgaaatctcttccactccctagttccttcatatttccagagtcccactgggagtgggggaggtctatcatcccctcaaggtagcccctactccctgggggatacctgatctctctccatcagccccagggctgcctggtgtccacggtagagggtatgccgacgatctacctgagtctggaatcggggcagggtccgaacagggtcttgtgctccaaaagtgggggacagcacctggggggcctgggccacccccaccccgaagatgaaaggtttgaacacagacctagaggggcacagatggaagcacggagatatatcagatcctctcttctccccagccttccccaccctcattcttcccacctggatgggtctggcgtggcggtaagaaagtgcacgcagggctgcgtgggatcctggggcaggacagacaccatgctggccgtggtgcgaaagcctcccgagtccatacagataccactctccttgtctctgaggatgcccatcatcacctctgccgtgatgccccctgccaaggagtagagggggaagctgtgggaggggagagtggctggcactgctgtggccctcctggcccccagccccctccaccgttcactaaccttgccgttgccgcagcagctcccgccctgcctggaagcgggccttggcagcctccatgcgcacaggctgctgggtcagggagaagatctgagcaaagtcaaaggcaccctgcccatcccaccagcccttggcctgggcatgagtccgcagctccgggtgttgggccgagatgtccgtgccaatgctcagctggttggagatgttgcgggccccctctgtggaggagatcggggagtggttcatttaccattgagcatctattctatgccaggcactgggcgaggtgctgagaacatggtggagaagagaactacctaccctcatggagcctacgttttggtgggggaggcagacaaaataatcacagagataaatgtaagcatgcaactgtgttgaatgcgatgaaaaagaagtacctgcttgcatataagcaggaaacctgaccacccagggaagtccaggaaggcttcccagaggaagcaacaggctgtagcacacggaagacttaaccaagtgaaggggaggagaattcccaagtgggctcatctcccatctccctggatgtcccgacaggcttgcacctggatcgggcccctccctgcccctaccatctctcccacttcccaaagctgggagaaagggaacacctcaccctggatcctctgtgcagcccagagcctcccagctgtctccagcacccacgcctcagtgcggtcagccagcaggaaggtgctatggtaggagaatggcgcagcatcctccaggcagttgcccccctgcccatagtgctccagtaaccctgtgatcacatgcaaggcctcctgggcagagctgctccgttccaaagccagcctggcaaaagagagggccaagggacagaagggtgacagagggatcaatggctggtggcagaagctccaggggacagaagaggcccggagaggtttggtgataggcccaagtcacacagcaaatctgctggcactgatcgtatcaaatgcaattatgccagtggctttcaatgctctggttccatgtgctatgctttgagggttccatgaaaaggcctgaaacacagtttcagagagagaagtgtcctgagcccctaacctctctccacccagagctgctccatccactattactggttttataaattgggactctatgtaagatttcaactgaaaataaataaataaccactgctctatttctgggccaggagaggcccaaaggtggctgctgctgcagccttcttcacgaaggcacaagggcaaagtctgcagagaggaggaggcccctgtgaaccaggctgggggagggatggatgggcccaggtcaaaactcagcccctagatttctggtgtgtcaggcagatgaggaagggcagggtctgcacctgagtaggtccatgcccagcagggcttccccctccccaactggctccttcgtccacacagcctcgttgccaatgcagacaccatgctcgttggcgcccatctcagccccccatagccaagaaggacggctcagaatcacagcgtgcgtcttcgacacctgttccacttcaatgtaggtgcactggaggtgagggaggagaaaggaagcgtccactcatagaggggcggcccctcgagtgtggcactctgccaattaccttatagatccctttgaggaaggtctcattcccattttacagaagaggaaactgaggtagactgaggctacataatgagctcaggtccaggttggtagacctaaagctcatgctcttccactacttctggcagcctcccaggtgtggggagcagggaagaaggtcttaaaagaatgcagagatctgccacacctcccagcaccccataaagtctaacccacctggagccggctcccaggagtgtgagtgcctgcggggacaaacaccacctcctgcacctcgtcccggggtcggtccgagttcttggcaaagatcacagccgggatggctgaggccgggggcacggagacaaagcagtcgcaggaacatggggagtcagggctcgacgacgccatctggggagaggcgggcctctccataaccctggccacggctcagccccgaggagcagcctacccccacacgtgtaaaagacgcgcaaggaagacaccgccgtggctcctggacgctcggcgcacacaccatggacgggtgtgcgggaacggaggtgcccaccctctccccaggctccaggcttgggagtccgcaggcgggcactccgggggtcccgcccccactgggagtcccggcccttcggagcagtcgtgggaccgtccccctcgctaccccaccaagagtcctgcggccctgcgcatgcccagatacccgaccctcttctgtccaacccttctctcacccccagtactgtattcccctcaccctctcttcctccaagaccccagctcggtcccgggtgccacctcctccgcttctggccagggccgccccattgggcggagactctcaggtgacctggaaggccttcggcctcggggtcggagccggaacggagcctgcagctccgccgttttccaccagggcgcgcgcctgcaccacttcccggagcagagcggccttgcgagtcccacctggctccctgtcctacccaggcgcccatttgaggcctgacaaaggctgctaaccccacggagtcactgcggggagctggagctgggggtggaaaggatcccgcgtgaaaagggagactttgtcagagaaaggggactgctgggacatctggagattaaggaagaacctcagatacttgagtcctggtttgaatcccagaggcgcaatcccaggctggaggcgcctaggggaataagatacagaatacgagagtggtggaggctgggtgcggggggctcgcacctgtaatcccagcactctgggaggcggtggtgggaggatcacttgaacccaggagttcaacaccagcctgggtaacacagcaagacctcgcctctacagaaaatattttaaaattagctgggcgtggtggtgcgtgcctctagtcccagctgctctgaaggctgaggtgggaggatctcttgagccagagagattgaggctgcagtgagccaagatcacaccgcggtactccagccgcggtgacagagcaagaccctgtctcttaaaataaataaataagggaaagtgtgcacaaaacccatctgatcccagaggacctatctgtctgatagtgctcaaacccataggaagatcgctttaaagggaaatttagaactttctagttcaaagatttggtgcctttacctgtagtgaaactgaaaccacaaagaagtcttggccaaaggtgacacacagtcatgtggaggtacactctgatcccaaatgttttgattttcagttcatttttctctacaaaccatctctccatagccatcattaagacaaatgcatcttacacccttttgctctgtggagccctccagaatggagagaggggagatgctgcaggttatctgcttctaggggttgcactgaatctatagatggctttgagtagtatgcacattttagcaatagtaattcttccaatccgtgagcatgaaatatctttccatgtctttgtgtcttcttcagtttctttcatcaatatcttattttcagagtacagatctttcacctctttggttaaatttattcctaaacattttattattttggtagctattgtaaatgggactattttcttgatttcttttttgtatagtttgttattagtgtataggaacactattgacttttgtacattgaccttgtatcctctgactttactgtatttgcttaacaattctaacagtgggccgggtgtggtggctcatgcctgtaatcctagcactttgggaggctgaggtgggcggatcccctgaggttgggagttcaagaccagcctggctcacgtggagaaaccccatctgtactaaaaatacaaaattagccaggcgtggtggcacatgcctgcaatcccagctacttgggaagactgaggcaggagaatcgattgaacctgggaggcggaggttgcggtgagctgagatcgcgccattgcactccagcctgggcaacaagagcaaaactccgtctcaaaaaaaaaaaaaagaaagaaagaaagaaagaaaacaattctaacagtgttttagtggagtttggccttctttcaagcctactgtgctagggtgctggcggtcagtcatgctaggattaatgggaaggtgaaggctgtttctgatacagtgtcggggagggattgtgaggttgccaattaatgtcattccagaagcaaacatcgaagctgcgtgctgagaaatctgggcacctgaagcagcttgcaggaaggcgggttcatctcctgcagtttcccggcttcccactgtggggcggaaacaggcaggaggagaggcagagagaggccacagcgcacccccaggttgcagtttccaggctgtcttcttctctgtcactttctcat

SEQ ID NO: 12568 - DNA, 22350 bp, Homo sapiens
tttgtatttttgtagagacggggtttcgctatgttggccaggctggtctcaaactcctgacctcgtgatccacccaccttggcctcccaaagtgctggtgttacaggcgtgagccaccacgccaggccaattttgtatttttagtagagacggggtttcaccatgttggtcaagctggtctcgaacacctgacctcaggtgatccacccgcctcagcctcccaaagtgctgggattataggcgtgagccactgtgcccagctgggttacctgtttttgtctggggtgcccaagctgctatattccaggaggggggcctactctctgaccctggcaaatcttggagaaggggttcataggtacagatttctgaggggggtccctggctcccaccaaaggcacccagacagctctccatagctgcatcccctcctggttcctggtcccctgccacccatccccacatcaccatgcccttcactagaggacacagccttggtgtcctggtgcagaatggtgcccatgaccctgccaggcagtgatggtgctccctgatgagaaccacagagaggatgcgttgatgaggctcaacaaagcagccctggagctgtgccagaagccaaggccattgcagtccaacctcctgcaccagatgtggtaggtgccctgccaggagagctgccccatctccttccctttgtggcatctgcaggggtcctgggcaggcagtcctgggactccaggggtctgagcttccgttgagctcaggttgctagagcatgccgcaaacattccacgttctggaaccctgcagtgcctactgctcactggagagcagtcacagcagatcaaacaccttatcttttttttcttcccctttttgccttgttccttctcagtgagcaggggaatggaaaaaggagaagccagagggcaggaagaagagggggggcagattccaataaaagcttcatttctctgttgtcaccctcccctgtacctgtttggaacttgcttgtataggcgtggggtccttttcaaggccctcaggacaagccccaggagccttatgctggaagtctcatgcaaggttcagcccctccagtgcgactggacccaagtctggccctggcctcaagccctctgaagtaggactgaattcatgcaggcctcgtaaccctagtcctgggccatttttttcttggttgccacccaaggcaagccagaaccccctccaagcacttgccctggcggggaacagtgaggatgctggctgttcaggggtgtggcatttccacagcagctcatggcaccagggtctttgaagggagggacccaagcctctgcaggttcaaggacaaatgaggagtgatggcatttctccactgtgtcttgccctctagtttgcagctgtggcgagatgtgattgacagcctggtgggccattccatgtggctgaggtctgtgctgggcctgcctgagaaggagaccatctatttgaatgtgcctgaagagcaaggtcagatcttgtgcaaccaaccacacctctgcatagccctcctcatctctctgaatggacaagcagcagtgcctgggccagtcatactcctttggtggaagctctgctaggttgagcccatggagtaggccccttacccctttctgtcggctgccaggatgtggtacccagaagctaccttagtgaccaccttgctttagtaatcccagcaaagttaaatgacttatccatggccattcatggcatggcagagctgggaccagaacataggcaccacagtcctgtttcatgaagccacgcgcctaccagggctcaaggctattgccctttgcttttccacctcccctcaagcctcctcacgtacctgcagcatccactaggctgttgggggcctgccatattttcttccacccacctcccttagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgggaaagaggcatgctggggcgtggtctgggccaggtggggctggggaggggattggaggggctgcggaggtgggggctgtggaggtgggcatgtgcccaggctctcccagtgagctactattgaggacatccttggcctacctctggagctcctgaaggctatgtgtgtctccctcccccagcaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagaggctgcacagtgaggtgaagggaagcgcccagcagccattcccctgcctcccacctgccttattcattccattcagtctgcagacaataagtgcccactccatcatggtggaagcagagctgcttcaggaagggcatcctcgtgtgtgagacaggcctcatgaataaggaatgcgcctagcatgttaggtgatgagtacaatgggagagaagatagaccaggcagggaatggaggcacagaggcctcagtgaggaggtgacaacccacaaagatttgaagggaggggaagggtggccaagtagacgtccagtaaagagtgctccaggcatggggagcaactgccataggagggaggggccagaagggagagggcagtagtggggagcaggtcataggggtgggggatggtttgcaggctattgtgaagacttgggatttttcggagtgaaatgagaagtcacgcaaggttttgaatagaaacgcaatagggtctgataggctttagaaggtggctctggccgccctttggagaacagactctaggggaacagagaggaaggaagcccttctctttcttactccccgttaggtgcatcctggcagatgcgttccttgggagaacaccatgcagggtgcattcccatcaactgtaagagtttgaaggactagagagacttcatcctaatccgttcttaagtagcaggtccttagaaattcacccaggttttccgttttgtttgttactgttgttgtttgttttggaggggaggtccacaaagccattttcaatatgtcagtatgtctattggcgacgtcttgccttcctctaatgtggatagctggggagctgggattacatcatgtattgtggtcacactctggatctcatttgatcaaaagttccatttgccactggtgacatcactaagatatcagatggttgatggggtctagaaagtaattaaagggctctgaggacccatgggggtcaacgtcaacccttccatggctctttgatattaagaatcaacttgcagaccaggtgcggtggctcgtgcctgtaatcccagcactttgagaggccaaggtgggcagattgcctgagctcaggagttcaagaccagcctgggcaacatggtaagatcccgtttctactaaaaattcaaaaaattagccaggcatggtgacactcacctgtagtcccagctacttgggtggctgaggcacaataatcgcttgaacccgggaagtggaggttgcagtgagccgagatcacgccatttcactccagcttgggtgacaagagtgagactcttacctccaaaaaaaaaaaaaaaaaaaaaaaagaatcaacttgctggccagtggctcacacctgtaatcctagcacgttggaaggctgaggcaggtggattgcttgagcccaggagttcgacatcagcctagacaacacagggagaccccatctctgcagaaaaaaaaaagaatcaacttgtctgggcttgtatgatccaaccccattggaggggtcagtcccagagacctttcagtctgtggatacaggaaggaaaattggcctccaggaggccagagtagaactggggctgagcccaggcccaccccaaacggctaaatgggcaccgctccatgggctccctggagttgccccttgaacaacttagctctagtatctccatatgtcaaaggtaccagcgcagggccacctccccagactggtttgaaaagtaaaactgcaaaagcaggtggattgcttgagcccaggagttcgagactagcctgggcaatgtggtgaaaccctatctctacaaaaaatagaaaaaagtagccaggtctggtggtgcacgcctgtagtcccagctacttgggaggctgagatgggagaatcacctgagccagggaagtcaaggctgcagtgagccatgatcacaccactggactccagcctgggtgacagagtgagatcctgtcaaaaaaaaaaaaaaatctgcaaaaccaaaaattatttcacaagaactttgaacttgtgaaattctttcacaaacaactggtttctttcccctctccagctattctctcacagcatagttcatatataggtgcttcccacagagtaaactctgcctgtgatgttgtcccgttcttccaggtccgtgggctgctggacaccctggtgaccgacctgatggtcctggctgatgagctcagccccataaagaatgtcgaggaggctttgcgcctctgcaggtgactctcgggcccaagcaaccttctggaaaacgggttaataaataaatcaataaagaaccttcaagtttctactacttccgtgtgcctctgtgtcttgcatgatggatcttggctaggtcagctcctgatccaggtcctcccatgttccacctgccctcagattccctcctgccagctgccagagccctcctgcaggaggacagacagacatagctggggaagtgatgtgtgggatgccaagcagaggagcaggttggtagcaagacaaggagtcaggtgacaggacagtgtgtcacctctggtagtccctgcctctggcttccttggcccacactttcagggtcgtgcttcctggagccaggtcttcccgaagtgtcatcaccaagtatgacaaagtgtgagataaggagtagaactagacccatgggacctggctccctgccatctcccctcttcagctgggtcccagggccccaattcagtccctgaagatcatgctcaccacacctcttcagctctagaggccacatcaccttgttatttcggggtctagtctgccttatccccctcctcatctcaaactatctggccttgagccatctttctgccttaaaaacagctgctgatcttcatgctacctcccttgctcaggggaacatgaaacaggctagaaatggctctcagaaaaaaaggtattgtcagctcaaactcaggcccctcattgtcttctgtcagtcataaccatttggggctgggctccctgtgtgaacagcactccaggctcccagagtttgaagaacaactttggtttttgggtgggtgggcatccttaagtgggcctcaggcatcctccagctgagatgcaggagggggaggatggacagaaggatctgactccgtgtgggaaaggcagggagggggctgtgctggagtcctgatgctctcctccccaagaagacgagaagacgggggctccaccaaagagccagccccagggaatatccctgccctctcctttaatgtcctcccggcccagaggaggaaggggaggggtgtggtgggggtgttggagcccccctcctttcctgttgaagaggcaggggaagggttaactcaaagcagaggggatcaggtcgccagcactggctccagatgtgcacttcctgggggcggccaacaggcaggccccccacctctcaatgcaccacttgcctggccagcaggaaggggttaacctgccctgcgcttcctcctgtgtcctgttactgctgaggcagacctgccgggccagctgagcaactttcctcggagtgctgcctggcgctggctaggaggcaaacrcacgcgggaagagctgctacccattccaggraccctgccgctgcccctctgaggggtctgcacctcctgggagcaggtgggtctctgggacgagggtccatggtggatggctctggagacgctcccgaggctgtgccgtcccsctgctgcacaggtcggagggtcaccgcagaggctactcgggctggggctggggccgagggagcccgcactggaggtaagcttcctccytggccccctccctggcagtggcggcatggaaggcgggggttggtggggagcaaacagtggttctggggcttagtctcttttccaggtgcgagggaraaggctgagctgtagaggacctaaaggcttctttcctgccacccctccctccctgccgcccccaaaaagggactcagggccccctccccaaccatcctgggacttagcatctttggtggcatcttagcatctttggtggcattccccacagactccttctgcacatctctgctgtttcctcttcttcagcccctcatgcacacctctagcctcagggcagtcccccctcccccatcttctgtgctcccgggatgcagctattacagtggccagaagcttagagttcaagctcaccccctgtcccttacagcatcaagaagggcactgtcattccccactgctcaggctggatctgacttggaggcaggggctggagcccaccttagcagaggacgggaagagggtgtgggctgggctggtgggtgcacagactttacgcaaactcatgcacgtgtgactggacagatctgggttctctccrtctctccgaaacccttgctggggatgagcgatctgcatttttcggtcctgacttttgggaaactctccagatccccccatcctgcaggccctgagaagagcagcccctccctactgcgcagttctccttgggaccctgtatgcaggagagagctgatactccgtgccccgtggcccatcccaccgcctgctggccctgctcccatcccctcagcttcctccctcctctgccctctctgtcatctctgaattctcaggccctgccctctctgtgcccttccctccacctgacagggtctggctcaaggtcactgcagtaattccatacccagctgcccagggctgctgctgctaccgccaccgccttatcggccgctgggtttctgttacactcccttttatttctgggcatatcgtgttcgataaaaccctttgcttgtaacactgctggcagcgctcccagctgctccctcccgcgttcccgcgttccttcctttcctcctcccttctctgcgcttgggcaggcttcttcctttcctcctcccttctctgcgcttgggcaggcttcttcctttcctcctcccttctctgtgcttgggcagcctcaccttgtcccctcaaactccagagaaggaaaatcaaggtgcctccccatgtttctggccccgcccttccccccagcccctgcaggggtgtgcagagaatgcccaccttctgtgagaaaggtccaggcagggccgctgggcccacaccgasagtcccctcccagaggctggtgcccccacacaggccaggccggagggccagggcagccaggtccaggtagggctctggtgcagtcacagtgcccgactggttctgctagttccagcggccagccggtaggggcgtgtgctgggcgggctttggtgcacattatttcccatcttgactctgccacccccagccacgggttggggaggtgaaggcaggtctgagtcactagcaagggggagggcaggagttaaacaagttgtggccgtggcattcccacagaaggcccacgacccgctggaagraaagagatagcaracaaaaggtaggctgcgctgtgggccaggcactctccacctcgcccactcccacggtatcttattctctgggcccccaacaaaacctgccaaggcatgttttcaaagcgtggggctgctttgaactgagcccagcactggcggggctggggtggaaggagcgtggaatcgggtgcgagaggacagtctccttcagattcctgcttctggcagcctggggaccagttggggcacgggctgggatggagggtggagccgaaaggtgtttggtgggtgggggacagttcacgggtgaagtggaggctctgcaggcccagacagtgtgtgtgtgcatgcacacaccagtgctagtgtgggaggaatggtggtggtcagggaattcctcttttggtttctgaaagggcctttgggaggaccttgggcctggagttgtattcagcagatagcctggacctgtggctactggggggaattgggctggcccagctcttctccctgctggggtaccagaggtccactatgtgtccagcgttttggggctttggagaacccagactgttcctactctcagggagcttccattctagctgagaaggtgggactgagacagtaaagcaatccgatgaaataatgaccaaactgggtaacactgacaataagaattggattagtcttctggagtcctggatggtagtccaggctctgccacttacgtgccatatgatgcaggcaggtcccatcccctctctggcctcaacacttccatgtgtacgtgggggtggcatgcaggagtgttggcagtggccagaactctgaggggcagtcttcctcaaacgatacttgctctcttgccttctggcccaggtcatagcatttcttctgagccgccctcccctgacttgctggttcactcctccttactcttcccttgtgatcttggatctcagctctgycaccacctcctctaggaagtctcccctgattttcctggcttgggtcttcctgtgcggctctgcactcccacactggactgtgattttctgtaccctctcaactgaacgtgggtggaccaaggcgtgtgttctgtgcctggcatggtgcctggctcagaaaaggcctccgggaaataggtgttgaatgcatcaaactacaaaaattaacaatatgagaaaagtgagctgaggagctaggaaggataggtcttaagctagatctcagcagaaacagaggcagtggccgagcagaagcaaggcaagcgggcattcctggaatcctgttagcgttcccccatgaggccatgcactcttaggtggggcttcctggggtcatcttggttccccatgcagcagctctgtgatctcggacaagtcacttaatattacagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggaggtaatgataatagcatctttggggtgtggctgtgaagatagatagatgagcatgcaaagctccaagtgcctgctgaattgtaagtgaaataagaacgtgtgccgctgaaggctgtccctggaggcagggacactctggccaggcctcatttagttggtcagtggctgagtgacccatgaggtaggcctctgcccctgagttcctggccctctcttcctcagccccatgtggaacccaaggatgcagctgctctgctaacacggcagcccatccttcragactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcrtcaacgtgcgcgagaaggtcaagcaggtgatggccctgctcaaggatgaggagcggctgcggcaggagcgaacccacgccctcaagaccaagragcgcatggcactggagggcatcggcattggcagtgggcagctgggcttcagccrccgctacggcgaggactacagccgctcccggggctccccgtcctcctacaactgtgagtaagccccggtgtgtggctgggatggggaggtggcccgacttccattcctggctctgcaatccaagccatggttcataatacctacctccgaggggtgttatgaagattcagacataaggaatgtaacacgcaaggcgcaacacccggcacataggaggtgctcaacaagttagctcagataataacgtygttatagattcattatcattcgttagctgcctgataggatggcgcgatagtggaagcatgggtttggagtcagatagcattctatattctgcttcctccaagctgtgtgacctgggcaaccagttctctgaacctcagtttcctcatctgtacagtggggataagctcacctacctccattgtttgatctgagaatgaaatgagaccaggttcaggaacgtcctctaccctgcacccagacacatggcattccccttcatccccctwcctgagggcagcggctagacagtccctgactctcctgcccccagtcatgggggcttccaggatctgaggaatactcagaatggcccgccttccataaagcccttgacagtttgctgagggctttgaggttgtgacctcgttggactagaacctcctatccttgcacctcccttgcccccaagccaggacagggtccatctggaagtccaagagctggagtcagggcacctgggttcaagtcctgcttcaggaacctggtcaggggccctaagtgccgcctgtgcatctgctaaggagggactggagccgcccctccatccgggatgggttgggatggggaacttacagagtgcctggcacactgcttggcccacgggggcctcaacgrccgttgttcccctcctctcagttctcttgagcctcagcttcctggcaggcagaggggtgtgggagccgatgggtaatygtgtggtcacagagacatgatggtcattgcagcctcctcttcgtcaccccgctatacctccgacctggagcaggcccggcctcagacgtcaggggaagaggaactgcagctgcagctggccctcgccatgagccgtgaggaggcagagaaggtgaggccatgcagccccactgcggtggggaggggatgggctagggggagagagtgcctgggagccccttggccttgactcaggctctgtcacccaaagccccagtcctgtgcccaaggacagcacaagacccattatctctgtcggtttgtcgcaggcagggactgcctccctgcctccagtcctctccactgggcctggaaagggtggcgagtgtacaattaggggcacatgctatgtcttggggtgcctgctaccacctcatggtggagtgggtgagtgtgctcagacatattcctaggagacactgggatatgcttcccacccccgcccaccagctatccttttggggagacaaggacaggcccccgatatcatcatctttgccattacctctgtggatccaggaagaccaggcaggaagcagctgggcctcacacaggagggcctgaggaactctcagaggattcagaagcgaaagatcagtcttcctgacctttaaactgcatttcagatgcaggcagggagaaggccacgcccaccctgctgactgagsggcaaatggcccatgcacactgagggtgggcattagtgtctccatccccatgacccaggcaggcctatactgcccttctggtcccaaggtgggggtacagggccaagtttacccctctcttcctccgcagcctgtccccccagcctcccacagggacgaggacctgcagctgcagctggctctgcgcctgagccggcaggagcacgagaaggtagtgggccgagcccgctgggctgccggtgctgctgctgctgctggtggaggtgcttcagggcactaacagcctcctcccgctgtacccggtggccctgctgctcctaacctctcagctgcctcccaccctgcactctctcgactccagcctctggtgcacaggtccccggattcccgcctgagctgctcatgctcctaactctttctgtgccttctgcaggaggtgaggtcctggcagggtgatggctcccccatggccaatggtgcaggggccgtggtccaccatcagcgggacagagagcctgagagagaagagagaaaggaggaggagaagctaaaaaccagccaggtagggagtgggctgcggtgcttgggatggacagggcctaagagatggactgagtatttgtaaagagagagcagagcagtgcctggcatatagtaagcactgatgtgtttattcgatgaaataggggtgggggtgtagcagccctagtcccacattgcatgggctggtgactgagttaacagcaaagtgggatgcaaaaggttcctgattggagacccccggattcgggttctggatttgctgccacttactctatgacttggggcatgtcactgtcatggcctcagtttccccttctgcacagtgtgcttattggatagttccagctctgacatgctaggattatgtgatactgtcaatcaagactagggttggcctaagcacatggtgctgaaaacacctcgggctcatggacatattttctccgcatggggagtgggcagctgctgagtgcaaggctgccctccaaagctgtccatgccacgcccgggtgctgtggtctcctttccgtccatgttcactgtggccagtttctcttggacactgacctagggaggtaggctggttgaaaaacatctgcctttggccttcctgcccctttctgctggcctggattctatcccagctctgcctctccctggctgtgtgacttcaggcaaacccattccaccctctgtgcgctggctggctcatccataaaatgggtacatcatctgccctacctacctcacagggttgttatgaaaatcaggtactctgtggatgaagaaacattataaactgtaaagcactgtgcagaggtgagggatcatgaatrggtatctgtggaatgaataaagagaatgaactggcattagcctgacaggtcagggcctgccctccctccaggccccgcccacttctgagccgcggctgcctctcccctccacagtcctccatcctggacttggctgacatcttcgtacctgccctggccccgccctccacacactgctctgctgacccatgggacatcccaggtgggcatgcagggctgcaagagacttccaggctggcccaagagcctcctccttcccagccacttgctgggccaagcacctcctcccaaaatctgagtgtcaccgggcaagtcactcaccaccttgagcctccrccgcctgtgggacaggctttcgtagtgagggctatggagaatgtctgaagggcccagctcctaggaaacgcagcaraatgttctctcgctgcactcacttgctcagcacgcctgggaaggtggcctgagtcgcccacacctgcaggtcccagttcctggggtcacttgtcaaataggggctccagcctgctgggtggtcctgaggctgcaggccatctgtgacatggatcttctgcctcccaacttgggctgggtaactgggaagggccctgggcgrgggataagggtgggcctgggatcatgtctatgctgttcccatttcaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccacyacaaactccccagcactggggctgacccttggggagcctccctggagacctccgacacacctggtaagaagagggccagagagtrtgagtgaggagctgggggacttccaggcagggccaaggggcagcagatactgtttgtgttaggaggacagcttctctggaaaggggtcagaccaacacctgccctttttgtcaacccatctcctcttcctctctctcttccgaggtggtgcctcgacctttgacccatttgccaaacctccagaatccacagagaccaaggaggggctggagcaggccctgccctctgggaagcccagcagccctgtgggtgagcagggcaaggggatggtgaggctctggggaatgaggggcccaccccgagcagcctctgtcctcttcctcccacgtcgggcgccaatccctttccccaccaattagctctagcatttctattccagagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtaagatatgcccttgtccctcaacccaggggctcctgctttcagagcctagcctccgccggaggagcccactcttcttcccaacttccacgacctcccggtgtagggctctgaaccccgggtcactcaaagccactctcgttctgcaggtctcagcgctccgtcccccaccaacccgttcggcgcgggcgagmcgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaatcgtatgaagaatttcaaaacagggacaacagagcatgaaaccaagcgcaaagcccactgcagtgcgattgcacaggtatctcaccttgcagccggcactactcccatttttcaggcaaggaaaccgtggctcagagaggttgaatggcatgctcaaagtcacaaagctggcatggggcggggctggaactcaagagtcagacagtctggctccaaggcctggagatcccaggctgggccccagatttaattcagcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcggtgagtggagaggcacaatgccactccccttcctgaggtgggggtaggggaagggagtcccacaatgcagttacaaacaggatggacaagaacacctgctcaggagtcagacttacagggttcaaagttctgctccaaggtttgaccctaacaagaatcacttagtaataagtggttatgctctgtgaccttgagtaaattacttaccctctccatgtctctgtgcctgcgtttccttacttgtcaaacgggatcagaagtttcttccttgtgaggttactatgtggatgtccccaggcgtgtccattcagctcagagtccaccctcttcaaagactgaccatgaggcacgaacccatcatggctttcactcctggttttgccaggcaatacccagagtccagcacccatctattaatatcttctgctgcacccaaacctgggatgttccatccttcttggcccctgatccaccctttgtggccctgccacccaggctctcttcttctaaactggatccccccgaggactcccaaggggagctgttttgtttcccacaaaaaaagttggcagccttgcttcctgcctccctccttataagacccctcctgctaggaggttggtgccataagtcattctgtctcttccctgcctggggctgccactccacctcacttttgggatgcttcggtcttggctcatggtcttctcatccagctcttacctcaatttcaagtcgctccattatccaaggaccttatggccccttgacctctcaatgaccctcaccatggtcacacttggaggtttgtcatcaccccagattcctctacattcaaggcaggcttctggctctctgagcttaacctcattccttctagccagaacatgttctttggagcacccactggaccctccggctagccaacccttccaacaacccgccacaccccacattctcagagtcacccaggaccaccatctcttctatccttgatggcgtccaccactttctctcaaacgaatccttcccatcgaaatgtgtcttaattagctccatccatcttgacagtgtcttcccatctatcctctcatgtcaagcacccatcatctctctctgtctcccctccctttcctcttcctcctcagccgactcggcaacttctgctctcagcctgacttcactagaacgacgcccactaagcacaccaatggcctccatgttgctgaagccagtggacatttttctgtcccagccaggctggcccctcaggagtctgacatgtaggcactctgtccttcatctctggggtgctgtcctttgcaccctggctgcttcccttctgtgtctttctttctttctttcttctttttttgagacagagtttcgctcttgttgcccaggctggggtgcaatcatgaaatctcggctcaccgcaacctccgcctcccgggttcaagcgattctcctgcctcagcctcccgagtagcaaggattacaggcatgcgccaccatgcccggctaattttgtatttttagtagagatgggggtttctccatgttggtcaggttggtctaaaactcctgacctcaggtgatccaccctcctcggcctcccaaagtgctgggattacaggcgtgagccaccatgccctgcctccatctgtgtctttcacaggcttacttaagcctggacctgagccctcttctctgctcctctgcatggtctccctggatcagctccacacccacatggtctcaacagtcaagacccccaatcctctctcctgaagcctctcctctgtcctccaagcagtgtcatctctgcctccatgtgcacatctcaaacccacaggtcccacaatgaaccccatgagttgtccccccacccccaccccatgccctctcttgagggaacggccccaccttgcaagtcaccctggacaccgccttctttgtcgccgcccatcctgacgacgtttcctccttgaccgacttccagcccatccctttctctgcatctctgctcccccatctccccctgggtgctgctatagcctcctatctgcccctgctttcactcttgcccctttccagttcattctccactgggaagctggtgggatctttccaaaacgcagatctaactgggtaaccctcctgactaaagcctttcaatagcttgcttctactgtcatcaaaaatccccttctctggccaggcacggtggctcacacctgtaatcccagcacttcggaggctgaggcagatggatcgcttgaggtcaggagtttgagaccagcctaggcaacatggcgaaaccccgtctctactaaaaatacaaaaattagctgggcatggtggcgcgctcctgtagtcccagctacttggaaggctgaggcacaagaatcgcttaaacctaggaggtggaggttgcagagagccaagatccactgcactccagcctgggcaacagagtgagactctggctaaaaaaaaatggggtcgggtatggtggctcatgcctgtaatcccagcactttgggaggccaaggcagatggatcacctgaggtcaggagttcgagaccagccttgaacccaggatgcggaggttgcagtgagccgagatcacaccactgcactccagcctgggtgacagagcgagactctgtctcaaaaaataaaaatccccttcttacagttcacgagtgtctccaagatcttgcctctgccctcatctactgcctgtcttccctctttctgcagttgctcagcccggactcactgacaagccacgggacctttgcacaaactgtacctctgcctccttccccagcactccccctgagcaccctccaagttcctttctctcgttctccatggcttcacaaatgtgatttcctcagggaagccttcatcctttgccccttccaccagatcaggtcacttgttacgttataccctcacggacttgtcacgtgggtgtttatcggtatggctgtcgaattagcatctgccgctctcaacagactgtgagccatgtgagggcaggagccttgtttctctctgcccaccattgtatactcagtgccttgcagagtggcaggcggcaggcacttaataaatattggctgaatgtagccaatgaggccatgtgtaacctatgagacataaaatgggctcatcagtattatttaaggaagacttcctggagtgggtaggatttgagtaggacctagagacgaggaggctgcaaaaagcaaaccttgttagctggtggacctggccaaggtacgccttcgccttggatctcatttctcatttgtaaaatgggcaggggttggacaaaatgagctgaagctctggcatcccatgtccctagcatctcccagccctagatcccacaactctccctattcccttgagaagggctgtcctccccaggcaggggcagagcccagttttatgcacagaatgggtcctcccaaggctcgggtgcctgatctgcaattctgcgctccgccgcagggcgacgctcggagaccagccacactgtcccaagtcccggcgaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccaccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactc

SEQ ID NO: 12569 - DNA, 29142 bp, Homo sapiens
tcaaggggttattatgtgctgggccctgggttgggccctttcctatgttatcttcaatagtcgcccaccttcccccacagcttgaaggggctctagacaagggacatgaagtgaccctggaggcactcccaaaagatgtcctgctatcaaaggaggccgtgggcgccatcctctatttcgttggagccctaacaggtaagtggggaataaggtcttcatttatagaccttttcagtaataggaatgaatcacttgaatcaattcccaaatggatgaataaatgaatgaatgacaaattataccacagttaagtagtttatatctacatttttataaattggtttcatggctggctgcagtggctcatgcctgtaatcccagcactttgggaggccaaggtggatggatcacccgtgatcaagagttcgagatcagcctggccaacatggtgaaaccccgcctcttccaaaaatagaaaaattagccgggcgtggtggcaggtgcctgtaatcccagctactctgaaggctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataaccctagttttatcagcaacatatttaaaatttctgcatatagctaagctcatcacttctatcctgatacctgttagctttaacttcagggagtaacattttcttatcttgcccctaagagctcttcttccctccacattttctagttttccacttagaaaaactctgtggtccttcaggtgtaagccaaaacgtttgttcccttaggaagcctgccctccgactccaagaccaaagtggacccctcagctatggctcccttaacacctgcgttgtaattacatccaatgaatgaaggctgaaattctggaagtgcgctatttggaggctgtagtcccctctgcaccagcaacacacatctttctctgctttttttctccagagctaagtgaagcccaacagaagctgctggtgaaatccatggagaaaaagatcctacccgtgcagctaaagctggtgagggaaaaacagcagatgctggggagagtctgggagtagctgcagccagtggagatgcagatttcgcctaaggatggagccattctggaggatccctgtcttatcccaggggcttatgcccactcctcctttctctctctatttctcattttttgttatttcacaagaggtagaagactgaatttctgggcaataatctgggtttattagcctgatcttgggagaagagacagaaactgtggctttgcttattcctagccaaatattgtaagcaaatttttttttttttttttttgagatagagtttcactctttttgcccaggctggagtgcaatggtgcgatcttggctcaccacaacctccgcctcccgggttcaagcgattctcctgcctcagcctcccgagtagctgggattacaggcgcccaccaccacaccctgctaattttgtatttttagtagagacagggtttcaccatgttggccaggctggtctcaaactcctgacctcaggtgatctgcccacctcagcctcccaaagtgctgggattacaggtgtgagccacctcgcctggcctgtgagcaaattttttactgtgtctgagtctgtctcaatttattcctctgtaaaatggggctaaaaatcaatgtgctgcccactgtatagggctgttcaaagacccagatggggttgtaatgtaaggtaaagtaaggaattctaataaggggaatgtaaccttcttgtgatttttgtgagttaggagaggagagaggtttccagttctttcttttcatgctgttttgattccctccaggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttaggaatgatatgtcttttggtgtttttctttaaagaatttatcatacagaaattcttaatttgtgccagaaaaagaaattgttatcatactgcatataaatcatatgtacatgaatatgatgctgtactgtcctcaggcaaactggaaaatgctcagagggtatagaatgtggaatccagatttttttttctgttcaattagttttctttaatggaatctagagtctcaagtgagaagatatcaaagcagtttgtcttcaaagaagagcatttgggagtcccctagctctgggttgagggaaagaccgagagatatatagtagaagcccgaaacaaaaataagacagatttcaaatttattgaacagaaaatgcagatgggcctttaaaaaaaagggggacccaagaataagactaacccaaaactttaaaaactaaattgtgatattatttcacctttctctgttctgccctgaaatttagggttcttgtaggaggaagtagtgtgggtaggcttggcatattactactaatatggatattacaatctcatcaaaccgctgggtttatatcatcctcctctgcctaaaagctgggtttgaacatctttcaccaacctcttttaaagcagtatcaggaccggacaccgtagctcacgcctgtaatcccagcactttgggaggctaatgtgggcagatcgcttgaatccaggagttcaagaccagcctgggcaacagggcgaaaccctatctctacaaaatataccaaaaattagccaggcatggtggcatgtgtctgtggtcccagctactcgggaggctgaggttagaggatcacttgagcctgggaggctgaggctgcagttagccaagatagcaccactgcactccagcttgggtgatggagcgagatcctgtctcaaaaaataaaaataatttttaaaaaagtagttctatgagtgcagtacatgtctgtaatcccagcactttgcaaggccgaggcaggaggatcacctgaggtcaggagttcaagaccagcctaatcaacatagtgaagccctgtctctactaaaaattaaaaaaaaaaaaattaaaaattagctggacatggtggctcgcacctgtagtcccagctactcaggagaaggaggcaggagaatcgcttgaaccccagagggggaggttgcagtgagccaagatcacgacactgtactccctagcctggccaacagaacgagattccgtttaaaaaaaaaaaaaagttttatgagtggaagaatttctctaaggattttggtccgtggagtcagactctcccccagtgtcttagtcaccccctgcccagcctggttccctcatccaccaagaattcatgaccaactgccagaagctttgtgttatgccgccagcctccctgatcctgagcaccttccaaagcctcactctattgctcatggatatactgggttgttatctgctgacttggttgttttctccttgtgatgtaaacttaatagagagatgagctaacaccctaactatctagaagagtaactcctttgattgttaaggatgaacataactcatctgttttcttccttaccattctcgcccaccttcagttgcagatatggtgttatgaagaggttctaatgagtttattccaatgatgattcaaaagtcctgttatccaccccccagccctggagggtgagaggacagttgaggaggaactggtcaaggcatgttccctaaaactagagcacatatctttccagttagcgagtggctgtttaacgcaaggaacatcctgcaatcctatgaaagaggatgcaaaagatatgcaggataccctttatatatgcaaaggaggaggtcaaaacatatttcctgccttctaggtccttacaacagggctagattgtcttgtagggtccgtgaaaggtctaaaactcaggacttccacttatgggagagagaaaagtttcaaggtagggagagagtttttgttttgtgttctaagaaattgggagctatatccttcaccttgtttcaccttccctgcagaaccagtggggcagtcctttgaaaaataagtgggtagggtttcttgtccaatttgcttccccttaggtacaccactaagtaaaccatcattctctccttaggcacaccattattctgttccccatttcacaatgtctgtctggatgtataaaagccctctcaatgggctccctaaagcgtctgccagtaggggctcccaccctctttcctcaacactcccaatccaccgcagcccagagcacagtgtctgcttatctaaccatctgactcccccgtatactacattcttgagctgtttttcacccccctatttgctaaccgtgggccgtacatagggtggacccctatattttgttaaactggagtgattctacgcaaatgcacgctcctacctatcggcactcccagcctgcagaaattgtatgccttatgttcagcactaaactcaaatctaaccaaggaagtccggatcccataggggtcttcctactctccagttcggtttattttaaggccaacagccctagcttcacgtccctccttcacagccttctttccttccctcctgccggatgcgcccggcagccgttgagcacaagcccagcggatctggaaggagaccccgccgcgaccggggaaaattgagcgaacttgggcgcaaaacccgcccggcaactcgtgacgtcatctcgtcccgcgctcggataggctgtacccactccacgctggttgaggcgctcttaaagtcctttgtaacccagattggagcctgaggggacctctcgtggacgcccacagaaatgcactcgagaggaacataaaagcatcacacttaagcgctcgaaagaaagccccacgaacccataaaggctcctccccgctccttcctcgaagctcctccttcatcctgcacctcggctgtggatttatttcccctttgttgactcggccatcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcracgggggaggcagacggcaagacggcggcggcagcggytgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgcttccactggccgacactccgattcaggcccaatgactgaaccttctytccaggctgggaaacactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggrgataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcgctgaatatacagaagtgcctaagaaactaytcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcctgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcaggaggtcaggagatcgagaccatcctggctaacacggtgaaaccccgtctctactaaaaatacaaaaaatttagccaggcgtggtggcgggtgcctgtagtcccagctactcgggaggctgaggcaggagaatggtgtgaacccagcaggcrgagcttgcagtgagccgagatcacaccactgcactccggcctgggcgacagagtgagactccgtctcaaaaaaaaaaaaaaaaaaaaaaagaactccttgcctggagtggtgggggactaggagtgaaagtgacatcaytttcttctctgctcttcttcagacatcaaggagcacgtgaaacagctagagaaagcggtttcaggcaaggagccgagattcgtgctgcgggccctgcggatgctgccttccacatcacgccgcctcaaccactatgttctgyataaggctgtgcagggcttcttcacttcaaataatgccactcgagactttttgctccccttcctggaagaggtgagtgagtcaggccaacttaaagggtgcaggcctggcctcagatccccaggaacagcattgttttccatcctaaagtcccatcttattacctgtggtagcatgaggagagaagccaaagcagtccatttgaatactcatctgcacagtgacaagggaaccgtccactgccctgtagtgtcattcttcmaagtcaggggatcaggaccctcccagccaaactcatttcccactaccctgcaacctgtaccccctactccagttgaggttgcgttgggtgacctctctgttgttctaggagagagaaggtgctgctgcctctttcttctgaagcttcaccatggaggaggtagagaacagtggttaggaggagcacagctgtcagggccaggcacagtggctcacacctgtcttcccagcactttgggaggctgaggcgggcacagtggctaacatcgtcatcccagcactttgggaggctgaggcgagcagatcgtttgagtccagcctggattcaaacaatctgcccgcccaggagtttgagaccagcctgggcgacatggtgagaccctgtctctgcaaaaagtacaaaaattagccaggcatggtggcacctgcctgtagtcccagctactcgggaggctgaggcaggaggatcacttgaatgcaggaggtggagattgcagtgaaccaagattgcaccactgcactctagcctaggtgacagggtgacccccctacctcaaaacaaaacaaaaaaaaccccacagattttagaggtagagttgaatttgaatccaaaccctgacagttagtacctgtgggacttgggcgagtgacttcattttgctgtgcctcgttttcttcatttgttaaacgtgatgaacggattgggaagcgggcagtataaagctcctagagcagtgcctggtacgtagtgaatgcagacgaagtcagtttggtggtggtggtggcgcctccgtgccaggagagacctctccttatcctctgtagctgtaaactctccctcatgattcatggcatgggccaggtctcagccttctccaattccactgaccttccagcacctgcatttccttaaaatcctgtatactcagtcagctccgtggatggggaaactcagaacatccctggaggcagggcagtgaagagtttcttgtctgggaaaggggaaaagcgtactgttcccccaactcyaccttgaatattttctgaccttcacatcgctaaactcacgaaacgtgattattttgggggtgactgtaacacattattttttccagtgtcagtgacaacataggaaaatatgttttgtttatatgttgactttccctaaattttctttgttcccacaagaaaccaktttttggtctcattattctgatttcatctctagaattatttcgttcagccctgtccagtagtatttgcagtggatccaggtgtggtggtttaatgtctccacttaggttgtagcctctttgaaggttccttacatcgtcctttgtctccattatgttgtgtaaagaaattttttgttctcctgtaacactttattgtgtttattaatattatattgccagcctccttgacttgttttgtttttttgagatggggtcttgctctgtcacccaggctgaagcacggtggcacacttatggcccagtgcaggctcagactcctggtatcaagcagtcctcctgcctcagcctcctgagtagctgggaatacaggtgcatgccaccatgcctggctagttcttttttattttttgagagatggggtctcactgtgttgcccagactggtctcaaattcctggcctcaagcattctcctgcctcagccttccaggtagctggcactaccggcgtgagccaccacacccagctcctccttgatttctttgggaaagactgtmatctttatttttttatccctagcacctaacaaaatcttggcacatggtagacactcaataaatatgttgaaatacatagtggatgctcaataaattcttggttacttgatcagactgagcttttccatggtaacttctgtcctctcctagcccatggacacagakgctgatttacagttccgtccccgcacgggaaaagctgcgtcgacacccctcctgccygaagtggaagcctatctccaactcctcgtggtcatcttcatgatgaacagcaagcgctacaaagaggtatccaggatgyrgtgagagcgattcataagmcccaagtgatgcaaggggtttggcrgggagatggtccctggtgaagaaatggaaataatcattgattcttaagaactgtcccccacactctttccccatagaggtatgcgtttgatcccacatcccaggagaacccactcttgctctgggcactgtgggacagggcttgcagtggtcatgctgtaccggtctgtgggggataccagcgtagtacattcttggggaaaagtaggggcatttggagacagaaagacctgggttccaatcccagccataccctaggcaaattaatttctcccagctatatgtaagatggggataatagtgcctaccttacaagatggttagcgttacataaaataatttgtttagaaatacttagcacaatgatctgcatatagtaagctttcgtgatattttcataaatggtagctgttattatggactaatagctccatttgcaaactgcacttctaccactccccagctagggccagcttctttgttcatcatagccactgtcacaggagcaractcaggaagtaagttgcactccttaattccctggtttgtttcctttccttaccacactatttttggttgttgtttggttgggggtttttttgagattgggtcttgctttgttgcccatgctggagggcagtggtgtgatcacagttcacttgacctccccggcttaagtgatccttccacctcagcttcttgggtagctgggactacaggcatgtgccaccacgcccagctaatttttgcattttttttgtagagacaggatttcaccttcttgccaagctggtctccaacccctgggctcaagtgatttcctgggctcagcctcccaaagtgttagggttacaggcatgagccactgcgcctggcccactgttttgtttttactggagatggggtcttgctatgttaaccaagctggtcttgaactcctgggctcaggtaatcctcccgcctcagcctctcatgtagctgggattacaggcacgtgccactgtacttggctgtttgtttttgagatataattcacccctttaaagtgtactacaggccaggtatggtggctcacgcctgtaatcccagcactttgggaggccaaggcaggcagatcatgaggtcagacaatcaagaccatcctggccaacatggtgaaaccccgtctttactaaaaatacaaaaaattagccgggcgtggtggcatgtgcctgtagccccagctactcagaaggctgaggcaggggaattgcttgaaccagggaggcggaggttgtggtgagccgggattgtgccactgcactccagcctggtgacagagcgagactccgtcaaacaaataaataagtatactacaattgagtgggttttagtatattcccaaagttgtatatccacccctaattccagaacattttcatcaccccacaaagaaacaccatacgtattagtagtcacttttcattttccccttacccagcccctggccgctactaatctgccctgtctctattgaggatttacttactctggacatttcatgtaaatggaattacacaccgtgtgcccttggtttctggcttttttcacttagcatcatgttttcaaggttgacccatgttgtagtgtgtgtcagtacttccttcctttttaaggctgagtaatattccctcgtgtggatgtgccacattttgtttatctgttcatcagctgacgggcacctgggttgtttctactctttggttatgaataatgyttctgtgaacattcgtgtacatgcttttatgtgagcctaagtttccagttctcttggcttgcatacctaggataggaattgctggctcaaatgacaactccatgtttatccttttgaggaactgccacttgattctcttttggcttcctccccaggcacagaagatctctgatgatctgatgcagaagatcagtactcagaaccgccgggccctagaccttgtagccgcaaagtgttactattatcacgcccgggtctatgagttcctggacaagctggatgtggtgcgcaggtacaggcagccaagcatctcacttggggtccgtggggtcagagacttggtcagtcacaagcacacagctgtggatctgcagagggcgaagaacctgtagatgtaagcagggaagaggggcagtggttcccatgccctgcgccacgtgaggggtgtgggagagagactggtgctagatgaagaagtgggtcactgctgggctgtaaagaactgtccccaggttcttcccttcaccccacatcaaggtaggactgagggtgggttaggggtggagggacaggctagaaaacattttacttctttgctcaaaacctgcagtggcttcccgtctcaaggaaagacaaagtccttacaatacctcataaggcctgacgtgatctgctccattttgacctcccagacttcacctcctcctgctcctcagccccactggcctgcctttcctctggtgtgcccggcacactcttcttcagagcctttgcactggctgcccctctgtccagaacactcttctctccgcctccttcaagccttcccttaactgatcccttctcagtgagtcctgccttggccaagctattgaaaagttcaactcatctttctcacgtcctgcattccccattgcagttcccctggcctcacaggcctcccatcttctgtcacactgcaggctgtgcttctttctcatgaccattgcctcccccactgcactgcattccctaagggcagggttttgtccctttgtcgcacccagaatagtgctgtacaccttaggcactcgatagttaacagtattcagcaaataaccagaaaagcaatttgtataacttttttaaggaattgagaaagagcgaagagttaaaggcagttcagagagttgtsatttgaaggctttgacatctttctttccttcttgaagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaaygagtgggccaggtacctctactacacaggtgagcagaggggcccaacccataaatcagaaggtgtctcaggcctgcctggtgcaaattttccaaggggtggtgcataagaggcccatttggcaccctggcttgtcggtggggagttggatgaccctactctgttgaccaactctcctctcctccactcccagggsgaatcaaagccatccagctggagtactcagaggcccggagaacgatgaccaacgcccttcgcaaggcccctcagcacacagctgtcggcttcaaacagacggtgagccacaactaccatcatccctttgcctctttttttttttttttttttaaatggtgtcttgctatgttacctgggctggtcttgaactcstgggttcaagaagtcctcccacctcagcttcccaaagtgctgggatcacaggtatgagccaccatgcctgrcccctttgcctgttactcattccctaccacttcagttctcttctctatgctaggggctaggaaaggcatccttaaccttcctatccagaaggacttcaacttttattattattttttgtgtgtgtggagacaggcatatcactgttgctcaggtgagaactcctgggctcaagcaatccttcggcctctgcctccctaagtgctgagattgcaggtgcgagctgccatgtctgcaaaaggttgcttcacatctatttgtgggtgtcaatgaagcagacactacctgcacctctggcagtggatattcagagtgttyctggcagataggtttagaatattcctgattccccagmgctcctgacagtcattccaggcttggacctagattgtgttgatacaaaccccaggtttttatctagtccttcatgttcacatttggaaactgtattgtctgtggccaaggaacccagaaaatctctgcaaggctgagtggctcaagtaaacataaaacttggccacttaagagctgtcagtcagcaagtatttaagcatcaaccttggtattaggcactgtaagggataggaagggaggataataagtgatctttctttcttttctttcgttttttgttttctgagacagagtctccctctgtcactcaggctggagtgcaatggcrygatcttttctcactgcaacctctgcctcccgagttcaagtgattctcctgcctcagcttcctcagtagctgggcaggcgcctgccaccacatccaactaatttttttgtttgtttttttggttcttttttttgaaacggagtcttgctctgtctcccaggctggagacagaggtgccatcttggctcactgcaacccctgtctttggggttcaagggattctcctgcctcagcctcccgagtaactgggattacaggcgcctgccaccacgcccagctaattttttgtatttttagtagagatggggtttcaccatgttggccaggctggtctcgaactcctgacctcaagtgatccacccayctcagcctcccaaagtcctgggattacaggcgtgagccaccgctccaggccaggtatttcttattattagagtatttcaaagagataaagaatgttgtgtcagaaagcttgagggtgtatgtgaagtcacagagcccagtagccaggatgtagacccagtcttcccaaattcaaacctctgctcctaccttcacacaacatccacctccatggtgtcttgacagggaacgggagacgtgtgttgattaggtcaatgtagtaggagattcattttatttctgttcagaagttcagagaaagtcagatttgtttttgatcaaataatgaaagagaaagggtcttaaagaaaaagttggctaggtacagggctcacacctgtaatcccagcactttgggaggctgtggcaagaggattgcttgagaccaacctgagcaacatatggagacaccgcctctgcaaaaattaaaaacctagctgggcgtgatggcatgcacctgtagtcccagctacttgggaggctgaggtgcaaggatcacttgggcccaggaagtygaggctgcagtgagccatgatcgtgccactgcactgcagcctgggcgacagagcaagactctgtctcaaaaaaaaacaaacattaaaattgaactggtctttgaaagatgggtaggattttcacaaggagtaaaggcttttcagacacacagggtgcgtgagcaaaatgttagattgcttacaatatgagagacactaaagtttcttttgaaaatcactaaaaatactagtaattaacatatataaaatgtgtcatgtaccatgagagaggctttcaggcatttaaatctcagtggcaggaaggcgtagagagctggaagagaggtctcgggctgttggtgagggagcgcagggagagagagggcgggagtgaaggcatgtttgggagaaggcctgcaaccagccctctgccctctgccctcacacacctttgccgtacccctgtcaccacccagcttacagaatcacctggggctctgatgaagctgtagattccgattcagagagtctgtgttcctaacaggccttgggtgatgccagtgctgctggtggcacagagcgctctgaggagggcggtgctggctcatcctgttcaaagcggaggtcagctagcattcattcctgcagccaccttgtctcttgtaaacttgaatgtctctctccgcccattttcaccctccctgtctttacttaacaccagcttcactacctgtgttttccatcacactccttcctctctcttctagccttggcccatcacctgtttgcttcagtctccgggaagaaaacccccagccctgctgcttcctctctcaggckscckrytcctgtctcccctggctccctccccaacagtgcactggccagccccttccctccagtgttctctctgctccttctcaccacctgggcctcagcagagcactctgagagcttctctgtcgatagtaaaaccctcattctctccttgagtgaccttgtttgctttcccagcttcagcgctcgcctgcatgatgctcttcagcccgtacattactaactccgttactctgctggcactgccaccgcaaggtcccacagacttggcggcttaaacaaccgaaattgatttcatcacaattctggaggctctaagtccaasagcaaagtgtgacacgattggtttcttctgagggcctctctcgtctgcttgtcgatggccrtctcctggtgttttcacatggtcttccctctgtgcgtgtctgtgtcctgcttttgtcttagaaggacaatagtcatgtaggattagggtccacccatatgacctcactttaccataattacctctttaaaggccctgtgtccaaatagagtcccattctgaggtactggggtttaggtctctaacatgaacttgagggggatgcagtttagcccataacactaactctgacccctctcacgagcatcaggcctgcagatccagctccccctcccactccccatgtctctctctacagcgtgtcccaaagagayccytcctggcccccttaccattccttcctcctgctttcccgatccagatcagggccttgggatcatctctgactctcccccatcctccttcccatcacttggtcgtctgttgaattgtctgcacatcttctgtgtttgcctgttccttcatattgccagtgccatggtttgagccactaacattcccagacacttctgcctggtcatcttcctctccagcagcccagcttacattcacttgccttactaagcagagctccagctctgtccttcccttgcctgggaagcttccattgctccccactgctgtagggtatcataacggtcttgtgaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgyggtcccaactgtctctttcctaacagctccccaggcacccacacttttctgcctctttttcaatctgtacccttgaccctcctcctttttctgctttgtcagactccttaaggcacttcataaattaaccatttccagggatttcccctcacacatgagttattccagtggacagggcagcctcatgggtgcctgtggagggtgaagggtctgcctggccgtaggtgtgatcacacactcccgttgtaacccctgyctcctgtgacacttgctgccccacgatttagctgctttgtgttccgtgcctcctgtttgctggtgaactcctgagttggggggcgtcattccctccactgtagttcttccgygatgctgamtccacccacggtcagcaccactcggaaatacttcacagtcctgtagaggaagacaggtccaggtttccagttacccttctatgtctggatactctgctcattcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgyggggtggccaggtgaaatgcagctgacggctctgcgaccaaatgtgaccaaagggccacattcccagyacccggctccaaaggcagagcttggattctatgcccagcacaggttttcagggcttcctcctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagyagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcgtgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtwaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccacgagaagggctatgtccaatccaaggagatgattgacatctattccacccgagagccccagctagccttccaccagcgcatctccttctgcctagatatccacaayatgtctgtcaaggtgagaagcccgtggctgcagagtcacrcctggcagcagcacacccctccctccacactcatggattcctcagagaagactggcttaatttgtggcccacgtcccagccaatctctgtaaaatcactgagctgcagcacagggggcccagaatggggaggggacttggccatarttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcsctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggcwctttcccccttgggggtcccctgcccagggcactgtccccattttcccacacacagctcatatgctgcattcgtgcagggggtgggggtgytgggagccagccaccctgacctcccccagggctcctccccagccggtgacttactgtacagcaggcaggagggtgggcaggcaacctccccgggcagggtcctggccagcagtgtggsagcaggaggkgaaggatagttctgtgtactcctttagggagtgggggactagaactgggatgtcttggcttgtatgttttttgaagcttcgattatgatttttaaacaataaaaagttctccacagtgctttgtgcatcagttactatacttcactgcagtattggcaggctcagattttgggttttttggccttagagtactagccccaggtgtgtaatctgagggcgatgggtctgcagatggggaggtgcccaggggaggatgaagggaccctgacctggggtcgggggcctaggtttactctcttttcgtacttgtgtggctttggtaaggtcttgttaggaaaggtgtaccatgtgtccatcaccagctgcagaccttcatctcccaatacacctcatggtgcttcacggttattgcagtttttacaaattgaaggtttggccaggcatggtggctcatgcctgtaatcccaacactttgggaggctaaggtgggcggatcactaaaggtcaggagtttgagaccagcctggccaacatggcaaaaccccgtctctactaaaaataaaaaaatcagctgggcatggaggcaggcgcctgtaatcccagctacttgggaggctgaagcaggagaattgcttgaacccgggaggtggagcatgcagtgagccaagatctcgccactgcactccagcctgggcaacagagtgagactgtgtctcaaaagaaaaagaaaaggacaaattgaaggtttctggcaacactgcatcaagcaaatctgtcggtgccattttcccaacagcatgtgctcacttagcgtctctgggtcacattttggtaaatcctctcgatatctcaaactttttcattatatctgttatggtgatgtgtgatcggtgatctttgatgttactattgtcattgttggggcaccacaaattgcacccatataggatggtgaacttagccgggcacggtggctcgcgcttgtaatcccagcactttggcaggccgaggcaggtggatcacctgaggtcaggagttcaggaccagcttggacaacatggggaaaccccgtctctactaaaaatacaaaaaacagccgggtgtggtggcaggcgcctgtaatcccagctacttgggagactgaggcaggagaattgcttgaacccaggaggcggaggttccagtgagccaagatcgtgccattgcactccagcctgggtgacacagtgagacattgtcaaaaaaaaaaaaaagatggtgaacttaataaatgtcgagtgtgttctcactgctcacactgctcactccattccctgtctctctccctcttcttgagtctctccatgccctgagacacaaaataatattgaaattaggcctgttagtaaccctacaatggcctcttaagtgttccagtgagagaaagagtcattggccaggcctggtgactcacgcctgttatcccagcactttgggaggccaaggctggtggaccccttgagctcaggagttggagatcagcctgggcaacacaatgaaaccttatcgctacaaaaaatataaaaattagctgggcatgtggcacgcacctgtagtcccagctactaggaagcctgaggtggaaggagcccttgagcctgggaggtgaaggcagaggctgcagtgacctgagatcctgccactgcactcccacctgggcgacagtgagaccctgtctcaaaacaagaaaacagaaaaagggagaaagaatcacacatctctcactttcaatcaaaaggtcaaaatgattatgcttagtgaggaaggcatgttgaaagctgagagaggccaaaagtcaggtctcctgcaccaaacaggtagccaagttgtgaagggggagttctttaaggaaattaaaagtgctgctccaggttgggcacggtggctcacaactgtaatcccagcactttgggaggctgaggcgggcagatcacaaggtcaggagttcgagaccagcctggccagcatggtgaaaccccgtctctactacaaatacaaaaactagccaggcatggcagtgggcgcctgtaatcccagctactcgggaggctgagataggagaatccttgaaaccggaaggcagaggttgcagtgagccgagatcacaccactgcacttcagcctgggtaacaaaagcgaaactctgtctcaaaaaaaatgttttaaaaagagttcgagaccagcctggccaacatggcaagaccccatctctactaaaaatacaaaaaattagctgggcgtggtggtgcatgcctgtactccgaactacttaggacgctgaggcaggagaatcgcttgaagtggggaggcggaggttaccatgagtcaagatcgcaccactgcactccaacctgggtgacagagcgaaattctgtctcaaaacaataaaaaataaaaatgataaattaaattaaaagtgctgctctagtggacacacaaatgatatgaaagcagaatagcattattgctgatacggagaaagtttgagtctggaaagaagatcaaatcagccacaacattcctttaagccaaagcctagtccggagaaaggccctcactctcttcaatcctttgaaggcagagagaggtgagaaagttgcagaagaaaagtcagaagctaacagaggttgttttgtgaggttgaaagaaagaagccgtctctgtaacataaaagtgcaaagtgaagcagcaagtgctgatggagaagctgcagtaagttatccatcagatctagctgatctcactgacgaaggtggctacactcaaaaacagactttcaatgtagacaaacagccttctattggaagaagatgccacctgggactttcatagctacagaagagaagtcaatccctggcttcaaagcttcgaaggacaggctgactctcgttagggctaatgcagctggcgactttaagttgaagccaatgctcatttaccattccgaaaatcccagggctcttaagaatgatgctaaatctattctgcctgtgctctgtggatggaacaacaaagcctggatgacagcccatctgttcccagcatggtttaccgaacattttaagccactgttgagaccaactccttcgtcggctctgtcggccaggctggagtgccgtggcatgatctcagctcactgcaacctctgcttctaggttcaagcgattctcctgcctcagcctcctgagtagctgggattacaggcatgagccaccgcactcggccaaaaaaaatattttttaaagttattactgctgattgacgatgcacctgattacccaagggctctgatggagggataccagggaaataatattgttttcattcctgctaacacatccattctgcagcccatggatgaagaagtaatttcaactttcaagtcttttttaagaaatacattttgtaaggctagagctgccatagtgattccgctgatggatctgggtaaactgaaaacttagaaagcattcatcattctagatgccattaagaatattcatgattagggccggacgtggtggctcatgcctataatcccagcactttgggaggctgaggcaggtggataaactgaggtcaggagtttgagaccaagctggccaacatggtgaaactccatctccactaaataaataaataaataaataaataaataaataaatacaaaacttagtcaggtatggtggcacgcacctgtagtcccagctactcgggaggctgagacatgagaatcgcttgaatccgggaggcagaggttgcagtgagccgagatcgtgccaatgcacttcagcctgggtgacagagtgagactctctcaaaaaacaaaaaaagaatattcatgattaggccgggagtggtggctgacacctataattccagcactttgggaggctgaggcaagaagatcgcttgagcccaggaggccaagagcagcctgaataacaaagtgagaacccatctgtattaaaaaaatttaaaaattaggccgagcgcagcggctcacacctgtaactccagcactttgggaggatgaagcgggtggatcacttgaggacaggagttcgagaccagcctgaccaacatggtgaaaccacatctctactaaaaatacaaaattagccgggcatggtggcgctttcctgtaaccccagctatttgggaggctgaggcaggagaatcgcttgaacccgggaggcggaggttgcagtgagccgagatcatgccattgcactccagcctgggtgacaaaagcaaggctccatctcaaaaaattaacattagcaggagtttgaaagaagttgattacaaccttcatgggtgactttgaggggctgaagacacacttcagtggaggaaaaaactgcagatgtagaaatagcaaaagaactagaattagaagtggaccctgaggccaggcccactggctcacacctgcaatcccagcaatttgggaggccagggcaggaggataacttgagctcagaagttccaaaccaacctgggtaacatagcaagacctcgtctctacaaaaaaaaaaaaaaaaaaaaaaaaagtggagcctgaagatgggactgaattgctgccatctcatgataacatttgaacagatgagttgcttctatggatgagcaaggaaagtggtttcttgagatggaatctactcccggtgaagaggctgtgaacattgctgaaatggcaacaaagatttaggatattacatatacttagttgataaagcagcagcagtttgagaggattgactccatttctttctttctttttttttttttttgagatggagtcttgctctgtcgcccaggctggagtgcagtgcagtggcatgatcttggctcactgcaacctccacctcctgggtccaagaggttctcccacctcagcctccccagtagctgggactacaggtgcacgccaccacgcccagttaatttttttctatttttggaaaaaatggggtttcaccatgttggccaggctggtctcgaactcctgacctcaggtgatccacccgcctcagcctcccaaagtgctgtgattacaggcgtgagccaccgctccaggccagcattgacttcaattttgaaagaagttctactgtgggtagaacgatgtcaaacagcatcatatgctatagagaaacctttctagaaatggagagtcggccgggcatggtggctcacacctgtaatgccagcactttgggaggccgaggcgggcagatcacctgaggtcaggagttcgagaccaacctggccaacatggtgaaatctcgtccctactaaaaatacaaaaatgagacgggcatggtggtgggagcctgtaatcccagcttcttgggaggctgaggcaggaaaattgcttgaatctgggaggcggagcttgcagtgagccgggatcgtgccactgcactccagcctgggcaacagagggagaccccatctcaaaacaaaacaaaacaaacaaaaacacaaaaatgaaaaaagaaaagtcaattgatgcagaaaatttcattattttcttattttaagaaattgttttcacctgaaggcactaggaaaaataaaaacaaaaataaggaaaaaaaaaagaaattgctacagtcaccccaaacttcaccagccaccaccctgatcagtgagtggtcatcaacatgaggcaagacccttcactagcaaaaagattaggacttgctgaaggcacagatgattgttagcatttttagcaataaaggttttttgttttgttttgttttgttttttgaggcagagtcttgctctgtcacctaggctggagtgcaatggtgcattcttggctcactgcaacctctgcctccggattcaagcgattctcctgcctcagcctcctgagtagctgggactataggcgccagctaccacacccggctaatttttgtacttttagtagagacggggtttaactatgttgtccaggctggtctcgaactcctgacctcaggtgatccacccgtctcggcctcccaaagtgctgggattacaggcacgagccactgcgcccggccaattatttttaaattaaagtat

SEQ ID NO: 12570 - DNA, 100477 bp, Homo sapiens
cctccgtctcccgggttcaagggattctcctgcctcagcctcccaagtagctgagattacaggcatgcgccaacatgcccagttgatttttgtatttctagtagagacgggctttctccatgttggtcaggctggtctcgaattcccgacctcaggtgatccacccgcctccgcctccctaagtgctgggattacaggcgtgagccactgcgcctggcccaatcagcattttctaagtaccccccatgttccctgtgcggtgccagaccaaggctgaggatgatacagagatgaccaagactccacccatgcgccggagttgcttacaatctaatgggggaacttgcgtagggaacctctttctggcacagatcaccgtgaagaatccttgcccagagacacagctaaggggcccagcaaggtgagtctccaggctccttcctcagagaagccctccctgactctcaggcatccagaggcctctgtatatttcctttatcacagtatgtaattacagaattatgtgtctgaccatttatttagtatccatctcttctactagacagtaagcctcaggggcatgtctgcattttcaccagtaactccagagccttgcacagtacctgatgcacagcagatactcaagccagttcatctctgttaattgaattattggatgtaactttggttcctgcacccagtccgatctgggcaagggctggagacttgaaggccatcattctcttgggttaggctgacccctcctgttccttcctccctgcaggctgcctgccagacttcagtggatggaatctcaggccgctgctaactgatgttccagtctgaggtcaaccagaaactttggggttttgcatggtcaacatgggtggaaaatcaagtggctatttattacttttctatggttctctagtgggagcagtggctgctatggacagtgagattgacaccattctcccaacccgttgctgagaagctggactgcataccttggattcctgcagacagcacagcagaagaagctgctcctcactccatggccgcaggcatccttcttggagacgtcagggaaatgttggatatgttgcagatttagtgagtggaactctctccctctcctcagccctcagtctctccgtaggaataatgtgtgtgtgtgttgggggggcagattaagagacccctgaggctgggcgcggtggtttacgcctataatccagcactttgggaggctgaggcaggaggatcacttgaggtcaggagttggagaccagcatggctaacacggtgaaaccctgtctctactaaaaatataaaaattagcttggtggtggtgcacgcctgtagtcccagctactcgggtggctgaggcagaagaattgcttgaacccgggaggtggaggttgcagtgagccgagattgtgccattgcactccagcttgggtgacagagcgagacaccgtctcaaacaaaacaaagcaaaatacaaaaattagccggacgtggtggcgggcgtctgtaatcctagctactcgggaggctgagacaggagaatcctttgaacctgggaggcggaggttgcagtgagttgagatcgggtcactgtactccagcctgggcgacagagagagactccgactcaaaacaaaaacaaaaacaaaaaaaaaaacccctggaattgctcttcatttcctcaaacctccttccaccctcaggctttttagcccctcagccatttttgtcccattccctttgggcaaaggagattctagcaaggtgaagaaggtgggctcaaggggaggagggcagaggcaaaaactggaaggggaaatggaggaggacaggacgtcccagatagggacagccctttgcactgcagggattccacttctcctcgtcttcccattccctctgagatgctgactctgaccacagctcttggactttaagccaccccacagcatcccctttacttctagtgtccttccaatttgaatcccactcctcccaaatataccagattcctaaaggggctgcttgtttgtctttgtgtaatgatttttgttgttgttgttattgttggagtctcgctctaccgcccaggctggagagcagtagtggcgcgatctcggctcactgcaacctccgcttcccgggttcaagcgattgtcctgccccagcctctcgagtagctgggactataagcgcgcaccaccacgccctgctaatttttttgtatttttagtagagatggggtttcaccatgttggccaggatggtctcgatctcctgacctcgtgatccgcccgcctcggcctcccaaagtgctgggattacaggcgcgagccaccgcgcccggccaggattttaaaaaaaatactgtattaggatttttataaggctgtagtaaatgctattgaaaaatgcttacctcttatttcagccttctcctctgtctgttcctcaaactggcttttggtttgagagaaggggaggagcgaccctggggttggaaaagcccaggagacaagatggagatccagtctgttcatctgtacatccctggacctggggcggtcctggggacagtccttttctcaagccagtcagtggacatttgggggagagtctaggcacggatatagaggacccaatattcctttttttttgagacagagtctcgctctgttgcccaggctggagtgcagtggcgcgatctcggctcactgcaagctccgcctccagggttcacgccattctcctgcctcagcctcccgagtagctgggactacaggcgcccgccaccacacccggctaatttttgtatttttagtagagacggggtttcactgtgttagccaggaggtctcgatgtcctgaccttgtgatccacccgcctcggcctcccaaagtgctgggattacaggcgtgagccaccgctctcggcccaagattccttaatctagttggttttccgaaagcgtggctatgaaggaagaactcaggagttctagccattcccattgtattttgtgtttttttcagtaggtatcccgacgcaaccctcagattaaaactttaagggaaaatgaagaccacacccctattccatagaaattaactctaatgacaacgtagtggcgtggcgggggtatagctcagtggtagagcatttgactgcagatcaagaggtccccggttcaaatccgggtgccccctctgtgctccggagttacctcgttttgttggtctccggaggtcctctaaagagttcccgcacagatggaatgggagggagtctcgagccctgccaccctttttgctttcgcaggcgagtgaggatggagtcctggcccctgccagtggctcagcctgtgtgtgtacccagggtagaatgcaatgcgagtgagggcgaggagctccgggctgacccttggaacacggtacgggtggctcaacctcgcaatggcagggcggaggcgagcgcacccccaggtcagcctggctctttcttggcgggaaggaggctgagtttctaagggctgggctggggaagacaggtcgggagaagccgcgtgagcatgtgggagggagaaagaagctccgagacgtggcaaggggtcttctgcagggcaggagagtgggacgcccccgaagtgaaatatttcgagagacttctccttccacaccccaggaatatattttcttatactgccagtggggatcttcagctcagagcttcagggaacaacccctgcttccaagtgagtaattcttctgggagttgtattttttccatctcttgtaaacgtcttaccccacttccacttcccttcgggaacgccacacagcgcctgcgcagcaataccactaagcgactacgtgcggtcggtttgccggcagagggggtatagctcagtggtagagcatttgactgcagatcaagaggtccccggttcaaatccgggtgccccctctttggccttttcgagatactgtttttgtcctgggtgtcgatttttcctaagctgtttgcttttactcctactggcagacgaggagcagtgagggactgaaaggaactggggattcaacagcagtggctctcaaaatgtggtcctgggaccagcagcattacctgggtacgctcgggcctcatcccagacctaatgaattagaaacttgagggtggagtccagaaatctgtgttttcatatacgctccccatcgcttgagtccaggagttggaagctgcagtgagctatgatcgcagcactgcactccagcctaggcaacgtgcgagaacctgtttcaaaaaacaaacaaaatacacacacacacacacacacacacacacacacacacacacacacacaccctgcaggtgattacgatctcaagttctagaggcttacgttaaaatttacacatttgcttctactatttacaagtttatgtttcagcctgagctcttcttgtaagacagaccacgaggtaccccagatggaggaatgtgcaaagacgccggggctggagctggaatccgtcccgagacttctcaccttgacctcgaggaaggcaggaggtcggagacagggggtgggcaggccggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtcaggggagggaagaggcatcttcgtgtcctgacctgattccttgccgtctattaaatatcctacattgcgggtatttttattctgtcctggaagaaaaaataaaaagattatctatccccagagcctgtcagaaggtggtgacaggtggggtgagccatttcctcgtctggggctggctctgaagattgattgggtctggccctgagtaggcctggaggccccagagaggcaggaggcctgggttacctactcgtggggaggggtccagactgttgcagagtaaggggtagccaggccccctccaccctcacgtctgctaggcttggggggcaaatcggtgctggaaatggggggtggagggataaggtggagtcatggaaggggggtgggattcaggcccctcttggggagaaaagctgggggtctttgctgcagggggagatttctgggggtgggggctggaggacaaagcatcagagacgcacagaattccgaagaacagctcaggaagtcgcagagcttggaggagctgggggcgggggacagtcaggggcccgtgacccagggatggggcgcctgtcccttccaggggtccagtcctcgggccttctctctgcagctttcccggcggaacggaggagggaaagggagccaggagctcagtgaggagcgcggggcggctgatgcttctaggggttctctcagcccgaggggctcccgccctgtcccctactctgcaccccttgccttgggagcggctgcagagctctaggggagcgctccgttagggctgagggcaggcgccgggagagcccccaacgacgccgcgccccccgccccgccccctgccccagctcccccccacccccaccgacccagcggcccccccagctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtaggactggcgggagccggcccgggtgggccgggggcggggagggacgggcagtcaggtgtgggcatgggcaggtgtggacggcctggcgatgtccgcgaggggggcattgtccgcaggaggccaggagagctgtgggctgtgggcaggtggatagggaccccactttcccaaacacatagggrgtgtgagtgacggtggagacaccgatgcccggacctctycttctctcctggarggatactggagggaccttaggagaggcggctctatgtggccatgggctctgaaaggggacagcgggagagtcatcaggacccctgatcaccccaggcaaggctgaattctgatgagatgggagcctggggaggcccctgccccagccatgccttcttttcctcttctctgccacacccccgaccccaaagctgatccaggctagggataggtgggagcagccagggggatggtggggacacagcgtctctgcctgggaaggcagcagccattcggtcaccttcccttgcctatttggtgtcagtagagaggcagtgggcccaggaagaagcaacttgctgcttctgcacccccagcctcaagagtccccctcctcacacctgctcccatttgccctggcagcctttggctttcagctactctggctctagatggggcactggggtagggggtrgagggaggcgtcccattctgcacactcctcttcccccctaccagttctccaaactcatctctcccacctggaagtcctttctgagatctacctggaatccctcatggtataattttcatagtctctgttctcccctaagcacctagactttctctggggttggggagatgggtaatttgcagcctggcccctcagcagagatgattaagaagatagatacctgtgcatcaytggcatgggtgcccctcaggtggggtgagggaggcgctgttgaggtgagygctgtggttgacctgctgtgtctcaggagtgtgctggcaccaggcacagtgtcagtggcaatgttcttgactttaatggtcccagcatgtagctgagacagacctgggtccctattgagaagaagagtatgttgggggtgggaggggaaggaggctgacagtgggaagtatgggcagagggcagtggagctgaygaaccgagaagctgctggtgagaaccaccaattttcagggagaccacacagagggtggccagagacgtggcttctagtcccgccatctcacttgctgtgtgactttagrcaagttactttctctctctggacctatttttgcatttataaagtgaggctgttggcaaaatctttgactcttgtgcgtggaataatgaaggatcttttataattgcctttccttttcatatttgttagggtctttatgggtaactgrtactttaaaaaaatcaaggtaaacaggasagagttrgatatgttatgaataatttctgggctcctttgaatcctcaacctggtgtgatcttctgaactctgggtgtaacagagtttatgaggggaggatctgaacctttggctggattgtgtgaaccacggagagggctggggaagggggaattgggaggtaacaaggatgggctgggagatagtggccagaccygggcctggctgagggcrgccccttcagagtagggttggggtagtagacggttgaggagaccaggaagagtggggcaggcagagacttgaatcacttctctaagtagaggcyatcctgtcttcttgrctttgacagagattgagccaggagaaatgcactttttctgcagcaggagggatagaggttagacttaaggaatctgtaagaagccagaggcggcagctgttgactcccagtccggtgcycttttcacaggccaggtgggatttcacaggcaggaggacctatgaggaggaagcgggtgtctggggaggccagatgtaggagaaggacrttctgggggagagttgctaaggaggggcagcctgacctgattgatggcggagttgttgtgaccagtggaagggcagctgggagcaggacctgaagagatgctagcatccttccccaaggctctgggtttgtggggctggtggggggccttgggaagtagctgagatctcccctcgctcctgatggacaggcttgtttggtagagccttgaaacctcatctatcrttagaacagyagcagcagagagatgagtggcccaaagacagagtcagacagcaggggagaccaggatgacagacaggaaaatggccttggggtgcagagcaggggccmagggaactgacagtctggtcagatggaaccagaggtgcatatgacagataaagaagaggcagcgagagttggcatcctggcctgggagtcctgcaggaggccaggctcaataccaactactggtgaccctgacagcttcctcctttctctgaggaaggtttccccgtctataaaatgggggcttgcaccagtcacggtggctcatgcttgtgatcctaacactttgggaggctgaggtgggaggatagctttagaccaggagtttgagaccagcctgggcaaaatagtgagaccccatgtctataaaygatttaggccaggcarggtggctcatgcctgtaatcccagcactytgggaggccgaggccggcggatcacctgaggtcaggagtttgagaccagcctggctaacatggtgaaaccccgtctctactaaatatacaaaaattagtatatttagtattgttattaatattattaatattagtatattagtaaaaattagccaggcgtggtggtgcatgcctgtaatctcagttactcaggaagctgaggcaggagaatagcttgaacccgagaggcagaggttatagtgagctgagatcgcaccactgcactccagcctgggcaacagagtaagactctgtcaaaaaaaaaaattaaaattaaaataaaaaattagctgggcatggcggtgtgcgcctgtagtcccaggtactcggaaggctgaggcaggaggatcgtttgagcccaggaactggaggctgcagtgagctatgatcatgccacatagtgagggcagcataacgaggtcccatctttttttaaaaaaaggagggaaggaggttggaccagattgtctctagggctccaacaacctgagactaaaatgcgaacttatggaggtcaggcagcccctccctcatcccaccatcttctctagctctccccagattcaccccttaacccactccagctgccgtcccctccgatcgacagataactaactggcttcttctcattcaggtcttaatcagctcaagggraccctcctcagagagccccacctcatggctctgtgtagagtagcaacaaccccaaccctttcctctgtctgattttcttcatagcccttaccaaatgattcattttgtatgtctccatgaagaaaactagactcttcctgggtacagggcttgtgtccccccagcacccagcacagtgcctgcgactcaataaaagtgtattgaatgaatgagtgagtgactgagtgagtatatcagaggtggcacagatcccagactctcccctcaagggacacacatagagagctgaactcttcttgctgtccctcccttcccctcccctccccttccctccctccctcttcccttctgctacctggtggtccctccctgcacttcctttgactccttccctctccccaggtgagggtcctcagtgggtccctacctgccagaggaaagggagagggtatggttaggggctttgtaacttggaggcaggatttcagtttagggtttggagccttccctggcccctctgaaagctggtcctgtgaccctaacyggtgtgttgcccaaggtgcagcaagttgacacaccaacaccgagggggcagcagagaaagagtttcatcatcgtggggcagcatttggggctagaggttttatggggtttggggtggggtggccaacgtgtgggaattgttaattggttgaagagtgcatgaagaaataaagaaactgcattctcatgttaaatcagttcctcggctgggcgcggtggcccgcgcctgtaatcccagcactttgggaggtcgaggtgggtggatcacaaggtcaggagttcgagaccagcctgcccaatatggtgaaaccctgtctctactaaaaacacaagaaaattagctgggcgtggtggtacatgcctgtaatcccagctactygggaggctgaggcaggagaattgcttgaatccgggaggcagaggttgcagtgagccgagatcgtgccactacactccagcctgggtgacagagcgagactccgtctcaaaaaaaaaaaaaaaaaaaaaaaatcagttcctgtctgagggtcttcgaattggcccttctgctggaattcaggatccgaaaaccatcttaatccttcttttttttttttcttttttgagacagggtctcactctgttgttcaggctggagtgcagtggtgtgatcatagctcactgctgcctcaacttcctgggctcaagtgatcctcctgcctctgcttcctgagtagctgggactgcaggcatgcaccaccacatctggctaattttttaaaatttattattaataataaattaaattttataatacctttttttattataaaaaagacaaggtcttgccatgttgcccaggctgatctccaactcctgggctcaggtaatcctcctgtcttggccttccaaagtgctgggactacaggcatgagccaccatgtccagactttaaaaaaaattttagtagagatggggtcttgctatgttgtccagtctggtctcgaactcctggactcaagtgatcccaccacctcaccctcccaaagtgttgggattataggcatgagccactgcacctggccttaaacaattcttaaataaaagctggccaggcgtggtggctcatgcctataatcccagcactttgggaggccaaggcgggagcatcatttgaggtcaggagctcaagactagcctggccaacatggtgaaaccccatctctgctaaaaatataaaaattagctgggtgtggtggcgcactcctgtagtcccagctacttgggatggtgaggcaggagaattgcttgaacccgagaggtggaggttgcagggagctgagatcacaccaatgtactccagcctgggtgacatatcgagattccctctcaaaaaaaaaaaaaaaaaaggaatgggccgaagtgcagcctgattaatgcttaattactcctatacttctgcccagaacccggcatgtaattcttgttaaccctgagaagacggtttcagtcctcatgtgaaacccagggaaggcagggcgacttgctgggtgctctgtgtatatgattttgttaaagtgtcaaacctaccaagtttatgttttatcagccccatctcacagatgaggaaactgagtcttagagagtrtgtgtaatttgtccaatgttgtagttagtaggtggtagattcagggttcagtgtctagcttgtctgattccaaacctgtgttgttttactgctctgatactacaatgaagttccaagggaagggtgtttccagttcggtgtatctcaggtactcagggcatttaaagatgctctcccttccctcccctcccctcgcctcctttctcttctcctctttttctcagcctgtgggacaggatgagccagggacaggtgagctggaagccggagagagatggaatcaagttcaccctctaggtggcttgtcctggctatggtgggggagattagctctagggcattaagggtggaggctgacccaggatagaggctgtggtaacctgagctatggggtggcccagggctgggatgccaagtttgggtgttgggtgagatgaggatggcttggcccaggctctggggccgcacaacctggcctcctgaggtcagccccattcccccttgccctgaaatgggaccagtgccagctgaggggactgggacrctactgctgggctgtaccctgcatgctgggggacacagtctcccagggaagctctcaggttcaggcccaatggcagcctgagtagggccctccaagaacctagmccacatgccagccccaccccggggctgcccctgcaccctgggaaacagtggggattgtcggtcactttttactgcactttctgtggttctgagtaggctctggagccagcctgcctgagttcagatcctgccatggactggttctgtgaccttgggaggttccttaacgtctttgtgcctcagtttctccatttgtaaaatggattttaaactagtaactatttcatgggattattgtggggattaagggggtggatgtgtttaaagcccctggaatagtgctagcacagagcagcattctctgaaagtcagctatcatttttattactagggtgattattatggcatcccactggactgcacactacttggggccatgagtgagtgaatcaatgaatgaacagcttgtgttccggaagctccttggcaacacatgcaggcggggaacgggtccagggaaaatggagctctctccagtggaaggcaggtggggtgaggagtggctgagggttgggcaggtgtccaacttgtgtgtgagcacatacgggaaggccgaggctttsaggaaagtctttgtgggcatgtgcacaggcacgtgggcccctgcacatacacgtgagcaaccagctgtgttggcttctttcatgagtcgtggggatgacgtcctgtcccaggcaacagggaaggaagggtggccaggaaacagatgtagtatgggttggaagagtaagattcagggctaggccagggtaggccagggtcctggtcaagctccctctccatccctcgccctgccctctttcatggactctttacctcttaccctggcctgagctctctataaaacctcatttgtgtttctcacttgacgcttatggcagcctgtactgtgggcaccatcgtcaaatccatttgagtcactagggagctgaggattagagaggaaaactgatggggctaaggtcccataacttgtgagtggcaagactgggtgtsgaggtcaacccagtgtctcttccctggccacccccagctgggccccctccctgtccttccccgkgctgcaggcctccaccatcccrcctcctgtctcggctccaggtttgtgaatcctgaagatccccaacactcctctctgggccgctgagcccctccacttgttcactacccgctctatcctgttctggctcctgcccaggccccagggctgcttgcaggaagacctggggagctgggcagaccagcccagcacaaacarctctgtctccagaagcagctgtgggccccacccaagagagaccagacagccctggcttgggcctgggcagtgggcaggctgcmttcccagccctggactcatgtccatctgtgggcagccagtgggcatcttggggaaggggtctggggactgccctcctccccacgtgctccagcagcatctggttgctattaggggcagagaagtgagagggggccggcaagggtccagtaggcgccagcagccaagaatgacttaattggatacaatgtctaatgacaaagcagggccccacagcggagttctggcctcagccccaggcctgggcctggccaagcctggtctcaacctctgyccttgctggctcccaggagctaccctatgcactgcgtcctcaattctgcagtgatggagcacctgctgtttgctggacatgccaaatttgaagaaggtggagagaatcctgggggaactcaaatctaccagggagataggcacatagtcgcacacgtaggtgctctaggagagggagagccacatccaggagctctggggagtgggctgggggaaggcakaggttgagacaggtatctgacacagggtgggcctgaaatggaagagggtcataggtggggaatgtcagatccacctatctgatggtctgttctcatatatacatccatagtaggtgtgaccattagaatgacaataaaagccacagctttggggggcataaatctttttgaagtggaaaaggatggtttttgtgttgtttatttatttatttggagaaggagtttcgcttttttgtccaggctggagtacagtggcgcaatctcggctcactgcaacctctgcctcccaggttcaagcaattctcctgcctcagcctcccgagtagctgggattatggrtgcccgccaccatgcccggctaatttttgtatttttagtagagacggggtttcgrcatgttggccaggctggtctcgaattcctgacctcaggtgatccacccacctcagcctcccaaagtgctaggattataggtgtgagccaccacgcccggccttttgttagaactaatttaacagacctggtgcagtggctcacgcttataatcccaccactttgggaggccaaggtggaaggaccgctagagcccaggagttcaaggccagtgtaggcaacatggtgaaacccagcctctacgaaaaatacaaaataaaataataataactagccgggtgtggtggcatgcaactgtagtaccagctactcagaaggctgaggtgggaggattgcttgagcctgagaggtcaagcgtacagtgagctgtgattgtgccactgcactccagcctgcatgctagagtgagaccctgtctcaaaaaaagcatgcatttaacaacctagaggrarctggagaggagatcrtggaacctaaagccatttcgcaacctccagaaatggaggttcgcatggccgcgaaatggcctgtgtgtagtcactttccaatcctgtgcccatggcagacattgcttattgatcttcacagtccttcctgctaaatacaagaggagcctttgcattctcagttggagtgcctctggctgtcacgaatggattgcagatggcatgtgatatgaaacctatttgccatcctagacagtatctaggtagtgayaggagtaaaacagtaaaaaattacccctccctcaatggggcaagggggggttaattttattccccaggggatatttggcaatgtttggagacgtttttcattgtcacagcttgggatggggaggagcgtggtgctactggcatttagtgagcaggggccaaggctgcggctgctaaacatcttacagagcactggacagttcccgcataacaatgaattatccagtccaaccaacaatccaatttaaaaacaggaaaaagactkaaatagacatttctccaaagaagatatacaaatggcccacaagcatatgaaaagatgttcggcatcactaatcatcagggaaatgccaatttataaaaacgatgagatataacctcatacctgttaggatggctactataaaaaaaacagaaaataacaagtattggcaagaatgtggagagattggaacccatgtgcacggttggtgggaatgtaaaatggtccagtcattttacatggaaaacattttatatggaaaacagtatgacaattcctcaaaaaattagaaatagaattaccatacaatccagcaattccgcttctgggtatatacccaaaagaattgaaggccaggtctcaaagagatatttgtacacccatgtttgtagcagcattgttcacaatagctaaaacgtggaagcaaaacagacatccattgatagttgagtgggttagcaaaatgtggtatatccacacaatggaatattattcagccttcaaaaggaagtcaattctgccatatgctacgacatgaatgaaccttgaatttattatgctaagtgaaataagccaatcacaaaaagacaaatatagtatgatkccatttatatgagatacttagagtagtcaaaatcatagatacaggctgcgcgctgtggctcatatctgtaatcccagcaccttgggagccaaggcaggaaaattgcttgagaccaggaattcaagaccaaccaccctgaacaaaatagtgagaccctgtctctataaaaagtaaaaagattagctgggcatggtggcgcatgcctatagtcccagctacttaggaagctgaggtgggaggatcgcatgagcccagcagttggaggctgcagtgagctatgatcgcaccactactccccagcctgggtgacagagcaaggccccatctcttaaataaaataaaataacaggggtgaatagggagttattatttaacgggtacagaattttagttttacaaggtgaaaagagttatgcagatagatggtggtgatggtcatacaacattaggaatgtatttaatgttactgaattgtacacttggaaatggttagatggcaaattttgttatgtgtattttgccacaataaaaaaattggaaaaggaattatccagtccaaatgtcaatagtaccgaggttgagaagccctgaacgaaaagaactctggcttctagtcccctgaccccactgggaaataggattatgtgccatttctgccagagaaataagaaactggtttggaaggctcaacggcaatggttctcacccttgcctgcagagttaagtccaagactcctcaaaatctcccctgaggctcttttaagaaatcgaggctaggcgcggtggctcacgcctgtaatcccagcactttgggaggccgagacgggtggatcacgaggtcaggagattgagaccatcctggctaacacggtgaaacctcgtctctattaaaaatacaaaaaattagctgggcgcggtagcgggcgcctgtagtcccagctactcgggaggctgaggcaggagaatggcgtgaaccctggaggcggagcttgcagggagcggagctcgggccactgcactccagcctgggtgacagagcgagactccatttcaaaaaaaaaaaagaaaaagaaaaagaaaaagaaattgaatgcccaggctacaccatagaccagttacaagagatctctagggtgggacccagacatcaggaacttttgaagctgtccaggtgactccagtgtatagctgaggttgagaataatcaccctttggaggcagatcagcttgggtttgaaacttacctgcatgcctaacccactgcgtgacttttaacctctgagcctctgattcttgtttgcaaaatggagaacatcctaactactgcggagagctggcatgaggattaaaaggatatgtgcgaagtgcttggcctggagctgggcacgtgactctcagtacacattgggtgtctcctgtcctggtagtcagtcaagtgtctgcaaattctrcagtggcatggtgttggggcccttgcagaataactgggctggattcccctcctgatcttcattccggactgctggcactcaggtttctgtccccttctcccaggtcacgatgagggcccaggctctggatgggctgccaaagggaccgtgckgggctggaaccggagagcccgagagagccctgggcatgtgtcagagccggacaggacccagctgagccaggacctgggtgggggcaccctggccatggacacgctgccagataacaggaccagggtggtggtgagtgctggaggaacatggagggggagcgaagtgggggtgggggaggtctcaccagctgccccaggtgtgcttgtcctacatgcaaatcacatatcatttggggttggccccggaggacagggtggagagaagaatccccggggaggggatggaagcagggcccagactgggtcataaaatcacagcatctcagcgtttcataggctgcctactccctcctggacccagagacatcaaatggattgtatcaggatgcacagcctgaccacagcattcctgaaactggactctcccatgacttagggaagaaaaagctgacagtggccttatgagtcacatctcagctgccagatggggcccttccccaccccatttctgccccatctacagactggggcgcaagaggattaatggctgcttagcctaagggctgggcactcagcagggggctgagtagagaaagcaattagggtgcagctcctggagacaacctccttggcctggggcagttctggggtgctggcacagggaggagaggcctggagggagtgctcttctctcagggtttccrggaggctsttggaagcctcggtgtgtctgggggtgaatctattaatataattgtgcgtttctgggaatgggtgtgtgtgtcatggacgctgggttcgcacctgtgtcagatgattttgtatattatgtatgtgtacctgtctgtcactgtgggctgtttgtgggtgtctgtgatgagcatgtgtaagtgtgagtgtgcctgtggctgtgtgtgtaggtgcctgcggctgggagtgatgagggtggattcttaggacgcamgaagcaacaagaggaccttcttctcagtatagatttattttatattttaataactattttcttaaattagtatgtgctgacagttaaaaaaaaaaaaggttaaatagtgctaaaatcataaaacaaaacagcagtcctgcccctcctctcccctggggcctgcccccttccctttctcagaaggctctgtctgggctgtttcctctggagtttacttccatatttccaagggatttgcttatactgtactgctacctctctgtgcactggttttaggccgtacctattcatggcctgctgcggctcagggagatttggcttttgtatactcccgctgagcaacctttcaccctgccgcccaatcttcctgttcaatccgtgtgctcggttgtggattgtgacgatcatgtacatagtgttcacttctaatccaggcagggtcataacattgtttcttttcttgtatgattttggctcttcctggatcctggccccctctcctgcccttgcttacttagttttctgtgcctaccgtagctacattttcctacacgtcccctagcctcaaatgtaattccagtgtgggctgggcatggtggcccacacctgtaatcctagcactttgggaggcccagacgggtggatcgcttgagctcaggagttccagaatagcctaagcaacatagtgagacccacgtctctaaaaaattaaaacaaaaattatctggatgtggtkgtttgcccctgtagtcccagctacttgggaggctaaggctggaggattgcttgagcctgggcggtcaaggctgtgctgagctgtgacctcaccagcctgggaaaaagaagaagactctgtctccgaaaaaatataaaagaaagaaaataagataattcagggtggtcaaacctgtcagttcctttatcccccygagaaacttctctcctgtcctgcactccaatcccgcccagccactcgcctgctggtaccacgggtgccatcctggggcctccctttctgttcgtcctgggaacccctttgtctccctcctgtgttggatcccctgttcccttgaccctgtgtcttctctttcctgcttcatccttttgtttgtttagcttcctgggaaaggttgcacagagggaaaaattcccttgagaacgtgcatgtctgaagatatctttattctgtcctttcatttgactagtggtttggctgaatatagaattctagattgaaaataatttactttttcttttttttgagatggagtctcgctctgtcgccaaggctggagtgcagtggcacaatcttggctcattgcaacctcctcctcctcctgggttcaagcgattcttctacctcagcctcctgagtaactgggattacaggtgtgtgccactatgcccagctaattttttgtatttttagtagagatggggtttcaccatgttggccaggctggtctcaaactcctgacttcaagtgatttgctagcctctgcctcccaaagtgctgggattacaagtgtaagccaccgctcaaggccttgaaaatagttttctttcacaagtttgaaggcatctctccattgtcttctggcttctgattcactgttagaggcttggtgtgattcttatttttgacctttgtgtatgccggttttcccctgacttctggaagctctcagggtactccctgtaactccagcattctgaaattgcagtgacatgaccttctctggctgtttttgtttgccatgctggacgttgggggactgtttcaatcaagagactkacatttgtcagttctggawagcgtttttgctttatttctttcagatttctcctttcyacaattcctcatggttagatgtccatttctggaagtgatccttcaattttttcttctctcttctgctgtgygtctcttttgcattttttgttgtttatttgttagtgtgcttgttgttcttctttctggaggattttctcaatcttattttcataatgtcactgatttttttctctactatcgtattgttaatttctaagagctcttttttattttcagatttatttttctttaacaaaaaagcatcctgttctttttttgtggatgtaatatcttctctctctgaggatattagaacaattttgagatttttttcccctctgctctctgcattgtttctgttactgtttttttccttgtatctcaggctctgaaatggtttggaaccatgactaaacctgtatttctttaaaactttgggccgggcacrgtggctcacgcctgtaatcccagcactttgggaggctcgaggtgggaggatcccttgaggccaggagttggagaccagcctgggcaacataacgagaacttgcctctataaaaaacataataaacttttgatattctgttcatcaaaatattatttttttgtattcattttgattttttaaaatattgcattgaagtattctctatcttgattcctgagttttggtgccatcttagatgttgtaccccaggtaggtgcctccttacctcaccctagtttgggctcctagtttgaggtggaacttcaggggacatggcatcactcccttcccaatctgccctgtcttcttgatcctgcagagcaaggagcaggactgccatggtgagatggtggagtggaaggacagagtaggagaggcccctgattaaggagacacctggcagttcatccctgaccccacagctttattgggccattggttgaataactgataacctgctcaggaccagacacacaggtcagaaggattatgtcccagtctgcacaaagaggacctttcagaaaagagccatggagacttagatttctggaagcaattgttcgtgggtgttcagaaaggacagtggggttcattaagagccagtatggattcaataacgccagagcttaaaaaacaccacaaattctcaggctccaccctggatggactggttcagaaacactggggcaatggattttgggaatttgttgttgttgttgttgtttcaagttccccatgtgttcctggcgaagttgcagagatttaaaaatgtgattctgatggtcatgtaggtgtgggaactttttttttttttttttttkagacggagtgttgctcagttgcccaggctggaatgagtggtgtaatctctcggtttactgaagcctctggctccgaggttcaagtgtttctcctgcctcagcctcccaagtagctgggattacaggcatgcgccaccacgcccagctaatttttgtatttttagtagagatggggtttcaccatgttggccaggctggtctcagaatcctgacctcaggtgatctacccgcctcagcctcccaaagtgctgggattacaggcgggagccaccatgcrtggccaggaacttccgatctataagatttcaaaccaattttataattggtgacccgctcgattgtcagaacatgaggcttccaccatctcaggggctttrtgatcccctctgcagctacacatcgagggtccacacaggagcaaggccacctggaaggaggtccctctgacagccatagggcttgtccccggctctgcctaaagacaggaggaccaggctttaagggataacttatctggagagtgcagatgtcaggtcaggaacccgaaggcctcatgggcaggctggaatgacatctgcctyggaacagatgaaactactgggataaatataaatcctggcatttaagtttagaatgagttgggagagatgtggtttagcagcagctcacgaggaaaagatttggggatccccacttcttgtgggctaggatgagtcaggcgcataaagtggctgccaaggctggaggtgggaaagccagctgcatgatggaaacctggggactggggctggggctctgggggtcctgcgggctatttcttgggcctgactaccattgaggggcttgtgctcccytttcaagtggtttcccagacacaagcagagtccaggggagggcagctggggtggtgaagaggcttgcactcttgtccctggaggaatggtagaaggygtttggggtatttagcctggtacagagaaggttctagatgtggttgttttctttctttcttttcttttctttgttttttcttttttttttttttttttagagacaaagtcttgctctgtggcctaggctggagtgtgatggcatgatcttagctcactgcaacctctgcctcccgggttctagcaattctcgtgcttcagcctcctgaatagctgggactacaggcacatgctaccaagcccggctaattttttgtatttcagtagagacgggctttcactgtgttgcccaggctggtcttgaactcctgagctcaggcaatccacccgcttcggcctcccaaagtgctaggattacagacgtgagccaccacaccccgccaatgtggtggttttccagcagctgcagggctstgactggggcacagggaatagactttatttttttttcttttcttttctttttttttttgagacggagtcttgctctgtcgcccaggctgtagtgcagtggcacgatctcggttcaccgcaagctccgcctcccaggttcacaccattctcctgcctcagcctcccaagtagctgggactacaggcgcctgccaccacgcccggctattttgtatttttagtagagatggggtttcaccgtgttagccaggatggtcttgatctcctgacctcgtgatccacccaccttgacctcccaaagtgctgggattacaggcgtgagccactgcacctggcctatttttctccgtattacttatcacctcctgcatcaaattatgtgtatcagccagtcacagtggctcacgcctgtaatcccagcacttcgggatgctgaggtgggaggattgcttgaggccaggagtttaagaccagcctgggcaacacagtgacacccccatctccacaaaaaatccatttttaaaaagttagctaggtatggtggtgcacgcctgtagtcttagctacttgggatgctgaggctgtaggatcgcgtgagcccaggtgttggaggctgcagtgagccatggtcgcgccacagcactccagcctgggtgacagagcaagacccagcctcaaaaaaatagaaaagaatgatccatgtattggtgtctgttgcctatcttccccctggaatgtaagcacaggagagccgggactgtgcctggtccatgacaagcactcctttgaatgaacaaaggaagtagggttttcgacatcctagtctccaaaaacagggttgtagaagggaagagttctgcctggtgtgattgtccctggtgtgagtcactggacacaggagcctctaaggaccccaactctgctaacttggattcccacacacatgagagaatgtcagtgcttacacacaccagggtgtctgcacacgcccgagactcaggtggctccatacccaaactctaccctgccctcgtcctgttaggccttgttctgggtggtgttcacctgagaatgctggtgatacccccagcagccagaccgcaaacgccctttcccactatctgcccacccccaacctggagaatgggtggccctggctgggagtccggcacaggtgtccagagtcacctgtttctcccatgcctctgacagctcagcatcactgtggcctaaggaagtctcatctagatgatgggttggcggcagagggtgggcaagataagaggagagtggcgggaaggggctgtttcagcaagtttgatttggtctgtctcacagagttttcttgggtttcaacaggaacacttcctctgttcatctggtatcacagctgggtttggccaacagcaaccagrctctgggaccctctgctctggggcyytatcaagggactgagggctggcgggtgggctgccatgccttttgcctccccctacacaaaccccagtgccccatcacmttcctccatcrttcctcagtaaccctcctggctgcggacctcccctctggctcagcccccttgactcagctcctccatccagaccctctgcccagctgcctccattcagccctctctgcccagtgcctctgccaggcaccccccgccaggccatctcaccacaatgctccttccaattcagaacctcttgctttggaggcctcgaggcgtctagcctgccctcccagtcccagggtgagctggcagctccgaggaccctggtcagaaccatctcctccctaaaatgcattcccacacccaatctaccaccacatcacagtggaaacaggactcttgtccagactcaagatttccggagattttccaccaagaccaattctgaggccctggggacactgggcgtttcggggacgggrgcaggagarctggggaagccatagtgctgagtcaagagatcctgggatgtgctgagtcagagatcctgggatgtgctgagtcagagaccctgggatgtgccacaatttattctcaaagaggctggaaaggggaggtcttggcaaaggttctcttcctttgaggatttcaaaattctactccaatgtttacttggttccatggttcaggtttagagccagagtttgrgggaaatcaagcataagaacatttagatttgaggaggtgcccctccctttcaccccccttacctcccaatctcccccatggcccagcatccctgaattcctctctcttctctggctcragcaaaacctcctggcttgtacatcaccatagcaggccccaggaatgcgaggraccctgtgtcagggcagggaccccatcatccaagacagttggcagggagagtgcaagacctgcctggtttctacaaccttccaaaggaggcagctcccgaaaraaggttttcagaacrcagggccttgggagacaggaagccagtcagactcctcgcacaaaccacagrgggcaagcagtgctcctccaagaacctggccccaccagggtgctcaagggaacgaggtaaggaggccaatcccggaagattctgggagcagagttggggggtgggtggagggaggggaaagttaggagccaagttttgaagagagagaagataaaggttgtctgggcatggtggctcaggcctgtaatcccagcactttgggaggccaaggagggcatatcacttgaggtcaggagttcaagaccagcctggctaacatggtgaaaccccgtctctactaaaaatacataaattagctgggcatggtggtgcacgcctataatcttagttactcgggaagctgaggcaggagaatcgcttgaacctggaggtggaggttgcagtgagccaagatcatgccactgcactccagcctgggcgacagagcgagattctgtcgcctaaaaaaaaaaaaaagaaaaagagagaagagattctgtgagaagaaagcatgtccagggaggcaggaggtggagtgcagatgtcgtctccagtgctgtggaggagcccggcagtcctggccctcgatcttggtcctgacacagaccagctgcatagccttgggctggatacttaacccctcagttaacaaacctgacatttagagcccctccaagcccttgctagcttcacatttcccaaatgggtggtaaataccaatctcacagagttgatttaagagcagaatatgaggcccatgatggttcttggtcctggtggtctcccctccgcttcgggtcacaacactgctcccggctactcagccccaggtggttttctcccggtccggttcctcttgcaggccattttcctttctccttgggcagggtggtgtgttggttgattggttagtttctttttttcttttttgttgagatgaaattcacataatataaaattaaccattttaggctgggtgcggtggctcatgcctgtaatcccagcactttgggaggccgagttgggtggatcatttgaggtcaggaattcgagaccaacccggccaacgtggtgaaaccccgtctctactaaaataatacaaaattagctgggcgtggtggcatgcttgtaatcccagctgcttgggaggctgaggcaggagaattggttgaacccagagtggaggttgcagtgagctgggatcacgccactgcactccagcctgggcgacagagcaagactgtctcaaaaataaaataaagtaaaataaaataaacsattttaaagtgaacaattcagtggcatttaataaattcacaatgttgtgcaaccaaccccccatccagttccaaaaccttttctgttttgtttttgttcytgagaaagggtcttgctctgttgcccaggttggaatgcagtggtgggatcatggctcactgcagcctcgacctcctgggctcaagggatcttcccacctcagcctcccargtaactgggactataggcatatgccactacaacaggctaatttttaaattttttgtagagacaagatctcactaagttgcccagggtggtcttgaactcctggacgcaagtgatcctcctgccttggcctccctaaatgctgggattacaggcatgagccaccgtgcctggccccaaaacattttcattacccaaaagaaaaccctttacccattaagcagttgctccctgttcactcctccaccccaayccctggcaaccaccaatctgtgttttatttctatgaagttacacattctggatatatcatataaatggaatcatataatatgtgatgttttatgtctggtttctttcacttagcataatattttcaaggtttatccattttatggctgwataatatttaatcgtatgaatgtaccataattcgtttatccrtttatttattgatagacatttaggctgtttctaccttttggctgttgtgaatagtgctgctgtgaacatgtgtaaatgtacttaaatttctttccctttctttctttctttctctttctttctttttctttctctctttctttctttcttgcttttctttcctttctttcttttctttctttctttctttcctttctttctttctttctttcttttctttctttctttctttcttttctttctccctctctctctctttctttctytctctctctctctctttctttcttttctttctttctttctgacagagtcttgctctgtcgcccaggctggagtgtagtggcgcaatctcagctcactgcaacctccgcctcccgggttcaaacgattctcctgcctaagcctcccaagtagctgggactacaggcgcgtgccaccatgcctggctaatttttgtatttttaggagagacggtgtttcaccgtgttatccaggatggactcgatctcctgacctcgtgatccacccacctcagcctcccaaagtgctgggattacaggtttgagccactgtgcccagcctcttttttttttttttttgagacagagtctcgctctgtcgcccaggctggagtgcaatggcatgatcttggctcactgcaacctctgtctcctgggttcaagcaattcttgtgcctcagcctcccgagtagctgggattacaggtgtgtgccaccacgcccagctaatttttgtatttttagtagggatgggattttgccatgttgaccaggcyggtcttgaactcttggcctcaagtgatccacctgtcttggcctcccaaagtgctgggattacaggygtgcaccaccgcatctggcatgagtatctgtttttttctctcttttgagatggagtcttgctctgttgcctagactggagtgcagtggcacaatctcrgctcactgcaacctccacctaccaggttcaagccattctcctgcctcagcctcccgagtagctggcactacaggcgcgtgccaccacactcagctaatttttcatacttttagtaaagacagggtttcaccatgttagccaggctggtctcgatctcctgacctcgtgatctgcccacctcgacctcccaaagtgctgggattacaggcgtgagccactgcacccggcgagtatctgttttgaattccttgggatctatacctagragtggaattgctgggtcatatggtaactctgtgtttaactttttgaggaactgccagactgttttccacagcaactgaactattttacattcccaccagcaatgtatgagggttccgatttctctacatcctcgccaacacttgttattttcccttttttaaaaaattatagggctgggtgctgtggctcatgcctgtaatcccagcactttgggaggcctgggtgggcggatcatctgaggtcaggagtttgagaccaccctggccaacatgatgaaaccccgtctctactaaaaaaatacaaaaattagctgggcatggtggcttgtgcctgtaatcctagttactcaggaggctgaggcaggagaatcgcttgaacccaggaggtggaggttgcagtgagccgagatcgcgccactgcattccagcctgggcaacaagagtgaaactctgtctcaaaaaaatatatatatacacacacatatatatatacatatatatacacacatatatatatacatatatacatatacacatatatatacatatatatacacacatatatatacatatatatacacatatatatatacatatatacatatatatgtatatatatatatatatatatatatatacacatagagagagagagagagagagacagagagagagagagagagagctgtcctagtgggtatgaagtggtacttcattgtagttttgatttgcatttccctaatgaatactgatattgagcatctttttttttttttttttttttgtgagatggagtctcaccctgtcacccaggctggagtgcagtggtgcgatctccacctcctcggttcacgccattctcctgcctcagcctcccgagtagctgggactacaggcgcccgccaccatcatgcccggctaattttttgtatttttagtagagatggggtttcactgtgttagccaggatggtctcaatctcttgacctcgtgatccgcccgcctcggcatcccaaagtgctgggattacaggcatgagccactgcacccggccttattgagcatcttttcatgtctttttgggctatttttatatcttctttggaggaatatctattcaagtcatttgtccgtttcttcccccttgccaattttttaattagaatgtttgtctttttgtcttgggcragtttcttagcccctctactgaggagcccatttcttcattgtctaatggggatgctattgtctgaagtgttattgcaaaggtgttgtgcggtaatgtccattcagggcctagcacacagtgggagtgggaagcataarctgacttggaattcggctctggtctaggggatcaactatcccgggtttcccaggatggtcccggctttagttctgagagtctggcatcctggaaattcctaagttctatgtaaactggggcagttgctcaccctcctcaggtcccagatgaggtagaccgtgcgtatccttgctgggccttaactctaaacctgtttcctcatctgtaaggtgggactgatcatttctcatagggttgttctaaaaatcagatgcactgattgcttgagaaagttaactagaaaratccctcccagatcttacctgaaagtacaraaataggattrtagtcacaaaagaggatttcctggccttgaagcttcaggtgttatctttcatattcttaatactcttcaaggtgtgggaagggaccggcagcactggcagtgcctgggagctcgtgggaaatgtggaatgtcggagtcctcagacctgcagaatcagaatccgattcccaggtacagtaggtcctccaatgacatcgttgtggtcaccgttgttttgttgtagtgttgatgagaaaaaaataaatggattcccagctgggggcaccactgatgtggagtttgcatgttctcttcacgtctccgggtactctggtttcctcccacatatcaaagatgtgcactttaggttcactagagtgtctaagttgtcccaggatgagtgagcgtgaatatgtgtgagtgcgccctgtgatagaatgggctctgagtcagttcccgccttgttccctgagcygctgggataggttccagccaccagagaccctgaactggaataattgtgtaaataattattctaacttgtttttatgagtcttttttaaatgtatgtattacataactcacatttatgtctgtttaatattagaagtgttttggtctttatttagtagtttgactttatttagaagcaactggaaatatgccctaggaacttaactcttgcttatatcaattactttatggtaaaattggtttcattatacgttgctttgcttacagtcaaagtttccaagaacccatcaacaatgttgagtgaggccttactgtaattcacatgcacactcttttttgtttgtatgttggtttttttttgtttgtttgagacggagtttcactcttgtcacccaggctggagtgcagtggtgcgatcttggctcattgcaacctccacctcctgggttcaagcgattctcctgcctcagcctcccaagtagctaggattacaggcatgcgccaccacatccggctaatttttatagttttattagagacagggtttcactatgttggccaggctggtctcgaactcctgacctcagatgatccgcctgcctcagcctcccaaagtgctgggattacaggtgtgagccaccgcgcccggcccatgtgcactcatgtttgagaagcattgctttataccaaaggctacgaagcagaggaagtcatccaagatatggaaaatgtatcaacaagttcatcacagtagtatttataaaagcatcaaaattggaagctacctaaatgctcaataaaagagaaatagtgaagaaaattgtgagttttctcctgagtggactgtcatgcagctgttacaaatgatgtttggaaataccttgtttaccatcaaaagctgcttttgatatcatgaaatgtgacagaagcggtccatgaaactgcatgatcagcagaactgtgactgtgaaattaacatacatatraaaaaacactagaagaaaataggccagcatrggaccagatgagggatggggaaggcctgtttttgtttttgtctgtccttgtcctaattctctgtggctatatggtctatatttaccctatcacaatccctcaaaaagcccacatttgggtcattgccaggataggatgatttttccatttccatgaactgttaggggtattaagaaatgcttaatacccccaatgccagtccatatcctctgtacaagcctaatccaaagccctgtttccagggctttcttaggtcagcctcactcactctgacatctctctaccccagaccctcagcgaggcagagctctttgtccagcctggatctccccttgcagggttataccaggggacatacttcctgcatttctgtgatgacaaatgttctgtgtgggtttatttcaacctgaggtttggctatgtccagagggcagctgggggttattgtatggatacatgaggtgagagaaaataataacaggggacattaaaaggaattgcgcttcaggcctgtaatcccagcactctgggaggcggagggagggaggattgcttgagcccaggagtttgagaccagcctggctgatagggtgagaccctggctctataaaaattacaaaaaaagttagctgggcgtagtggcctgtgcctgtagtcccagttactcaagaggctgaggtgggaggatcacttgagcccgggaggtggaggttgcagtaagctgaggtggcaccactgcactccagcctgggtaacagagtgagactgtctctaaataaataaataagcccttcctgagtgccagcctcattgtatggctttatgtttaatccacacaactacctgatgaggcaggcatgtctctctttagctatctggaacagagaggtgaagttgcctattcaggatcacacagccagtaagtggcaaaaccaggacaagaacccaggtctttgscttcagagcctaagctctttctcacaatttaacttaatttaattaaaaacttttttgagatagggtcttgctctgttgcccaggctggaacacagtggcgtgaacatagttcactgcagccttgacctcctgggctccagtgatcctcctacctcagcctccctagtagctgggactacagatgtgctccaccacacccagctagttttgtctttctttgtagagatggaggctccctatgttgcccaggctggtcttgaactcctggcctcaagtgaccctccctcctttgcctctcatagtattgggattacaggcgtgagccacagtgcccaggcagtctgagctcttacccaccgtctcttcagggacaaaaatgagtgacgtgttgatgcagaaggtacttctggaccaggacctctgaaactgtgctttrcaaaaaatccccttggaagtgcttccaaaggcagatgccgattcagcagkcttggggttgggcccaataatctgaatttctaacgggctcccagtgatgctgatgttgyggcccaggggtgctcttggaaaagcaggatctagaatgcatttctgttggccttgtaaggcttcctggtatatgtgccctgcgatcgaagggcagggactgggatgtccccctccccacagtaatcccatccacgcctcctgggttggacccagctgcctcagcaccatcctgaccagcctggccagccaagcctctctagcagccctgcaggacgtccttggttgcttgccccagcatttcctcctgccagttggctggcaggtgatgggccgactgtgacagcttagccagagttcctgtccagaaatgtcttgagctcagccaaggtaaatgctgccccgctgtcagaaatgaagtgcctgtcgggcctctgggcatgactaattgaggcggaagaaatactgtaactgctgacgtttcagatggagctgggggttgctttgaggaggcagcctccacaatcaagccctttcctggaaaggcccaaacaaatcagggtaatagctcccacttctcaaatacctcctgtgggccaggcactgggctaagagctttgtgttgatatgttttgtctaatcctttcaagaaacccctttcaagaaccttgcaagaggccaggcgcggtggctcatgcctgtaatcccagcactttgggaggccgaggcgggtggatcacctaaggtcaggagttcgagaccagcctggccaacatggtgaaaccccgtctctactaaaattacaaaaattagctggtgtggtggctcacatctgtaatcccagctacttgggaggctgaggcagtagaatcacttgaatccaggaggtggagtttgcagtgagctgagatgcggctattgcactccagcctgggcaacaggagtgaaactccgtctcaaaaaaagaggaaccttgcaagaaaggtcactgatgagggaactgaccctcagagaagagaggaatgctggacaccaaccattacataatggagcccattttggaacttgggtctgtcttactccacagacaatatgtttgatcctagagcaatggttttcgaattgtgctccatggaaccccgagggtctgaggagcgcttcacgggctgctgtgggagtgagggtggcagaaaaggaagtagcacagcaagctaggctccaacccttctctgtccttctcccaatgtggctttactttgatgtgatttgtgtattgagcttctatgaaagatttgttggaagaaatgatttcaggaccaaaaatgtttgaaatccatatcacactgcctcccaaaacaaatgtggattattgmtcagggcttcttgcacacatttcaaggaaacatcattccatttggtggacttgccaagcggcgtggctcgtgtaaccctcactgagctcctttgtaaygtcaagtcatcctggtcagagcttctacaatgggctgtgaattgtgtgaattccttgggarggttcactgccaggcaaggtctccgcatcctttttaagaggcacatcaatatggattatagtgaccataccctgggatagactggcctggtgttgggggcctaggttcctgctatcttgcggctctgccttctaaaacatgtgctttccattttgtagctcaagatggctatttcagctcccaccatcacatctgcatcccagccaggcagagagagggcaccccagtcttttttttttttttttttttttttttttgagacagagtctcgctctgtcacccaggctggagtgcagtggtgcgatttggctgaagtgattctcctgcctcagcctcctgagtagctgggattacaggtgtgcctcaccacgcctggctaatttttaaatatttttagtagagacggggtttcaacatgttggcccggctggtctcaaactcctgacttcaagtgatccgcctacctcggcctcccaaagtgctgggatttcaggcrtgagtcactgcacccagtcccccccccctttttttttttttttttgacagagtcttgaactgtcaaccaggctagaatgcagtggcgtgatctcagctcacgacaacctccacctcctgggttcaagtgattctcctgtgtcaacctcccgagcagctgggattacaggcgcccaccaccacacatagataatttttgtatttttagtagagatggggtttcgccatgttggccaggctggtctcgaactcctggcctcaagtgatctgccggcctcagcctcccaaaggggtgagcctccggacccggtcacccattcttattacgggcaatctttctgctcatcttccattggccagacatagtcatgtagccatacctagccataaggagggctgggaaatatggtttaactgtgtgactgtgtgcctagctataactgggagcctctgcaactcaaggaagaaggagagagtggttattgggaggcagttattagtctttgccatgggtggggttcctccatcaaaactgcccatgtgggtggcagcgtgataaggggcctatggtggcagttgggaagtatccccaaagttggtgaatttcaagccatgggactctttttcccaatggccagccaagaagctagcagtgattgactttagagaagaagaatcacagtggtgttggcagagaaatcaaactaggaggtttattctgagcctctatgagcgattgcagcctggagaaaacacaaacccaagaagccttgagtaagtgatcctgagacaggtgacaactctgctttatacattttagggaagcagaagttaccggcaaagtcataaattaatatatggagtttatatgttgctttggcccaaaaaaggtgagctatcttgaagtgagagctcacaggtcataggtgggttcagagattctttaatttgcaattggttaaaggagtaaggctttgttcaaaaacctggagtcagtagaggccaagtgcagtggctcatgcctgtaatcccagcactttgggaggccgaggtgagaggatcgcttgagtccaggagtttgagaccagactgggcaacatggtgaaaccttgactctacaaaaaatttaaaaattagctgggtgtttggccaggtgcagtggctcatgcctgtaatcccaaccctgtctctactaaaaatacaaaattatacaaaattagctgcgcgtgatggcgcatgcctgtaatcccagatacttgggaggctgaggcaggacaatcacttgaacccgggaggttgcagggagccgagattgtgctattgcactccaccctgggcaacaggagcaaaactctgtctcaaaaaaaaaaaaaaaaaaaaaattagctgggtgtggtggcatatgcctgtgatcccagctactcaagaggctgaggcggaaggatcacttgagccctggaggtcgaggactgaggctgcagtgagccatgatcaggcaasagagtgagaccctgtctcaaaaaaaaaaaaaaaaaacctaaaataaataaaaatagaaaacttggagtcagtggaaaagaatgtttaagataaagaagtttgctaatcatcatgtgatctgccaatcatatcatgccatgtatcgtatgatctgccagagtcacatcatctcatgccttatctgatatgtcatgtgatatgtcagagcaagactcaatatgctgggtcaggccaggcgcagtggctcacrcctgtaatcccagcactttgggagcccgaggagggtggatcacctgaggtcggtctctactaaaaatacaaaatttagccgggcgtggtggcgggtgcctgtaatcccagctacttgggaggctgaggcaggagagtcrcttgaacctgggaggcagaggttgccgtgagccgagrtggtgccattgcactccagcctgtgttacatgagcgaaactccatctcaaaaaacaaaacaaaaaagcgctgggtcagagtggcctgcaggggtgcgtgatttaacccgtgcctgtcatggccttaggtcctctttataatttgatatcatattgccacagagtccattctgtctgtcttctgatctctattttaatattaatgctggtagttgtgtctaaactgcaaaagggaggggttacaatgaggtgtgtctggtctcccatcccattatggctgggaactcagcttttctggggtctcattggccaagagggggtccattcagttggttgggggacttaggattttatttttagtttacagtggctgatgtgttgccagggaaaagttctcccagaaatttagtttctcagttctctcttctcattcatattctttttaaaaatgaagttaaaaaaaaattttttttgagacagggtctcactctgtcgcccaggctggggtgcagtggtgcgatcttggctcactgcagcttcaacttcccaggctcaaacgattctcctgcctcagactctgaatagctcggactaygggagcacgccatcacccctggccagttttggtattttttgtagagatggtggtttcaacatgttgcccaggctggtctcgaactcgtgagctcaagtgatccacccacctgggtctcccaaagtaccagcattacaggcctgagcctccacgcccgatctaatttaattttttaattgamaaataattgtacatattcatggggtacatagtaatgtttcaatacatataatgtatartgatcagatcagggtaatttgcacattcataatctcaaacacgtacccttgctttgtggtgggctcattcacactcttgctgtctgtaccagtgaaggactgcctgggctcaccctggaggtttttcctctgatcacctcataagcaaggctattctatttaaggtccttttggttctgaggagctatttgagctgtcccacagagaaggattatcgtgagggtgcagaagacgatcatgggagacccaagggctggacatgaaggacagccagacctcaaggaagctggaaagctgttgggaaccaggtcccctcccccagttcttgcctccttttcattaattcatcatatgtttattgaagccaaatgtatataaggtctgcctttcctttctgtggatcagaagtcttctgcagacagctcaggatggtttcggttcctttttttctttttttctcacagactctgttcatcttgaatggtttcagttcctaagtctccaagatctttcaactcagctctcttgctgccagcttctcagtttcccaatttcaccctcccgggtggtgatctgattggctcagkctgcacaagctgtagattgtaggcttccaatagatgagctgcttttgaatcatgtgattacctatgtccaatcagtctgaggaagcacagggtcatgtaggagactgtgatgggtgtagtcaactcagcagggcctacgggtctgggggyaaacgtcattgggatggggatggagcatcctaaaacatgtctggtacaaggatattatttaaaatataatgtcacacctgaaattttagttagcagggctccatacaacattgatgtttcaggagcatcagaaattgtagactaggcggacatggtggctcatgcttgtaatcccagcactttgggagaccaaggtgggtggatcacctgaggtcaggagttcaagaacagcctggccaacatggtaaaacccctgtctctattaaaaatacaaaattagctgggcgtggtggtatgcacctgtaatcccagagactctggagggtgaggcaggagaatcgcttgatcccaggaagcagaggttgcagtagcccagatctcaccattgcactccagcctgggcgacaagaacgaaactccatctcaaaaaagaagaaaagaaaagagagagagacagacagacagagagagaaagaaagaaagaggaaggaagagattgagaggaaggaaggaagagattgagagagagagaggaaggaaggaaggaaggaaggaagggagggagggagggagggagggaaggaattctagactaaaaggactggctctagaacgccgcgggtaggtggcaatagctttcattgcatcactgatgctcagccctgaggaacctgggtaaactctggcctcataaagaactggatggagacaatcaatacaggcaatggagcagccctgccccagctgaagtctcttctttttcattccacaaggcctgagtggttggcagaactgttgcacctccctgggcatgtggacagattggaggatgctggccaatcaaaccctttactcagctctgcttccagaaagtaaaaggcatgtctcttggttttgttttgtgacaatgtcttgctctgttgcccaggctggaatgcagtggcatgatcatggcttactgcagctttgatcccttgggatcaggcaatcctcctgccccagyctcacaagtagctgggactacaggtgcatgccaccatgcccagctaatttttgcatttttttttttgtagacttggggggagggtctcactatgttgcccaagctggtcttgaactcctggattcaarcgatgtttctgcctcagcctcccaaagtgcttcttgtcttttgagagtactggttcattggttggattcagatggcaagtggacattgcggttgacttttcaacatatattttaccttacagccttgtacaataggaatgggatcttgggttccatgataatcctaccccccagctggtgtttggtttaggtggaagctgtttagcatctagggcttcctagtccagaggtggcaggggacccaggttgaccctgccatcttgaagcacacgtgttcattcagtggtcggggagaggtgtgctgtgcctgtcttgcttccatgagccagggctagttgccactgtctgccatcccgtcactamaagatgcctagccttacaatgaagcccacactgaaagtggcagagaagaaagactgaaagagcttggtcttggtcattgagccacattccccgtcaaccctgatgtcaggcctttgctcacccagcttccattcyccattcctagcggagccatgatccccagttcctgggggaagtagactrgtttaaccaatctggcacrccctggcccttgtaataatcgggggccacatcagactgaagggaagatcttgtgttccactcttggtgygaggtttctccttttgaacccgacaaggaagcatgctgcctcagtggctataggcagccctctttggaccaggaggcagtcacacttaggacaatgtcctgatgacacgaggatcatccatgttccatgcctgctgccaggctctcagacgcttggtctaacacatgtcctccgtgttgaagctgggtttctcttccttgcccccgaaggtatctgccttgttggctttacttcctcagagragaaattgaggaatccagagacaccttcctgtgtccaggatgtcccaggtttgggaatgctgtctgtgggcttggattcccagaggaggcagctgkttcctccacaagtggcttttgtgtcacctgccactggagatgggggaggatgctgtccttgtcagagccacactgcacattctcagcacagtcttgacaccattggctgcagaatccttgtgattcagctcatttggcaagcagatgctgaacacccaccagatgccaggtgccaacccctgcgctagggaggtgctgggggcggagatgaatgtgccaccrtccctgagctccagcctccagacagtggtccttctgattgagagtttaaccaatgactggtaggtagcctaagtcaccttcccrgagagctgttgcttaaagatctcagagacagtggatagaggaaaggtcactgtctttgagtggaactgacctggtttcatacagttacattatttctttttattttttgtttttttgagacggagtctcactgtgtcacccaggctggagtgcagtggcgcaatctcggctcacagcaacctccactcctggattcaagcaattgaatatactgcctcagcctccccagtagctgggattacaggcatgcgccaccacacccagctaatttttgtatttttagtagagatgggtttcaccrtgttggccaggctggtcttgaactccggacatcaggtgatccgccctgtctcagcctcccaaagtgctgggattacaggcatgagccaccatgcctggcctagttacatgatttctagtctcagtttccccactgagaaaatgggactaatattagtgctcacctcctagggttgccctgcagtaacaaatatgaaatgcccagcactctcccatcaccactcagcaaatgccagcttccmttctccttcctcccacgctcccaaatgctcccctgcaggctttgtgcttggctctgcccaggagtgatccccctgcaagtcgccccctccctccagggtgcartttggcctcacccatcactgtgtggccaccctcagccagagctgagtagatatggctcctggcttcactgtcctggagtaataaaagtcaggtgtgccaggagggcagtctgttgggcctgtttgggacctgcagcagattctgcatggcattgcccttgagccagtcctccccctggcaggccagctgtacttggcacttctgaggcctgaagcagagcttggcctcaccctcgctggcctgagtagggcatcgttaggcttcgaggctcttgccttccctgggatctgctgactcattggagagaatcagcttaggagttagaggcagcagctcgtttcatttctgactttccttgagtcagaatagatggaagttttctgtcagttaagaggtgccattgcaggggtcatcgggaactccaagmatgagtccagggatcatccaggtgtcagagctgaggcacgtgacacagggcctggtttctctgcagaacagcactagtttggatcagactgcttgtctttgctgtgaagcagagaactccgagcaacgggccaggaagatgcattcccaggaagctcacgctttgcagtcttagctgaggcggcaagagacacgtcagcatctgtttkggcttcacaactgcagagcgtggcttctgtcccgggcactcatttcagacgcccggaggtttggggaaagctctcgctgtgcggggcccaggaagcaggctgattgaaaccagacctttctccgagcctcaaagcaaccgtcttaaacactggcccgctcaggttcccaggtggaagctgtattcagttgactctgagacttacctgagagcacctgtttagcatctgcagctgtcctgctttgtttggtaaaatgatcctatcctggacttcagaatatgtagtggtacctgtaaaacaggcagctatamtttgtggtcattctttgctcaacaaatcctccattgaacacatactctgtgcttaaacacgataaataaaggctgaccttactcttggggtcttaygrtcttacaggaaaggcagacatgaagatgtgtataaaatccaagtaaattgtcacaagtgtgcaaaacaccaggagaaagaagcacagggtgtgatgggaatgcaacagggaatcagagaggctttcttgaggaagtgactcctgagctgaggctggataggtgaggaagggtcagctcctgaacagggaagggaagaaattttgaggcacaggcggcaccaaggtcctgaggcagacaactgtgtggtgattcccagaacaagagagcaggggagaggaggaggtgctgagttggggccagaccaccacacgtggggaaggatttgtgtttccgtttaacagagagctaaacccagggacttaagaagcagccctctagcatgtcatcagggaccaagtctccatctagttgtccacttcaccatccttagggtgtggctcttgtccttatactcacaagatggctgttggaactccagccatcatgtctgcattccaggcaggaagaagaagggcaaagataagagggacaagcagtcaaatttgatctctttcagaaggttccactagaaccttcagctgatgtcatgagccagcctgtgtcacatggtaatccttaagacatccagggaatgaggtttattagatggctacatcattgctggttgctacagaatcaatctttttttttttttgagacagagtctcactgtgtcactcaggctgagtgcagtggctcaatcacagctccctgcagcctcgacctcctgggcttaagggatcctcctgcctcagcctcctgagttgctgggactacaggcatgcaccaccatacccagtgaattgttttattttattgtattttttgtagagacagggtctcactatgttgcccaggctggtcttgaactcctggcctcaagtgatcctccagcctcgtcctctcaaagtgctaggattacaggcatgaaccactgtgctcaatccaaaatcaattttctattagtaaagaagagaagggaatggcggaaggggcgtaacctttgttctgagtgcaactggggagccacagaatggcctaagcaaggggatgatgtggaacagggaaaacaatttcaggttgtcccaactgggccacagtaacacacacctgtggcacagatattcatttcctagggctgccagaacaaattaccacaattttggtagctgaaaacaacagaaatttattcacttgcagttctggaggccagaagtctgaaattaaggtgtcagcagggccacgctccctctcaaggccctgggaaaggagccttccttgtcttgtcctagcttctggatctcctggaaatccttggtgtccttggtttgtaaacagcgtcactctaatctctgccttcattgtgacagggatcctccctgtgtctcctctgcgactctgtatccacatctccctcttcgtttacataaagacaccggtcattggatttagggcccaccctaatccggtctgccttcatcttgacttgtttcatctgcaaagactatttccaaataaagtcacattcataggtaccagaggttcacacttgaacatatcgttttgggtaacacagttgaaactcactacagcatgcaaaaggatggaaaggctatctggtgctggctgggctaaggtgggccactcgttttcccctcacccacagatcataagatagcccaggatttagggaggcaggtttatttccctaattttaacacattgcaaagcaccagtccccctacccccacctccagcaaacacttcctaagcatggaggaagtgagggaccttgagccataggcacagaggtgaccttgcccatccctgcgtgtcaggggctcgtagttcaggggcaaacaaacatttaaatgatgggctgggctgggcatggtggcgcacacctgtaatcccagttacttgggaggctgaggcataataattgcctgaacccaggaggtagagattgcagtgagctgagatcgcaccactgcactccagcctgggcgacagagcaagactccgtctcaaaaaaaaaaaaaaaaaaagaaagaaaaaaaaagatgggctgaatagcatctaaacttggtttcctttcttcaggcaaaattttaggstaactgatgtctcttaataagccacttttttgtttgaactrgggggaagagggcaggctgtagctacggccgtggcaggtggtcccaggtgaaccataaccagcttcagagttggagtcctacagactatcagatgtacagtgttgggcagggccccctatatkttttttgcttggaagtggaataaaaactgctcacctgtgaatccaggaagcaggctgggaggcrgccatcggactcttcctttgtgcagatctctctgcacagagtgccacgcacggagctttgtttcttgatgggtgatttttttwaaaattgagataggggtctccagcagagatgggtggaaataggagagacagacaccaaggaaaaacatgaagcattagttctcctggaggatggggaaaggggcagaaacagagggagctgctttcccgagggaggctaagagctctgggcagaagcagtggcttcagtgcctgtgggcagagctggagagcagtgcrtccccctctgggtaccctcccgagactccagggctggtggctgtggcagcaatgggaagcagcatccttagccctcaccccaggggccgtggcatcagggcagcccccctaccaggtggctttgtgagtaaaaccaagaatccaacaagagtgrccccatgtaactcttgcaaatagtacacatgagtcaccccttgaggactccctgaaataagggatggtggaggccacttgcagggggtggaggtcctcattggggaggtaggggtgaaaggctgataagaaggcagggtttggctaggcgcrgtggctcacacctgtaatcccagcaccttgggaggcccaggtgggtggatcacttgaggtcaggagtttgagaccagcctggccaacatggtaaaaccccgtctccactaaaaatacaaaaatttgctgggcgtggaggcgtgtgcctgtaatcccagctacttgggaggctaaggcacgagaatcgcttgaacccgggagacggaggttgcagtgagccgaggccatgccatggcactccagcttgggcgacagaacgagactctgtctcaacaataaaagaaggcagagtttaagccgagtgttgaatgaccaggaatctgtcaaggggagaaggcgagggtggccattccagacaggaggaccagcgtgggcagtggcacgagtgaccattggtggcttgaggctgtcaggggagtctggtctggggggtgggcacacaaggatgcacaaggtggtgagaggagagagaaggagctagagagaggctggggctggctgatggtgggatcttgcatgccagcctaagagctttggttttcgtctcgaggacagtgtcttcagggagccctggatagcctgtgaacagagcaaggtgtttttgattggtttgactgccgtgctgaggatgggtggaggcatgggctgtctggaggcaggaagggagggcagtggcagagggaatagcccccgacaccaaccaaccatgcttcttccgctcatcgtcccccagcctgccccraccccaggtctccagattgtgtcrcttatcgtaagagcagagtgccttctggcaggtgaggagtgcaggaaccccttgtccctgctcacgctgcgcccagggcaagggccggctgggcagctggcagcctggcagggagaatgtcgtttactctgctgtgtctgccgccaccaccgctgggcagcctgattaatgacccagggctcctcacaggtcagcggccccacctctgtggcggtggctgccaagggaacctgcctgccctgcctccattcctcctgcggctggtgctcttgggtcggctccaggaagggcttccacatcgcccctctctggctcttaagtctttctgccaaccatttccctggcctcctttgaaccctggcccaagtgctcctctgcaggagagcctttgcagaatgaacccccagcccatagcattctaacttctttatttcatctccatcaggcacacagcaaaggctcaaagatatgcctcgaaggaatccttgctgcttctctccccttcccaccaccctggtgatgctgtgtggactctgggttctgtattagctctgcttgagggtctgtgtctgctcctctgtttatataagtcccattccagactggaaactccccaggaccaagaggcagcctcctcctttagactggtgccttctaagatccagatttttctccttcttttgagacagagtctcgctctgtcgcccaggctggagtgcagtggcgcgatctcggctcccgagttcaagtgattcttgtgcctcagcctcccaagtagctgggattacaggcgtgtgccaccaggccacactaatttttgtatatttagtaaagacgaggtttcgctgttttgtccaggctggtctcgaactcctgacctcccgtgatccgcccgcctcggcctcccaaagtgctgggattacaggcgygagccaccgcgtccagcccagattttccttttccattaaatagggtactcttccagggcagggactatgactctccctcggcctgggagctccctgaaaacaagggcccggtttgaggccatcctgtctgttcctcccttatgccccatgccaagctcagccttggtcctggtctgaagggatgcaggggctgccggcctcctggcttgtctgggaacaggagggctgagcatgagggcagcaggcgtggatttggctgtggccaggcctgttggggcaccactaggggccagctagtgagctgtctggggccaagggggmgtccagggggtcctaggcctaaatcagcccttggggccacaggtccagcaccctgggagggtggtgacttcctgtacccagaaatctgagtggggaagggcggagagtcagtcctggcatgctgactactcacacctcctgtgggctttatcttgggtgccggcaggaggacaaccacagctattatgtgtcccgtctctatggccccagcgagccccacagccgggaactgtgggtagatgtggccgaggccaaccggagccaagtgaagatccacacaatactctccaacacccaccrgcaggcttcggtgagtgccccagtcgccagccatgcttccctgtgctgggaggcygggggccaaaccaccctgcctggtcagtgggcatggctgtggcccgaggtctgtgacctgggaggtaccttccagggrttcccatgggactttgccagagttggggtgcccagcagtggccctgggcatgcctgctccccactctgtccaaacaagcatgaggcagtgtgggtgcccaggcccctggcctgcagcttggcscgtgctgactttctcccatcccctgcagagagtggtcttgtcctttgatttccctttctacgggcatcctctgcggcagatcaccatagcaactggaggtaaggccacgtcgtggggccccggggagagtctggagacctcagcccgaactcaggggccctcccaggggtggctcactggagacagggttatatgaaatgggaggaaggcacatttggctctaataggagtctgattctcaggaggggggtcagtggacgtcagagcatctcccttgcattagctgacctgctcatgtgcctgcacrtgtgtgtctcctcrggccagcacgagtcagtgtggacagccctgtgtcccggagttgctgaataagagggagagggagactccactgagagcttgggctcctggggccaggctccctgttgataggaggcacctgtctttaatccctgcacttcagttccacatcccacttccccagggatggggaaagctgygagtcctctcctcttcctgccccctcgccctatagtctgtgccctgctgaagggacagggaggaccttctcctatctggggtcctttggctccatacacaccagacccagagcccgccagatggggatgggcgacagaggtctcaggctcacttccagctctgcctgcgctgcccttcttgcccttggggaaaaggcccccaaagcggcccctctgggccatttctggtgactcctctgcacctctcccaccctaggcttcatcttcatgggggacgtgatccatcggatgctcacagctactcagtatgtggcgcccctgatggccaacttcaaccctggctactccgacaactccacagttgtttactttgacaatggtgagactggatctcagaatttaagtcacccagctccagggatcccttgtccagtcctttagaggagcacagggcctagagagggcaagggtcccacagtcccacggcaaagcagccacctacctttctctgctcagtttcctgacctgtcagataggggcaaaaatgcctgctacccagaagaatctgatgagataacaaaacgacagtgcttggctcttagtcgaggtaaaataaatgttaggggcctttattgttacttacattcaccaggatgtcccttgagccccgtctgaatccaggagaacagacattcctccttcttttatctcaaggagtcagaatagacaagaaggaaagggaaagagatgatcaagtacagtatctggggctgaagcaggatcttctggctcctctgctgcttggaagccgcgctgctttagtgagctgcccagctcctgcctccttacctttgcaaacttccccatcatcccgaagggacccaacctgtggccgctgccctccgactggcatttctgtagggcmctgctccttgcatgatctcccgtccagccgggtctctgttcttctccccagggacagtctttgtggttcagtgggaccacgtttatctccaaggctgggaagacaagggcagtttcaccttccaggcagctctgcaccatgacggccgcattgtctttgcctataaagaggtgagtgggcccagctgcagagacagctgggtcttggagcctttcttcattcagcaaatatttagagaatttgcaatgtgccaggcatggggcttgctgctggtaatacagcagttaacaagatgtttgcgggtcctacccttttggagcagtaagtctggttgcggaggtggacaataattacagggacaaatgtagaatcaccactgtgacaagcgctcccaagtagaggtgcctggtgctagctgagcctttcacagacctcttaaccttggcagaggccaggggaggctttgctgaggaaaagagttgaaatctgaaggataaatacgagttcaggaagcaaagaggasagtgaagtatgttctaggagagacaacagcacacagcacatgcaaaagtcctgaggcaggacagagcacggctggcacaaagcactgaaagaaggcagcatgggccaggtgcggtggctcacacctgcaaacccagcactttgggaggctgaggtgggtggatcatcagagctcaggagttcgagaccagcctggccaacatgatgaaaccccatctctactaaaaatacaaaaaatttagccggacgtggtggcaggcacctgtaatctcagctactcaggaggctgaggcaggagaatcgcttgaacccaggagttggaggttgcagtgagctgagatcgtgccactgcactccagcctgggcaacagagtgagaatctgtctcaaaaaaaaaaaaaaaaaaagaaaaagaaaaaagaaaaaagaaggcagcatgatgagccagggtggtggctcataaccccagcgctttgggagactgaggcgggaagattgctttaacccagaagttcaagaccagtctggagaacatagtgagacacacacctctattaaaaaaaaaatagaagaaggcagcatggttggaagggagagagtgaggggcaggacagggcaagggaaccacagatttgcccttgagaaaagtcactctggcttcagagtggagaacaggttgttgggggcttagagggaatactgggaagtaatttaggagaagggtgacagcagcttagagtaggatgaggggaaatggaaaacagacagatttgagagccacttagcaggttaagcaacagaattcggagatgcattagatggggaagggaagaaatgaaagaaagggaagggaaaagggtrtgtcccgggtttccggcctgcatggagtgccattcaccgagacagaggaaagaagaaaatgtgcttggaggtgrtgtggagaggacttggaatttgggtggggtcccactgggcttccaatgtcttggagtcctccaggaggtggtgccatccasaaagatgggtctggagctcacaggggagggctgggtgggycccagagcgtttgggaggtggacggagtctcttctccctgccgcagatccctatgtctgtcccggaaatcagctcctcccagcatcctgtcaaaaccggcctatcggatgccttcatgattctcaatccatccccrgatgtgccaggtgagtcttcagggaccccgcagaggscttgatgggggtaggactccrctcagactgaacctgagctgctggggggatggcagtggcagggagtagacaaggggcagagagttgagagggaaaccrggcaggaaaggatgcccagtgacttccagcttttctttgttatagcagagggaccattttctccagcaaaatctccaatgggaggcactgctctggttgttraggtgaaagggagccacagcccttccactcagcccctgttctatgtagaaaacctccaaagatgccctagtaaggggtttgagtcctcccagaatacaaccattgtggccttcccactccaggtgataaagggagcatcataggatgccaggagacaggaatccagcctcggccatgctgttacctccctgtccttcagcaaaccacatcatctctctagcctcagttgcctcatctacaaaatgggatagtagctgaaggagtgcttctccctcccaggccctcctccagtgctgacattttaggaggtcatagctctttctcccctgctcccgacccccattgcgtgctcacgagggtcttggatttgtactcctggggagcgcggcaggcatcccatgcactgccgctccttctagacccttgtctcagagactttttaacctgacctcttctgctgagccgtatgcacaagttctgccatgtaggaccccgggaggtctggggaggagcctttgtctgcccttcccaccccacctgggctttgatggggcctgggggcattctcaactccactcttgccatgccaggctggacggaaggacacgcttgggagcccccaagtcaccttcctgtagaagggcaaggtaccgccgttctgtgaaatcagggcttcccgggggaggcatcattgcctatttctgttcggttccatcagtacacgtgttctgagttcctgcttacacactgggccactatgttccaggcactgttgagatacagtgaagaggaagggcatctgcccttgaggcattcagtatctgagcacagcctttttttttttaaacaaagtcttgctctgtcattcaggatgaatgcagtagtgcaatttctacccactgcagcctccacctcccaggttcaagtgatcctcccacctcagcctcccgagtagctgggaccacaggcacatgccaccatgcctggctaattttgttattttttgtagagacagggccttgctatgtttcccaggcttgtctcaaactcctgaactcacacgatcctcccatcttggcatcccaaagtgctgggattacagacgtcagcccccatgccccaccccaaacctctgtctttaacagaaatgttaagggttggggaacaatggggcctttaatctattttttttttaatctgaaggaaaggaccagggcttagttaaaaggccttacccagtaccttctatatgcaaagttcagtggagtgttaggggctcagctctggaactggaagcctgagctggagtccacactttccacaagcatctgacctctggtgagtcactcaacctctctgcgtttatttctttatctgtaaaatagggataagagtgatactttgcccctacagctgctgcaaacacgcaggcgatagtgtatgtaaagtgttgggcctaatgtctggcacatcaggtctgtgagtccggtataagaatatctcactacagtagactttaaaactcagcattttataatccagcaggacaccttgttctgtagcgaacagtgcaggactaggaacaagcagtgtcctcatgctggtgtcgcaggtcagatgccgccacagcactttcacactttcatgcagcttttgtgactagggacaaaaagtcacatgctatagtggcgcagagtttccctacctttacttgtttgcacatccctctttgagatttttgccatttccatgaattactattctttttttttttttttttgagacagagtctcgctctgttgcccaggctggagtgcagtggcacgatcttggctcactgcaacctttgcctcccgggttcgagtgattctcctgcctcagcctcctgagtagctgggattacaggcgccggccaccacgcctggctgatttttgtatttttagtaaagacagggtttcaccatgttgtccaggctggtctcaaactcctgacctcaggtgatctgcctgcctcggtctcccaaagtgctgggattacaggagtcagccaccgcgcccagccatgaattactattcattattattattattattagagacagggtctcaggctggagcgcagtgtccccatcatagttcattgcggcctcaaacacttgggctcaagccatcctcccacctcagcctcccaagaagctggggccacaggcacatgccaccatgcccaactaatttttaaatttttttttggagagatggacagggttttcccatgttgcctggggtggtctcaaactcctgggctcaacttaacctcccctgcaagcctcccagtgcccaatgtgctgggattactggcctgggtcactgagcccagcttatttagtaatgcatgtcttttttttttttttgagacggagtctcgctgtgtcgcccaggctggagtgcagtgatgagatctcagctcactgcaagctccacctcccgggttcacgccattctcctgcctcagcctcctgagtagctgggactagaggcacctgccaccacgcctggctaatttttgtatttttagtagagatggggtttcaccatgttagccaggatggtctcratctcctgaccttgtgatccaccctccttggcctcccaaagtactaatgcatttctttatcttcatttataaagttatattttttcatgaataagtgtatctggtctaaaatgcaaaagatataaaaggatgtacagagattaggtttttcacctgcccctgaaccctgtctctcagttcgccatctctcagctctcctccctggaggcaaagggaggggaaaccagtgttctgggttatctccagagctgcaagccttcaggtgagtgtgtgtgtgtgtgtgtgtgtgtgtgtgtgtgtgtgtgtatttgatagcatacgatgtcagtgtttctgcacttgaacagagtacatcctgcccactgttctgtctcagcacacagtgagctgcctcattcttctctttaatggctgcctgatagtccattccatggatggaccttaatttaacctgtcccctgggggtagacttttcagttgttttaaatcttgggctataacaaataatacagtaggtactttcatgcccccgtgtgagtatttccgtacgctatattctcagtggtccaatcattgggtcaaagggcaggggcatttacaattttgatagctgtggccaaagtgggttccacggagactctggcactttaccctcctcataggtgggcatgcctgtcacctactctttcgcttgccgtgtgtcccaaggcaaggtctgggctgtagctgtcaccatctaatgagttgcctcgagctacctcaagggctgtggtgaggattagctgagatatccatgcacagagcaccaggcactgtgcctggcttgggcggggtgcccagtaaaggctggttagcacccaccaagcatctcgccccagtccacaccttcatctgggcagatctgtgggtggggtgggtggcactcaagggtcaaggggctggtgaatggggcctggttaattcccaacaggccaggagttctttcccctcttcagaaattcaccagcttcttcttcctccaccttcctacaacctccctttctattctttcttcccaatatctgcctgcctgcagcattcccagctggtaagcaggcatagacttgctccccgaagcataccacctctcggtagggccagccgctagacacccttcccacgcaacactgcatgatatcgagggagatggcagagggcagggcatcggagtggaggggcatctgatttgcatatgctactagaaaggagttttgtggtcaagtttttgctgcttctacttgggactaattcagctctcagcataactagggtggtcccggcttatggttctgggagcaaatggctctggtggcttgagggcaamgcgcccactgctaagcsgcaaataaggaatccctcctccctggtcagcatttgggtgggttatagtcttgatccatgggcccgttggctggtggctgtaccccaggcctagcctgccacagaagtgtggggctcgcacctcaccctcccttcccttcttctccgtctccctttttagggccccgtgccctctgtctcctttcttccacaaaactgtcctggatgctgtggctcattgccacccataccacatggctcctcatgaggcctttgtgccccagtggcctagacttggatataaagccgggcagggtgtctgtcagacagcaggcacctactcgatacgtgatacgtgtgaatgtccctccctccttccctttctcaaacacggccttgaactcttctgcgcgtttctgatatttcagtgcctctgttatgttgctgctacacgaggaactgtttttaagctagtagagctgttttcctgtctttgccatatgtgtatggagcagtctttgaaactgcacacaagcggcgacagcagaaaactcttccttcagctccaatgtgtggcttcccttgctccatgccatggggccctgtggatatcaccttatcctttaaggcccatttccaaccctagatattagatcctgggctgagagtcagtgcaccccactacagttgtatcagttgtcaaaatattgaaatacttgcattcttgttggcaaattgctgctgatttgagccccctcgtacctcccacgacccctcctgccctccccttagscccctgcgctcccagtcctctatcaagtattacagcctgggctccaggacctggctccatggctgcaggcagcatctgctctgactggttggtaaacgcctgtgttgagccagttgttaaatcatctccgtatcacctggttgcattagttagctacagctgtataacaaattgctccagaatttagtggcttaaaactgcaacatattatctcagagtttttatggatcaggaagcaaagcacaattcagccaggacctctcattcaaggtctttcacagcctgcgactgaagtgttagccagcggccaggcacggtggctcacgcccataatctcagttctttgggaggccaaggcaggggatctcctgaggtcaggagtttgagaccagcctggccaatatgtcgaaaccccatccttactaaaaatacaaaagttagctgggtgtggtgatgggtacctataatcccagctacttgggaggctgaggcaggagaatcgcttgaacccgaggggcggagcttgcagtgagctgagatcgcaccacctcactcctcacaccactcactcacgatttcactgggtgaaagagtgaaactctgtctcaaaaaaaagaaaaaaagtgttagccagggtcacagttacccccgtgatggggtggcaggtggggagggttgggaccggcttcagagctttcatgtggtttggcaggattcaggattcagaattcaggattcagttccccaaggaggccttctttggctccttgcctggtaaacttccccatgatatggcagctggcttccatcagagcaggcaagcgagacaaaagcagagggcgaggaagacgcaaaccagggtctttttatagcttaattttagatgtaacatcctatcttttttgccacattccgctggctagaaccaagtcacagatccagtctacgctcagggactggattgcacctgggtgtggataccaggcagccaccgtagaggctctctgggggccatgctagcgtctgcctaccacactgattataatcctctttcccatgcactaagctggacagtgtcttggatcttccccaaacattgtgagtttgtacatttgtccctttctaaatgaggacacaaatgttcagagaggtagagtgacttatccttggtcacacagctatgaaaggaagaattcaagtccagatcgtctccatttaaatcctggagtccaccactgagcctttcttagactgacccactcccattccacccaggggaatcttttcctcctcagctcccccaaacacccacagagtggggtgtgcaaactccccaggctgcttcttgrgactgttcttggtgtctgtgccttatttccttccctatcctgcatcccatgtacattactgagcccactgtcggggcagggatgtgtctgtttcatctgcacctccctcaagggcttcttccaggcagagtctcaggaaacrtgtgcctgatcaagctgtggaatgagggtgaattagagggggtcagatccccggtagcatctgcctctgaggctcttctgtgattctggaatgagaagcccctttagagcaaaccagagagatgaggggtgaagggggcggggaagcacaacccacctgaaagagcagggaggctatgtctgctctgcaggatcaggaggaaatctcggtggtgggagcggttggagtctgactccaggtgctgtgtgctgaggtgttgggtctacctgccaggtgaaagccagcacctgacccccagacactgccagcagctcccagcctcgtcctccttccctctgtctcctgttcctccttgtcaccatcagatccgatcacatcactctctgactccttgctgcccacaggtcaggtcaaaatcctcagtgtggcattcaaggccgggcacagctgggtgcagtcaaccacgcaggcgcatttccaaaccctccctccgctcaccgccctctgcctgggsagctctggtctgtgtcccctgggttccctgaacatgctaagggctgtccacatcggtatgacacagtccccttgtataaaacgcctcttactccaatcttttttactgcttggcaccattctccctctccagcggcccaggtcagatgctgtgcaagtaaccactccgccatgcagtggaattcacggcttcctcttcttccccccggcacttcgctgatacttttttcttcttcttcttttctttctagtggtggcgagaacaaatgctgatactcttaacatagaacttattgtcctccccagctaggtgtgaattccttgggggccctctatggcccccagcactgagcccagtgggcaggcactaacatttttagaaaatgagtaactacaagaaagtggacctagttgctggggttagggcaccgctgaagggaatggacatagcatagaccttgtcctctgctctattgtgactctaggtgagaacaggggtctgacaccacttgagtttgggagttgagtgttttggaaattgcatccctttttgtcagaggtttttagcttacgggaacaagcataaaattcaggaagtctgggaatcttaaaattgtatacggatttttttttttttttttttgagatggagtttcactcttgttgcccaggctggagtgcaatggcgcaatctcggctcactgcaacctccacctcctgggttcaagcaattctcctgcctcagcctccggagtagctgtgattataggtgcccgccaccacgcctgactaatttttgtattttttagcagagacggggtttcaccatgttggccaggctggtcctgaactctgacctcaggtgatccgcccaccttggcctcccaaagtgccgggattacaggcgtgagccgttgcacctggcctttttttttttttttttttttatagacagggtcttgctctgtcgctcaggccgaagtgcagtagcacaatcatagctcactgcaacctcaactttctgggcttaagcgattctcctgcctcagcctcctgagtagctgagactatagatgtgtaccaccatgcccagcttatttatttatttatttatttatttatttatttatttattatttgtaaagacaaataataaaatagggtggtattgaattcttacgctcaagccatgctctggctttggcttcccaaagcactggattacagatgtgagccaccgtgtaaggcctgtatgtggagtattgaaatgcaagtggaacatgttcacatccatgcgtttttctgggacagtatccatggccctcattggggtttaaaatgggccacagcctctgctcctggggagaaatggcttttatgtggctaaggggtcagatgactttgggtctcacattcaatccggcaagcagggaatttgtttggattaggttgagctgcaggtaatagtaaaccccaaatgatcatggcttaaaggaaacagaagttcaggaagagccatctggtctgcagaccctatgatcaccatggataatcctattgaccaagcccacctgatcatacagaatgggtggcgtcactgtccttgtgcccaggtttgactgctccctgcctggggcagtgtgaggaggggagtttgattcctcactatttaggaatccccagccactgaaccctgtctggggaaaactctcctcccccaggttctaaacactttcctccccacccctgctaggcaaggggatgggaggtgcaatggggaggactcytcacagcctcactcctgggggagarggtagaagaggctgaaaaccacaagagttcttaccagtacttcctcgtataaactcttccgcaggcttttcagcagagtctgcaaagcatctttggtgaaaagaaaagtcatgtgcaattagcagcatctgtttgcagaggcactcaaaacacacaggacagtgtatccgctatgtggctggggagaccgccggaagtcaatattatttcctctgttcatttgcttmagaaactctttatttcatggttagtataaaagcaactttagcattgccaacatcgaaactgacagggattctgaattagtgggatcagttagtgrggattttcttacaaagagctccagaatgtagcctgccccttggctggccccgaatggccttggacggccccaacatgctgatcctcctcctttaccggaactttcctgtcctttccgaggcagacttgagtccagatatatgtcagggcctgagctgtgtgtaccttcctgccaggctgcaggtaagggagggatgggtcccagagctggctacagaagggatctaggggcagccacgtgaggaagtgggtgcagggagaagctgaggatctggccaattttgccttttctgataaaggatcctttaaagtgcccttcgttggaagtttttaatccatctgggggcccatccttccctcttttcccttctcacttctgtttttcccactactctgctccctgagtcatttctggcctcttctttctctgcctttttctgctttgcttcaatgctgagggacccccctacttctcccccgtggggcagggtcccctgctggggctccactcgtgattattgaatgaataatcacatgagccaaggaacaaaagaatgcatgaagactttttcccaacccaacctcttagatttttttatacggtaaccacccattccaggtgggagtttgtggatcgacctgtcatctcctaacttcttctggccaagccagcactctcccatgggcatctggcattgaaacacaaagggacatgcaaacctctcacttgaaccattaacattacttgtttggggccaggcatggtggctacgcctgtaatcccagcactttgagaggccgaggcgggtggatcgtttgaggccaggagtttgagaccagcctggccaagatggtgaaaccccatctgtactaaaaatacagaaatcagccaggtgtggtggcaggcacctgtaatcccagctcctcgggaggctgaggcaggagaattgcttgaacccgggaggtggaggctgcagtgagctgagattgtgccactgcactccagcctgggcgacagagcaagaccctgtctcaaaaacaaaaacaaaacaaaacaaaaacaacccccccgccaaaaaaaaaagacaaaaaacaaaaacatttcttgtttgggcagcagtgtttgccaagtctggacctgagtatttctgaatctttgatgcctggaagcagagataaaacagaacaccttaaactgccagaaatggtgctctggggaagcctgcgtcttggttccagaaaggatctgttggtcatggagatggaagtcattgtcttgggcaagctccagatgttggtgaaacaatccaaaacaaataacccaggcggggggcgggggggagcggggcgtaaggattcttttattaaaaaaataaaaatattaccaaacccacactcgaacaagtacaagctggcagttgaagtgagcaaatagtttcaattagagatatagttccaccccccaccctcatccccctttctgccaccactcagcctcccccactccgctggaaggactgtattttcagaggacagctggcgtccctggctgcacccatgcttggggcacatccccaactctgccccccagcccggatggtggggaaacccatccccagagcctggtgtgaagtttctaggagacttgscttccctggctgccacttgtgtctctatcctcgaactcagttcccttgaaaagtctgagtctctatctgtgccccaccctgagtccctttgtccctcccatttccccttccttctgatgagggaaagctctgccctgcagccttgcaggtggagaaatcctgaaagccagctctcctcccgctttgagatctagcttaggaggcggcatgtctggtttactgtggtctttcagggttgtccttttgagaatggcagtaatttgtggtgggctggggaggragggcgtgcttcctttgggctgtgggctgacgttataagttgctgaggttttcatgactatttgtaacccattcattcactcacagtcatttcttaaggtcctgttaagtgcaaggcctggtgctaggggatgaggtacagagataaattccatgcagactctgtcttagcggagcttgtggtctggctgcgggagtggccaggagagcagatattgaccaagcgatgtaatgggggacactggacattgctcagggagttgtagactcagagtggggccgggtcggggggcagtcactttgcctgagagtgggggaagtcttcaaggaggggacgtcatttgagctgagtcttgaagtatgaggcagttgaagcaagaaaggttgacattggactctagaacctatggcctcaggcaccctggaagtcaggacatgggagacttggagtttcatgtttatttttgatcccattgcgttttggtgctgaaggggaaggagagatggcccctgggagtaatgagtggggatggtgtgtgaaagtctgcttcaaactttccatcctcatctagatattcccaggcccccaggcttactcagagcccaggccaccttctcatggccattggcatcactcaggggcacctgcagcacaggtggccttggtgccacctctgggcatgtgaattacaaaaaggtgcccatcctccaatctctgtcagatcccrctcgggcttggcaaagggtctttcttgtgtcaaagggttgcatatgtgtgtgcatatgagtatgtgctcatgtgcaggtgtgtgtgtgtcttggagggctggggtgtgcacatgcgtgtgcggggctctgtggacccctcgccacctcagctttccatggagggttccctcctcttagagccacagtgactctgtagacacccggcagttactgcctgatatttacgaggcttgccacggggcctcctctctcagacttagggttctttaggagacaaacacacagtcattccatcttttggattttggcttaattttatatatatatatwttttaagacggagtctttctctgtcgcccaggcyggagtgcaatagtgcaatttcggctcactgcagcctctgcctcccgggttccagcgattcccctacctcagccacccgggtagctgggattacaggcgcgtgccaccatgcctggctaatttttgtatttttatagagatgaggtttcaccatgttggccaggctggtctcaaactcctgacctcaggtgacccgcccactttgacctcccaaagtgctgggattacaggcatgagccactgtgcccgtaatttttaaataaatgtttttatttttaaataaacaactgggctcggtaaattgtaaagagatgtggcctgacgcagtggctcgcgcctgtaaccccagcactttgggaattggaggcgggaggattgcttgaggccaggagtttgggaccagcctgggcaacatagggagaccctgtctctaccaaagaataaaaaaaaattaccagggcatgagcctttggtgggggaggtggagctgggggcagggactgaagtgggagaatcacttgagcccacgaagccaaggctgcagtgagccgtgattgcaccacggcactccagcctggcaacagagtgagaccctgtctcgaacaaaacaaaacaaaacaaaaaagaaagaaatgtaaatgtttccctttgactcttttagaaacacaaatcaggaagctctcagcaggrgtgtgctggagatcatgtatgcagctgggtgagaggcaactgaacatgtctcttcctaactccatgttcagtaacttttttgaaagggtagctggaagtcagctaccgtggaagtatttacaccacagaaattggcaacaacggcaattcaggactcctctgcccctacctgcaccccagcccccaggcagttgttaaatatttatctgcactcacaactttggtgactttctggagccacagtggcttccagccctgaggttaaaagtctagcctctgattttaaaacaaagactgtgtggctttgggcaaataacgtcccctctccgatctcacttttctcctttgtaaagtggggagagcagcgatgtctgtctgtgcacytcaggaagttgtaaggggaaatgagatggtgcagctccagggaacctgcaaggctgcgagctmacrgagtgctctgcactcagcacagcccctgcacagagcaggtgtctgcaccgacatgctgaaggagtcaacaaatgtgctgcatggtggcgctgtgctcttgtagttttctcgtttaagtagatgttttccrtctacttaatggctaggcttggtaaattgtaaagagatgtggcctgtgtggtggctcatgtctagaacctcagcrctttgggaggctgaggcaggcagattgcttgagcccgggagttggagaccagcctgggtagtacagggagacccatctctactaaaaatacaaaaattagccaggcatgatggggtgtgcctgtaataccagctacttgggaggctgaggcaggattactgagcctgggaggtcaaggctgcagtgaactgtgattgcgccattacactccagcctgggtgacagagcgagaccctgtctctaaataaataaataaatgaaaaagtaaagtgctatacaaagttgtatctgtctatgggttaatctgtctgaacctcagtttccccacttatgaatgaatggcaagacaacttgattttttttttttttttttttttttgagatagagtctcactctgttgcccaggctggagtgcagtggtgcagtctcagctcactgcagcctccacctcccgggttcaagcaattctcccgccttagcctcccaagtagctgggattacaggtgctcaccaccacgcctggctaattttttaaatttttagtagagacggggtttcaccatgttggccagactggttgcaaactcctgacctcaagtgatccacctrcctcggcctcccaaaatgctgagattacaggtgtacagccaacttgacttcttaactcccttgctctctcaacctgatatgtctgagtctctgcagctgtagctcatctcctctctcataaagcccacacctgcgcagtgctcgccttggggaccacctggactcctcatcccacccactctgtccagctgctttcctgaggaggagcaagttccctgatctgcctgggatggaaggaagggagggagrcgtgggaggaggcctggatctcaytctaaaccatccggctccagtgcaggagtcgggcgaaggaaggagctgcagggctggagctgtcatcctcctggtaggaaaggaagaccaaggctaaagtcctctccactgcctctccccatgggagtcgtgggtgtgtgttgcggggagatggattccaagataagtactctctgagcagccctcagagggggcgtgggaaattcacctcagtctccagggtccccagtccattcaccacctgagcactgccgtcccccactgctcccatgacctcattctccagtggtggcaaaagcaagaaacagtaatcaggaagaaacaaggggaagctagggtgggggcagtggcatccacagcaggagaagcaggcagcctggactgtgggggcagcagaagagaggagaggcctgcaggatgacgggtgggaacagggcgtctggagtgccagcacagtaccgcggtcaggccgcctctgtgggcctcctctctctccacagcagcggggaactgggggacccatcagacttgctgacaagaaatatgccgtcctagagagagasmgacagvgggagaaagacagagtaaggacaggaaagagaaagcaatgcgtgccatccttcctcctcatgttcaagtttataaacattgcttaaggtggactttgaggggttagaagaggctgaaaatgccctagagtctcagccatgagaagaacagcaaaaaagcagtcggggcagagagaaaaggggctcasatgcttcgagggctcctggggtccttgtgcgttgagtgtctcccttaattctcaggacaacaccatttgcatggcatcaccagccccatgtgtggatgcggctcactgagtcccttgtccaaggtcacacaggcggtaagggcagagcctgtctgcccagctgcggcaaccctaagcctcctctccttgtgtggtcaccctccggggkccgagcttcttttcctccatgctctcatcagtgcccccatctgctttcccctttccactcggcctggagcagcatctggcctgtgggtagcaggtgcaccctcctagtggcatgggagtggggggcaccagcatttcagacataggcctcagggatgtagatgctgctcagctccagggaatctttattgacaccaatgccagagyagtcttcttttcactgcatggaatgacattccaaggtcttgaatgtttcaggggctgaagtgtcctgcagcagggcattgtgttggsaagagagcatgctttggtgccagacccacgggggcgcagtcctgggttaagtaggagggactaattccaacgttaaggataaataaataatgagatacaggccaggcatggtggctcacacctgtaatcccagcattttgggggtctcaggcaggcatatcacctgaggtcaggagtttgggaccagcctggccaatatggtgaaaccccctctctaccaaaaatacaaaatattagccaggtgtggtggtgggcacctgtaatcccagctactcgggaggctgaggcaggagaattgcttgaacctgggaggcagaggttgcagtgagccgagatcatcccactgcactccagcctgggtgacagagcgagactcagtctcartaagtaaataaataatgagatactatgtgaaccatggacaaagctcctctaggttccttacataggaggggatgtgggggtggggcacccagcagtggcacgggacgcccacccctttgtggatgcccctactcagctcttctgccaccttgggaaattttcctccaaaccaccttcagccgagcgagaaacgtatgtccccacctacttctagtgacgaaaacccaattcaaactcgcttaaatggaaaaggggggtgcacggaggatactgaagtagcccaaagaaccaaaagaagagctgaatagtggggcaggtcctggaaccccagggcccagaacataccagcacttcctgtttctctccatgaggtggcttcattctctgcctttccccatgagcccggtactgtggccattcacaggttctgagcctgcatcttctcagcttcattaccagacagcaaaaggcctcttggttacagttgaaaagtcccaggggaggtctctgattggtccagctcacagccgatacccaggcctggaacaatcacagcgtggccagagaggcaggatcatggaagaagatggcagctgtggttcagyccacctgtaggaatgggccaggcacagtaccccaaggggaatgctgctgtttccagaagacgaaagggtgttgggcggaccaaacactgagtggttctttcctcttgtggggtaactcattctcaaagctcaattcctggctgtctgcttcttattcttttttctttcttttctttctttccgttctttcttttctttctattctttttctctttctttctttctttctttttctctctctctctttttttttttttttttttttcagtcttgctcttgtcacccaggctggagtgcagtggcacaatctcagctgactgcaacctctgcctcccaggttcaagcgattctcctgcctcagcctctcaagtagctgggattacaggcgtgtaccaccacacccagctaatttttgtatttttagtagagacagggtttctactaaaaaccctgttggccaggctggtctcgaactcctgacctcaagtgatccacctgcctcggcctcccaaagtgctgggattacaggcatgagccaccakgcctggctgggctgcctgcctttcaaaattgaagaaaaccaaccccaagtcatggttcctgggtgggtatcgtggcctagagagaagtatcagagcacctcagattgtcattttaaaaaagaagcctttcatgtacagttccagctttttcctcccaagggtgttgtggtaggtgtttctgtctttccactccacagacaagaaactgaggtccaaatgacttgcctgaggttatccagcaagtcgtgagcagaactagaacgaacttggatctcctgactctgaggtcctgtgagaagtttctgcagggaccaaagtaggactcgagcctggctgcaagccctgagccttgctgggggatttgtccaggaggggtgaggtggatggtggacagcaacatgcaaaagtcagcctgtccatctgcagacattcacagagcactcagcgaggttcaggaccagatgatcatggtctcacacatccccagcctccaaatagaccctcatgtccacagtgtggtgagtgcagtgggaggggggcacctggcctgagccaggcagaggagggagctggccaaggagggctgctcaggggaagtggcccttgagctagatctgcaaggatgagctagacaggaagaaggggtggaagaacatcttgggtcaggggaatagcagttgtgaaggcgcagaggcaaggagaagcaagcatgggatcccatttgtcctgcccccaagagcagccaggtctctgcgttgagtcacttagcctcacaccacaacactctcctctccaggtccgcacctgtccctgtctccagcagcgccaacatcattgtcccaggctgctgggtgcacttactgccttcagtgcagcaggctgacctgtcagactgtccgggaagaggcctcgatgycctctgcctgtgatatgctcctgacaacaggctctgcctctgtttcagaatctcggcgaaggagcatctttgaataycacygcatagagctggaccccagcaaggtcaccagcatgtcggccgtggagttcaccccattgccgagtgagtaggggtcattccgccatcccagaaagagctctggagtcaagcagactggcttcatgtcccaggcccatgactgactcctgttttgtgcagccacctaacttttcggggccctccatctctcttttgtaacccgagcctgatgccacctccctcccagagatagggtaagggtgagaaccacctaggtggagttgagcacatcggccgcagctctgacattgatgggtccattctgggtttggggtgggggttagggcttgatctaggacagctattgttattcccacataattgaaacccgggaaagctgtacctctgagaacgcctagactgagcccccagaaaaggtgatccaggaactagacgggcctcagtttgtcactgtattctccttagaggaggtgatgctgcggtccacaggcaggaggcaatggagggacttagcaggtggcctccataaaccatgggaccctggccctctgcaccccactcacccatgctgaaggcagccacctgctgttgtggagcccacaggatccgcggtggatgctcttcgggatggggctgggacagctgagactgcgggaaggagtacagcatcttccttcttgttgttttatgaaggtcttcatttcctctcccatcttgtggtgcccccagcttcctgctgaagccatggccttctccctgcctcagtggcatttcttctttttcttcttcttttttttttttttttttttttttttgagacagtctcactctgttgcccaggctagagtgcagtggtgtgatctcggctcactgcaatctctatctcccaggttcacgtgattctcctgcctcagcctcccaagtagctgggattacaggcayccgccaccatgcccggctaatttttgtatttttaatagaaatagggtttcactctgtcggccaggctggttttgaactcctgacctcaagtgatccacccacctcggcctcccaaagtgctgggattacaggtgtgagccaccacgcctggtgctgggatttcaggcgtgagccaccatgtccagtgttggaattacaggcatgagccaccatgcccggtcttcagtggcatttcttgcctctctttacccctgcttcctcttccttggaggtcctgagagcagggggtggagaaggaagaggaagagaaggagggaggatcttctcaaatgctaggccatgtctcagacagggctcagcaggtgtctttccctggacaacagaaaggactcagacaccagggggtcacagggctgggacactttaggggtcacagggctgggacactttagaggtcacagccataccccaaccctatcactctccatcggggcagaaggctcagggcctgagaaccagggttcctcgaggactggtgagagcaaacctyagsctctatgatgtggataaaactgcatttaggagcaaggrcatccaagggcagggctgactgcctgggtggaagcagtgaaatgttttgggaatgcatttctgggacactgtacatttaaggtacttctcacccctccggtgaattttgtgagcatttaatagcattcaggccatctgaaatgttgatgagaaataaaggtcagtaggtgttatgaataccccaggaggatcccaggagtttctctgtggccagtttgactggagtcttttaaggggcctccaaagtcactgggaaaggcaagggcagggctcccacctggaagcagctggtgaaggaggggtaatgctatcaaggctgtgatttgagcccctgggaaaccagatagggagaaaactctctgtatcccctggcttctcccttaccatttgggtgtgggaaggacttgtccagattacttcagaggggtgagtggcttatctccaagccatcgtattctgtagctggtccctcctggtccctcttctaggagagacccataaaaaagtggcctggggtgggagtgagagctgaggaaggggcaggggaaacccacagtgagacctcaaggctaagagctcgatctctatgttcaaacagaccttggttcaaacccagacctctcactgtcagctccacgactctctccaagcctcagttccctcctccataaaatggggataacaagagcacttatatattgattcgacataccatgtgccaggcactgttccagaccctctggatacacaggraacaaaacagccagagagtgctcatcctcctgcacagggcagcccctgcttctttcctgcccatggctctttccatccactctcccagggccttcaacaccacggcagacaaaaggacacagtgccacccactgccagtccctcccagagtgactgaaggtggccacactgtgcccatgcagcctctctcccactcacccagggctggttcccagctgccatcttgctggggctccatgtaatgcacattggctcctgagttaatggatcacatgagaattcacacaggaagaaacacatgcaatgttgatcaaatgagtggtcatttttctgttgttagttgtcacttcttgtggctatcaaggtgttctgttctgttgcttataagataagcccttctgcacacagttgttctgggtgagtgcctgtctctctttgcaatcaaatatacgggctttgtgacagctacttgccgctcagaggtcatctggttcattcaagtgagtagcactggattgcaagtgaacagctcttaaatccagcccccgtgcctactgcgccccctgccctgctgctcctgtgcctggcctgtgccagaagggttcacgcgccctccagcaacctggtcccactaatctctctgytctctggctctgtcctgcycaggctgggccccagctgtcgctccctcttcattcgtactaattccagccccttcactctgtgcagcctggtagcagttctggctgctgctgggaycacgtctgggccgttcccctctcggctctgcacatgggacctttctgccttgacttcttctctcccaggagagctgttttctccccatggaccgaacatcaggagtgggcagtgagtgcccccaacaagcactgggggcaaccagagcatcttttaaaacaataacttttattgtacatatttcaggtatacagcatgatgctatgggatgcatatagacagtgagatggttaccatgatgaagcagttaacatatccatcatctcacagttcccttagattttttgttcttgtggcaagagcagctaaaatctactcatttagcatgaactccacatacagtacaattttattacctacagtcctcatgttatacagtagattctagccttgttcatcctacatacctgctactttgtatgctctgacctttaaaaaatccctttcaaccctttgactgtgggatacacacctgaaagtataatgtctccgactaggtgagattcctttgtacacacttacagcaccttgtgatttgccgtcatagacctcgtgacagttctaattctgtagtgatttttgattatctgtttagtgtctgtgtccccatatgagtctaagccctaagaaggcagggactaggtctcactgctgaatccccagcacccagtttagggcctgaccttctagtgagaaggaaggaagctagggagggaggaagcgagggaggcagggaacaagggagtgagggacagaagaaggaaaaaaggaaggtaggtagggagggaggaagagatggtggggaggctgaggcaggaggatcacttgaacccagaagttcgaggctatagtgagccatgatcaggtcatcacacaccaacctgggcaacacagcgagacctcatcccttaaaaaaagaagttaggaattggggctagactggaccaagggaggtggcattaatgaccttaaaggtctcctcaaagtcaggggctccatagttctgtaaataccaggaattcagagttgcaccctttggagcccaaggagaggctcggtgctgagcggccactgccttctctcttgcagcctgcctgcagcataggagctgtgacgcctgcatgtcctcagacctgaccttcaactgcagctggtgccatgtcctccagaggtttgtgcccagggttacctgctgactcccactggccgaccgtggaggggaagagggtggcatggccccgtcctggcctcactgcccacagtcagccaacatgagagtatctctggccagtaccactctgactcttgggacaagaacatggcctgggggcttctggaagaccatttagggattccagctactcaggctccctcctcacacccaggaggagagggttcatcctggaacagggcttctcggagtgytccacagctgtgggcattagaccctgggctccagttaaacacactggattcctgggacccatcccagaccctctgtatcaggatctctgggagagaacccaggaagctgcattttaacatcatgcttcatctgcaaacaagtgtgagaactgccagttcagagacaaagtctggtccaaagacccatgaccccaaaacaccacctcaagatctttcttgggctgcaagggatttttctgaagaccaggggtgtggactacaggcatccatggaaagttgggagagctaaaaagctgtgtttgcttgcttttagaagctcagaaaattctgggtgagattcagtttcagtgataatgttcttaaatccatctcctcttccactccttgttctgaaatcatttcctcacagattagactcagcattcaagctctgttccctgtccaagataaataaatgacaggaggagggggaagaaaaagatttccttggggactagagttctcatgagagtgggaagtcctatgaactccaagggcttttaaggcaatcttgaaaattgctaaattatagtctctgagttcctgtgcagctgtcgtgctgctcctttccaatgctcctttccagtgcttttttttttttttgagagagttttgctcttgttgcccaggctggagtacaatggtgtgatcttggctcactgcaacctttacctcctgagttcaagcgattctcctgcctcagcctcttgagtagctaggattacaggcacacaccaccacacccagctaatttttttgtatttttctagtagagatggggtttcaccaaaccaagagtttggccaggcttgtctcaaactcttgacctcaggtaatccatctatctcggccttcccaaaggcgtgagccactgccccggccccagtgatttcctttgcctctgcaccatggcccactctggagtctaagagtaacattaattccaggattcctttgctcctttccaatatcctgctgcaaatgtagaagttctcgcctttataggcagcctgcctagcacacaggacacagctctgggcccagaggggatggggtgtgcccatcaggtctcccaggtgttcttcccaccagctgtgcttttattcactctcttggggcctcagattgtttaccctgtaaaatgggctggggtcatgtgattcaggaagatgtgggaacaaacacactgttatttaaactcctcaagcagtttttgttttgttttgagacagggtcttgctctgtcatccaggctggggtgcagtggtgcaatcacagctcactgtggcctcaacctcctggctcaagcaatcctcctgcctcagtcccccctgtagttgaaaccacaggtgcacaccaccacacccggccatttttytaatattttgtagagatggggtctcactttgttggccaagctggtcttgaactcctgggttcaagtgatctgccctcctcggcctcccaaaatgctgggattacaggtgtgagccactgcacccaggctatcaagatatcaagaagcrtttttttttttttgagacggagtctcgctctgtcacccaggctggagtgcagtggcgcgatctcggttcactgcaagctccgcctcccgggttctggccattctcctgcctaagcctcccgagtagctgggactacaggygcctgcaaccacgcctggctaattttttgtattttttttttttttttttagtagagatgaggtttcaccgtgttagccaggacagtctcgatctcctgacctcatgatccgcccgcctcggcctcccaaagtactgggattacaggcgtgagccaccacgcccagccgcaagaagcatttttacaaagcattcagcatccttcgcatgagactcacagagcctcagaaagaatatgtaggatagaccccaggttggttcttcctggagcagagcgttgcagaatagtctgcagactgtgaggctctccttatacctggagggcttgtaaaatgcagattcctgggccccatcccactgaatatgatcctctggaaccaggatcccagaaatctgatttttgaagtggtccctcttgtgtactttcaaatttgagaaccatggtctaagcaatggagagatggcctcagatgagccctgggatcctggggctggctgccaccacatgactcagctttcacaagcgctgagccatgagaactgcaaaatgggtcagatgacagccaaactctcccatcaacacaacccccatttaaagcatatgcccaaattcagagactatgagttaaatgagggttgagccctcctcaacattaggaggttggtcaggctgggggaagggcaaggcctctgactgtgtgcatctgcaggagttgtgtcagcaaagaggagcacagagaaactccacctgggggagcatggctggtgcaggctgaaaatcatcccatccccaggcgccccatgggcctgggctcactcctgcacattgtcccttcttacaagctctctggagcctcagctgcaactgagagctgaacctaggtccctaaaaacccggagggcagggccagctgacatggtctstctgccaacagctgcagtcagtccctgcatggttctctgctcccctcccctccacccactttgcctttcacagcctcccagagcttttctccttgctcttgggctggaatggatttaaacaatttcgtctctcacggcagatgcctgcctgcccccgccccrccatgacccactctggagtctaagggtaatgttaattccaggattagctccagaaatgggggtcataaacccataccaaaggctcaatctttgaaagaatcagttagcacagtctaaaagaaactattttttttttttttaagagacagggtcttgctctgtcacccaggctggagtgcagtggtgccatcatagctcactatagccttaaattcctgggctcaagcaatcctcctgcctcagcctctcaaaacgctgggattacaggcatgagccaccacacccagccctaaaagaaactttagttctcagcctccaatagccttcctaatcctccatcccccaaagtagtgggcatagaggacctgacagaaggagagtgtggctggctcagttcagccatccctgctgcaggaggagcagctcagagcccagaggcatctgcagaaggaaagactgacagctcctggcaagccttggcccttggcctcaccaaacctcagtgggtgctggtgcagttaacctgctgagaattccttcttggcactggtggttcatgatgttattcttcccatgcagacatccctgggcttgagtagggcttggtgggttcccctagcaccaaagagtaaagaacgaaaagttgggaatgatgcatggagaacattctctggtgcatcgtcatgcccccatcctttccctacaggggcgcttggtgtcttccagcccagctgagctgtccaatgccctctccggagacccttgtcagccagttgtctcccagcctctctggcaggaccgtcagaaatgcccttgaatgatcacatggggaggtgttgactaagtctgctgaggcctacctttagccctactctctttcccaagtttaggtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggcyttggtcctggggagctgggtgggaaggaaggcagggatgccacaaatacyttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggtgagaagcataagtatctgctgcaactcctgtgccaggtggtggggaacaggagggcagccagtagggcctgcccctggaaactcttctcaaggtggcattagctcttggcaatatcctcccttccatctaagatttgttttccagactgccttgagccaatyagacccactttggaaggtttcagagggctctgtgggtctctgagacgagcattctgatgccttgaccttaagtgggcagctctcaaggaattcttttggtgcatgcagaggggatgttgggcatggcctcagccactgctggctcctctgggagactgtgcacctgctgaccttaatgatgcacctgctaagcctctggtcctctggcttttgaggaaggcagtcattctgggagtgagaagggtggttccaggcatctcctctttagaatcccayccaggttccttctcactgcaagaattttccagtacactcaacactgattctaggtggaaagcatcctattctcacaccatagactaacatasatgggtctattcatctgtgccctcttttttgccccctccctttatatcttcttgcaaagcaagcatgctgcatgtgccaagcatgtcactgtgagttgccctaccctcgctcttatttaacctgaaccaaaagctgggggccattgcccccattgatcgatcacaggggaaaactgggkstcagagaagtttaatgaattggcctgcatctcgctgctagaaggtgacgggcccagcatttaaatatcaactctccagaccctgtggccatacacttaccacagtctatttattagtctgagtctgggctttaaaaaaaccctgtccagccgcctacttttgaagttagctgttggtgaccgttcagatttgctctatttatttaagattggcatctcagccccttccttgaggaaggatttgaagcagctgacagataaattgccctgtaagagaagatgctttcaggatgaagggaaaggtgtaaatgcattcaagacacagcactggctctctcctgcaggcagagggcaggatgtgcgaggacttccaggatgaggaccacgactcagcctcccctgacacttccttcagcccctatgatggagacctcaccactacctcctcctccctcttcatcgacagcctcaccacagaaggtaagttctgagcccaggaggggagcagagaggaggccaggaaggagagctaccyacccctctggggccccctctctgtccctgacagggatgatctcatgggatgggaactgccccatccttttatagctaagggggcctgaagttcagacagtttaggtcacttgctggtgagaagcagagccagatttagaacttgaactctactcctgggctctaaccactgtactggcccacatcagggctacagacaattcactgtgaagaggggaaaaattaatagcccaggccagtgccaggtattttatataccttatctcagctaatcttaatagcagtcctcacagaacctgaaaaggctcatccctgtagcaggtatgaactcagtccatacactcaggcgtgagagaaaggctgccttgtttttctgtatgatcacctgacttctcactttcaggccctggagtgatggatggggaattccacctcagctgtccatccaccctgactattcaggtcttgcaatctaggggcttccctgctacctggaggcctgggggtcttggttgaagctgccagaggtccatccccgtgaatgcaccaggcggtgtcccaggaagccttgtgcaggctcctccggtcctaggcctcaaatctcttccctttctcccatgccccctccaggattctgtagctatgtctgagacattcctctcccttatcctttttcaataccctgcatctcggccaggcacagtggctcacacctgtaatcccagcacttcgggaggctgaggtgagcagaccacttgaggtcaggggtttgagaccagcctgaccaacatggtgaaaccccgtctccactaaaaatataaaaattggccgggcgcggtggctcacgcttgtaattccagcattttggaaggccgaggtgggaggatcacgaggtcaggagttcgagaccatcctggccaacacagtgaaacccatctctactaaaaatacaaaaattagctgggcatggtggtgggcgcctgtaatcccagctactcgggaggctgaggcaggagaattgcttaaacctgggagatggaggttgcagtgagccaagattgtgccactgcactccagcctgggtggcagggcaagaccctgtctcagaacaacacaacacaacacaaaacaaaacaaaaccctgcatccagctttgaaagccccttccccttaggctaagactgaaagacttgtgggttctttacagcctcccctgaaccaaatatctgcttgaaaggaataatggcaagaaggaaaggaaagaagaaaaaagttaacattttaaaacattattcagccacgtttttcttccccctctagccctatgttaggatttttttttttttttttgagacagggtctcactcttgctcaggctggagtgcactggagtgatcatggctcaccacagcccgcaactcctgggctcaagcaatcctccaacctcagcctcccaagcagctcggactgcaggcatgtaccaccatacctggctaatttttaaaaattttttgtagagatgaggtctcactatgttgcccgggctgatctcaaactcctgggctcaagcgatcctcctgcctcagcctccaaaagtgctgggattacaggcctaagcccccatgcctggcccatagtcctttcttatagataaggaaagaggctcgtaaaggggcaaagtaggttattcagggttatgggaggggtaagtggtgagatgttctttccacaatgtcccctttcttttttctttctttttttttttttctttttttttttttcagacttagtcctgctctgttgcccaggctgggagtgcagtggtacaatcccagctcactgcaacctctgcctcccaggttcaagcaattctcccacctcagcctcccaagtagctgggactacaggtgcacaccaccacacccagctwatttttgtatttttagtagagactgggttttgccatgttggccaggctggacttaaactcctgacctcatgtgatccacccaccttggcttcccaaagtcttaggattacaggcgtgagccactgcacctggtgtgtcccctgcctttctaaacgttacctagaaaactagagaacaaagtcagtgacccatggacctggctggggggaggttgtggaggagaatgaatgaatgatagaaagcatcagcatttgtggggaccaactatatgcccagtaggatgctaaagtagcgcataaattaacattcagtcctcccaacaatcctggatcttgatactgttatatccctgttttataaaggagacactaaggctcagagaggcagatgactttcccaaggtcacacagccaagaagggatagagtcaggtttcatctagctccaaaagcagagatctttcccctcaaccccactgcctctcttggtgctgaaagaaatggaaaagggtctatgtgaattcagggtcagggcagagtagcaaagtgtgaaaaagtgaggcagattccgacagctcccattaytctgaagttgctctggaataacaaggagctggcactgagagcagagcacgtggtggtgctgcaggggattcaatgaaaaagaagcagaggctgggagaggaggcttacgcctgtaatcccaacactttgggaggctgaggcaggcagatcacttgagctcaggagttcgagaccagcctgggcaacatggcaaaactatgtctctacaaaaaatcaaaaattagctgggcgtggtggcgcacatgtgtaatcccagctactcaggaggctgaggtgggaggattggttaagcctaggaggttgaggctgcagtgagctatgattgcaccactgcactctagcctgggtgacaaagtgaaacgctgtctcaaaaaaagaaaaggaaagaaagaaagaaaaaggaaaagaaaaagaagcagaaagaaactttgccctttggggagctggtgacagagtccagggttaaccttccagtcaaagaaagctcctcctacaaggaggtagtccctgattagttactgccagttaaccccctaggcttactgagggcatgttctgagcccagcactgggccagggcggggaggggtgctgcaaacataccctgccccacccagagggtttagccagacagtgtctggtggaggcacagtgtcagaggctagaagggggtctgtggtggcgtggggagcccagggcacagcacttgggggccaagcctaaatcctgacttgttattactgagccccctgggctgtcctacagcccaccatgtaggtcctctgtcctacagaggtagcgagttctgtttgccagttttattatctgtgtgcatcccctgccagctaaggaatgggtctcatttccatgttttgtgtagtggttcccaacagaaaacattcattagagtaaaaagtgaagacagttagggctctatgtccttccagtcctggaagaggtggcaaagattctgaagttacatctataagagaaaaaactttttggagggtggaacaggatcttgctatgttacctaggctggacttgaactcctgggctcaaggatcctcccacctcaacctactaagtgctgcaggtacatgccattgtgcctggtttataagaaaaaacatttttaatgaygacttccccccacatgcccaacttgcaaggcatcttggcaggasagtttgagtcactctcctgcctgtgtggttacagcccacacagggagacttgcagaggcaggtgtgggatagagtctttcccatacattctatgagggtacaggctctaacagggagattgaatgaagggacccagcactccagccagaggggcctgcctgggcaggcagargtagaaagcagcagggcaggaggagtgggagacatggggcctggatttaagagccgttcacttgcagtcaaacgctactcacttaaatgaaccagatgacctctgagtggcaagtagctgtcacaaagcccatgcatttgattgcaaagagagacaggcactcacccagaacaactgtgtgcagaagggcttatcttataagcaacagaacagaacaccttgatagccacaagaagtgacaactaacaacagaaaatgaccactcatttgatcaacattgcatgcatttcttcctgtgtgagttctcatgtgatccactaactcaggagccaatgtgcattacatggagccccagcaagatggcagctgggaaccagcccttggtgagtgggagagaggctgcgtgggcacagtgtggccaccttcagtcactctgggagggactggcagtgggcggcactgtgtccttttgtctaccagtggtaggtgcagactgagccataattgatcttcaatggtctagatttgcaacaagttgattcaaatcaagttaatttgcccagtgatatttaagttcctttgcttagttttgatgaatcaattcattgttttcaatttgcagtaacgaaatagattcaaagttgtgtttaaataccttgttaggccaggtgaggtggctctcgcctgtaatcccagtgctctgagaggctgaggtaagaagattgcttgagcccacgagttggagaccagcctgggcaacacagtgagacctcatctcaaaaaaatcttttttaattagccagacgcagctactcgggaggctgaggtgggaggatcacttgagttcaggaggtcggggctgtagtgaactgtgattgtaccactgcactccagcctgtgtgacggagcaagaccctctctctaaaatacataaataaataaataaagttcaggtgcttagggcaagaatcttcagtcatttacagcattctcctgacatggaactcttgcttttctttccccataaaaatctgcatgggaaggaaccacaggaagggtggacccttgaaacttacttagaaagccacaggctacaggcctcgaggtatagacagaaagtgggttgggactctctcctgcacactgcagccccagggagtctccaggctgatctgaccttgtgacacataaagcccctcttcaaacccttacacatctctctgtcgccccacagaagaacgtgcatggcctcctattgctctccaggcagccggccctccactcccagcctcatctctcaccagtccccgctcatttactccccagcctccagctacactcaactgctgtgtgacttgagcaagtctcctcccctctctgagcctcagtttccttacctctaaaatgaaagtttgggctgaactttcatcccatctggactcagagtgacaaaggctgtaatgattccactaatctygctccttctgtcttctctctttgaagatgacaccaagttgaatccctatgcaggaggagacggtgagtacagaactgcctgccctcagcgtcagacccagcgcctcttggacccaccccagaagagggtgcagcagtcgcctgggctatttttatgagtgcggagagggagcaacggcagcctgagcatcccagacctcctgctgggtggggaggcaggggggcttctgggcacaggtgccctagatcgaaggaacatgtctaccctagacatttctcatctcagccctgaacctcctgtggttcttctcctggctctctgtccttgaatattcactgcccagaaaggagtgggaggaggggaaggactgagccagggcaggtataggtggggcctgtggccatcccctctgatccccatgggctcatagtcagcaaggggtggagagcagcttctctttcctcactcaggctggcagaggacataaaattgtccgctacaatttttgcaggatgccagaaggtgggactccctgcagcctcctaggattacctagaaggataatctcctttctgagggtgggagctgcccccacctcccctgccctttgcccagagccagctcaggcctttgcggcaacctgtgcaagagtagagatgaaagtgccttccagctccgggggctggagattgtcatcagggcttccagcaggagaggaaagattattaatgcagcacagtgtgatggtgtcccccagcagaggtggagccattgctcctccataggcagtgggtgtgtgtgtgtgttgtgggggtggctgggccataatcccctcgctgtgcaccatgtgctcatcagcagaagccttcatcatcaaatcatcagagccactgcaggctgcgggctgattgccatccaggtcaggggaggctcacctggggcatttcacctcagtcctcccacctgttggcagacagaggccctagccatgccctggagtgccccaggatagtttctctcctgggtgtcctctgcttacagagtgcagagcagagcaaaggggatggggaagacaatggttctgagtgcatgcaacatcccattaaaacttgccacccctagttccctcccaacccacccactagctatgtaggaagaatgcaacatttttgttgccaacctgctcatctgtcttctctacctcattatctcttttaggatagggtgaagaggcaaatagccacccaaggtagtgtcagggaactaggttttttagtggtgggcactgaatttgtgtgtctgtggggaaatcacttaacctctctgttatttccattacctcagtcatgcacaaaaggggttgagcttccagctctgtggaaaatactctctcccccgggacgtatttcaartgcctaggatgttctcagagggtgactgttggcttattagcttccagaggacctagatcatcccatagactttctttgagcttctctgacgggcctgccagttttgttgttttgttttgtttgagacggagtctcactctatcgcccatgctggagtgcagtggtgcgatctcggctcactgcaacctccgcctcctaggttcaagctattctcctgcctcagcctcctgagtagctgggactacaggcgcgtgccaccatgcctggctaatttttgtatttttagtagagacaaggtttcaccatgttggccaggctggtcttgaaatcctgacytcaggtgacctgcctgcctcggcctcctaaagtgctgggattacaggggtgagccactgcggccagcccctgccagtttttctaagagctgaggacacagagttgaataagacatcatccttgccctgcaagaggtcacaatctgggagtggacagtgataggaaaaactatggtcatttgccatcataatagctaatacttattgaagtcatccaaaatgggagacatggtcctcagtgcttgacatggatcatctaattttaaccttcacaataaccctattaggtgggtgttattatccttgttcaaaagaaatgataatgaagacacagagaggttagataatttgcacaagstcacacagctagtaagtggcagagcatagatttcaacccaggcagccagatttcagatcccaaactcttaaccctccgatgccctttgtgaattccttaatagcacttatgtagtggcacagatatcagagagaacttctcttatgatccttattagacatttggggcaacttttacatgattttggaaaactacccagatggtgtcaagaacatgaatgccttactcataatgattccaactcccacccaacctcttccygtattggataagtggacccaaaggctctgtcggctttcatctctgagactttgttagaacccaagaccccatggttcgaccttccctgctcccctgcagcccctgtctgccctaatgatctctccacaggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcrctcttcttcatcgaggtccgtgtcatctgtggccacagggctcctgtctgcytctgcgtcggcgtctcctgggccattcggtccctgcctctccccttctccctctcccctgccacatacctgagaaaacttcatccaccccatcctggcacatttcgagatggctggcgcccgttaagtcctgcaccctgataaatcagcacctcagaactccctcggccctcctgtcctgtggaacagcccctctgcttttgttcccccatttgtgaaatcagaaaaaatccccagaggaaagaaagaaggccacagtgccacatagtgctcatctagtggctgtgcagcctatctccagtgatttatggtctctcatgcccaaatgccaggctcagtacttactcaaagccatgagggaaccagggtctctgcctcttttgcctactgatacctgcttttaaggctaaaattgaggggcaggtgcagtggctccttcctaagatcctagcacttkgagaaaccaaggcaagattacttgagcacaggagtttgagactagcctgggcaacagagtgagaccccgtctctacaaaaatttaaaaaattagcccagcgtggtggcacgtacctgtggtcccagccgcttgggaagctgaggtgggaggatcccttgagcccagtggtttgaggctgcagtgagccctgaccataccactgcactccaacctgggcaatagaggagaccccatctctaaaatagaaataaaaataaaatagacaagccaaataatgataagagctgccctctgggagctttaattgaggatactaagttttgaatgtctcaattctgaagagccagcctgaggggcagcatgggatgtgaggctcagcccccttcactcggggctgcagagctcagcagctcctgcccccagtcctccacttctggcttcttacgagttccccacagagtgcagcagtggtgcctctgtgaccctagtttcttccacgtgggtcacaagcccaccagcctcattaacccacaggcctaggtcattcccccagtttcttaggaggcttagtcattctgaagtcttagcctacctgggtaacacctgggaactgcagatccctgggccacagggattctgatagggcaggtctaaggcaggcccaggaatctgcattttatttattgcgagacagtctcactccgtcgcctaggctggagtgcagtggcacaatcttggcttactgcagcctccgcctcctgggttcaagcaattctggtgcctcaaccttctgagtagttgcgactacaggcacgtgccaccacactcagctaatttttgtatttttagtggagacagtgtttcaccatgttggccaggctggtcttgaactcctggcctcaagtgatctgcccatcttggcctcccaaagtgctgggattacaggcataagccactgcacaggccagaatctgcattttaataagccccctgttgactctgatgtggatcctgtgctaccttggagggttatcttggcattttcagagcctcaagcatcatgccagccatctctgagccactccctcacattgcagtcctaggtctccacttggtgtattgctgaacctttcagctgtgagttctgcagaccacacagtgaaggataaagtgtcctccttccacactctagcttycggcaggtttcccagtggttgggggatcacagcacggaacattttagggagagggtccctgaagktcagttgtgtggctcctggtaggcccaagtgccccagggcccttataagagacagtcttggttggytctgtcgctcaggagtgtggggtccccatgggggcgggggcatgcccactgactttgcctctgtgccttctgcagcgtagacctcaccactggccagccatgaagtttcgcagccaccctgaccattccacctatgcggaggtggagccctcgggccatgagaaggagggcttcatggaggctgagcagtgctragaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttrtttaaggggcctttacctattcctgcacctaggctaggataactttagagcactgasataaaacgcaaaaacaggaatcatgccgtttgcaaaactaactctgggattaaaggggaagcatgtaaacagctaactgtttttgttaaagrtttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagayggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcrgtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctrttcggtgccrggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagmctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcrtgcytgtactcccagcactttgggaggctgaggtgggagggytgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtawacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattgktctgtaaatccctggaagtaaaccccatgcatttttatctactgtctgaggacatacaataaatctgagaaagtctatgctgtcacatttctggatgctttgcatttgaacaactttagcggcctcattgtgtttttattactttgtggttttgctcacaaaacatggtttagcgagccaaaacaaagagaggaaaaatgtgaacacctcacagccaaaatcagtgatgccacatttcaggctccaaacaagccaatttataaataaacatgctgtgttcgccaaatcaagaggaatgtgttaagagaagacaacgtgaactgatggagaaggtgctgagctggacggggagtgggaaggtgggagcttggcctcagccctgcccctgagtagctgggtgatgtggacaagtcactggacttctctgggctggcttccacccctgtgaaataggaggtactagactaactggtctaaagtgggacctgagcaatcagctgcctggtcctttttcaggtcacacagcaacttagaccaaagcatgcctttctctttcattatcccgatagggtgaccaaattgttctatccaggactctcctggttctaacacacaaagtcctgcatcccaggaatctcctcaatcctgggcacattggaatgttatagaaccaaaccaggtcttctcacctggcgcaataacaccagatgtccacactgagactttgcagcaatagagaaaggaaggcatttgtttgcaggactccaagcaaggagaattgggtggcttatgcttaagatatgaactcttgatggcttgcaggtaaggtttttttgttgttttttttttttttgagagagtctcactcactctgttgcccaggctggagtgcagtggtgcgatctcagctcactgcaacctctgcctcctgggttcaagtgattctcctgcctcagcttcctgagtagctgggactacaggcatgcaccatcacgtgcagctaatttttgtatttttagtagagacggggtttcactatgttgaccaggctggtctcaaactcctggcctcaagtgatctgcccacctcggcctcccgaagtgctaggattataggcatgagccgctgtgcccagccacaggtaaggattttaaaaggcaggggtaaatttcaggaaagcagatgttacaggtaaaatcataaatcaatatatggaagctatacgttggtttgacctaaaaaggcaggacgtctcaaagcaggacccacaagtcataaggtgggttcaaagattttctgatttgcgattggttcaggaggcgaagctttgtctagacatgtgggatcagcagaaaagaatgttagctctggctcatgggcaatggcctcctccaggtccctcaggaagaaatttagaacaacgaactatagtcagagtcagtcctcagcacccgtttatctgaggtctacatgccagcggatcccttttggaggggtctgggcttctgaaaaacaactcagggacatacgttaagatgttatctttagtttgtagagaggggaaccaaacatctcctggctctaacttcctcagctattgttttagactactattaccttcctgcttaccaagttgctgatttacttctcagggctagctaggatttccctgaaggaactcaagattttcctttatccccatgtgtgggtgtccccagctccctcgccatgtttggtcccctctacccttggcacagccctcccaccccattggctgaagaaataatgatttcaagcacctggaaagcactttagaatatagaaccttgctagttaaagtctggtccagggccaggcacagtggctcatgcctgtaatcccaccactttgggaagctgaggtgggaggactatttgagcccaggagtttgagaccagcctgggaaacacagggagacattttctctcaaaacaaaacaaaaacaaaaacaaaaacaaaacaaaaaaaattagctgggcacagtggtacatgccctgtggtccgaactactcgggaggcttgggcccaggagttccaagcttcattgagccatgatcacgctactgccctctagcctgggggacagagcaagaccctgctttaaaaaaatgtaaatctgtataataaagtgtggtccaggccaggtacagtggctcatacctgtaatcctgctctctgggaggccaagatgggaggatggcttgaggccaggagttcaaaaccagcatgagcaacacagcgagaccttgtctctacaaaaataaataaataaataaataaaataataaagtgtggtccagccaggcagcattagcattccctggggttagctggaaatgcagcactcaggccccccaaccccagaactactgagtccgaatctgcatttgagcagctccttaggtgactcctgtgaagggcatgaaagtttgagatgcaccatttaggaagcaattctacctacatgatcgcagcctgttggagaagcactgtttttcctttcccagatgaggaaactgaggctcagggaggtggcttacttatttattcacttgatccacattcattaaacgcctgtgtgccaggcaccattaagtgacttgcacaaggtcacacagctagtaagtagagaaaaaccccaagtgcagatttttggattcccatctgaggttgttctctgtgtacctcagggtgttgccagaaccacatggccacagtttaatatagaagcagattatggattatgacagacagactgctccaggcctgtagagatcctcgaagagatgcctagtgatgacttcagatcctcgctcttggctcacgaaactgtgagcttaccatctatttatttgcacagtcccaggagcttgagaatgtcctagttgttgctgcctccttctcatcccgctgctcacactagcgaccctcccacatgaagaattagaagtactcctcacaagccttacagagcaccaggcgatgcctccatctaatttatcttcttggatggaggacaatggattacttccttcgccaagatggggccagaggtgcagggaggaaggaagaggggtagaatctttacttcaactgtgaaatccagagagaaattttgtggggaatgatttttctgatgttcataaaacatttttacatttggtccctagagatagctaaattacgcctacagttttccacaaagctaaaagcactgaaaaaaaaaatcacctgaatatgggccaataaaatttcatcataccttcccagagtcttgggttagaaccttcccttccagcttgtctttcccctttttcagtctctctccctcaaagtttgtgtggttttgtttctttgtgttttgagacagggtcttgctctgttgcccagactggagtgccgtagcatgatctcggctcactgcagcctttgcctcctgggttcaagcgattctcctgccccagcctcctgagtagctgggaccacaggtgtgtgccaccatgcacggctaatttgtgtgtatttgtgtgtgtgtgtgtgtgtgtgtttgagatggagtttcgctcttgttgctcaggctggagtgcagtggcgtgacctcggctcactgcaacctccacctcccgggttcaagcgattctcctgcctcaccatcccgagtagcggggattatagacatgcaccaccacgcccagctaattttgtatttttagtagagatggggtttctccacgttggtcaggctggtctcgaactcccgacctcaggtgatccgccctacttggccttccaaagtgctgggattacaggcatgagccactgcacccagtcaatttttgtatttgtagtagagacagggtttctccaggttggccaggctggtcttgaactcctggcctcaagtgatacgaccacctcagcctcccaaagtgctgggattacaggcatgagccattgtgcccggccttagatcccatttttaattaagagatgaagatgctgctctcagcaaacctgtgcactgactctgctctcctaaggaacattaagcaattccaagagcccctcctcaaggccaaaagggcagcctcctgtagggcctaccttcccgttctcagagcctcccttttctctctctttttttttctttcttttttttttagagacagggtctcagtctgttgtccaggattcagttcagcgatgcaatcatggctcactgcagccttgaattcctgggctaaagtgatcctcccacctccgccttccaagtagctgggactacaggtgggaaccatcatgcctggctaattattttattttttgtagagatggggtcttgtttttctgcctaggctgatcttgaactcctgggctcaagcaatcctcccatctcagcctcccaaagtgttgggattataggtgtgagccaccacgcccggatggagcatcccctctctacagctgctgacacccctctctgttccctggggctcttctcccccaggcccattacagactgagcagaatcctcccagctgtgctcactcttccctctgcctctgtagacaagcacttagccctctttagccgtgaagaaggagccacaactaacaaaattaggcagaggtaaacattacttaaaaccaaaggtcctggtctactgacttttggactctgggatggtactgctggtggtgctgccggcagctcacatttactgggtgtttcctatgttccaagcacattttaggagatttacttgtatcgtcatctatggggtgggtgctgttgctacctctaccctacacaggaggccactgaggcacagcgcaatagggaactgtatgtttttgtatttttagtacagatagagttttgccatattgccaaggctgctctcgaactcctggtctcaagtgacccgtccgactcagtctcccaaactgctgggattacaggcatgagccaccgtgcccagcctgatctttaaattttttctgtagagatggggtctcactatgttgcccaagctgagatttcttaaaaagggacagcataaaatgacatggggtttagcatcagtaggtttgagttcaaccttaagcttccataattcttgtcaggaaccttaagcaagtcaattaaccaccctgagtttgagtttcttaatctaaaaaaaccagagaactggaagattagtgtggcaatgcatctgaaaatattctgtaaaccagagtgctggacaaatgctaatctattattgaattcagcacttcatttcagcggagctaggaattccatatttggagccaccttgacaggagatgtctgaaaaagctgcttccggtggcatgccttttgggctccgtggacagccattgctgaataaaacttaatgacgccatagaaaccagaatgggccactgcagcatttgggaagacccggactgaatacaaaaggtcaaactgggaaaatgctgtgaacagtgaaagctgtgggggtggtcctacgccaaataagcgcatgaaatctcacgcccagaaaacaaaaccgcccatgccttcatattccccaaacgcttcttcgagaaggatgcaattcaaaacacttcccacttaaccaacaagttttcttcttaagatcctaaacttgaagaagtcctagaaggtaaaatgtgctgactggagaggtacctctccgggactctaaaaatctgtttggggtagctgtctgctggggtcccctctagaattaagagtccttcagcgggccaggcgcggtggctcacgcctgtaatcccagcactttgggaagccacggcgggcggatcacctgaggtcaggagttcgagaccagcctggccaacaaggtgaaacccccgcctctactaaaatacaaaattagccaggtgtggtggcgggcacctgtaatcccagctactccggaggccgagtcaggagaatcgcttgaacccgggaggcggatgctgcagtgggcagagatcgcgccactgcactacagcctgggcaacagagcaacagt

SEQ ID NO: 12571 - DNA, 18703 bp, Homo sapiens
  misc_feature (1)...(18703): n = A,T,C or G, or insertion/deletion polymorphism (see Tables 1-2)
ccagtcgcctgccgttgctcttggaatgagacctgggagccccacagcccctgcccaagggcgtccccagcgctcccccgcttctctggcctcctagttgtgcacaggcccggctctccccaccctgtgaccttcgcttctgtggctgcaggcccttctttgggtcccttgggtctcagcatagagccggcttccccccagggcttccctgaccttccttacaaaggaagcagggcagggagtgtgggtgggagggctgtgggcaggcacaggtgttttagggtcaccctgagcgctctgtggagaatggccagcagaggctaggtgaccaggcggggccagagggaggccgggtggggagaggtgatgggcagagagcggggcagcgggggtgtgctgtggggtgggggctgcggggcagagggaggaggaggggccgggaggaggggaaaggaagagggtgggggcagggaggaggcctcccactgttctctccctgggtttctgaggatggagaagcaggcggtgtagttgggcgtgactttctgcaagactttactttctgtgggtggggtatatcctccaggacctctgagggggcacaagcgagggtgagtccagacccaccctgtggggaacctgggtcacggaccttctctgggcctcagtttctttgtctgttaggtgggtgtcaccctggcctgtgggcagctggtggagtgctgaagccccctgtgccaggggcccgtggagggcccttcgtgctgtctgtgcgccacagcatcccactcctagaggcctctgggtctcctcgagatgccagtgggagctcctcctccctcctcctgctctgcccacggactcctcctcctgaggccccttcctggcgtccttggcctctgttctgggcacccgggaaccagtgactgggctgcagggcctgcgtgtggccctggctctgctcccggagctgccgcacgagaaggcgccaggcccaggttcctcggcagatgtgaggatgggggtgctccttgagcgggtgtggccagggcgcgcctcctccccgcgggtgggccaccctggcctgggcccgcggtccgcagcccgcctctctgtcgccacacaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctcctctctccgccgtcaccggggaggccggggatccttgcagggcttctggggcgttgggaaacccaggcccgccggccacggctctaaaatgaagagggcggagaccccagtgaagagcaccccccgcaatccgcgcagatccctcccagagaaggccctgagcccaggcggcagccacccgccccccttccgaggctgtgtctctgtttagaactgaacacgagggtggggagtgggggatgctggaccacagggcagcacctgcccggcaggatgcgcgtgcctgtgagccccgggactccccagggtcctgggcactggggctgtggatcctcggaggaactcagagtggttcccctgaatttcccggccctggcgacgaggtgctggtcccagagacaggtgcaggcacaggcagtgccacaaagaccggcccgggagcggggcaggggccagggctcagccgctcccgaacagctccacagctttcgctgcaggaggtttggttctgatggaaggatgttttctacagagagatggcacaactgctcacaagaccagggttctagccggagcccaggtcgagctcagctccacgacccctgctggtcagcccctgatgcctcgtgaaggagaggagtctcacttgccaaaggaggctggagtggttgggggtacacacacccttggttgccttggagaccgtgttgggtgtggtgccagagggcagctgtgggtacccctctttgtcattcacagggagggacagagcctccctgcctggcaggacgtgatccctggctgccaggggctcagcgggtaaagggggtgcactcgccgggaccagccgatgcctggggcacccaggaaacgcagctactctgcagcatgctcagcctggaggctgagaccccagcagtggatctaggcctgcaggtctaggtgtgtccacgcttttttggggacgggaaaccagcatttcaaagaagggagagaaccggaaaccgcagcgtaggcagctccctcggaccccagtgtaatgggggagttgcaggaagagtgaattttcagtgagagtcggccgtgaagaatggcaggagctctgctgagtcagagtcagccagggacgtctgcaggccaccctccctccccctcaggcnnnnnnnnnnnnnnnnnnnntccgcaggccaccctccctcccccctcagcccagggacctcgccctccctccctccctcccccctcagcccaggaaaggcacaggagaggatcctgccaggtaaagggaaagtggcccgggaggagcccacgtgccaacaacaggagtcccagaagacagaaaagaccacagatgagaaagcagttcacgcagagaacaaaacgttcccggaccaaacccagggtcgggttgctcattcccgaggcccgatagcgagatgcagatgaactggggaagaagagggattttatttctgtaactggttacagggagaaggcctggaaatgatcgccagaccaactccagattacagtttttccagagcttacacaccttctaagctctgtgtctccgtgtcagtgtgcattcgtctaaagacgtacgtgattcaattcttctcatctctaactgaggtctggtcctgaagatcttcctctgaagactcagtaaatttacttgatctaaatgggcccaggtgtttacccttatcttgttttctgctaaatcatggaggtttggggagttccttctccacttgtttgtggaggcctggggagttttttcagacccccagtaaaacttgtttaatcctaaacgggtcctggtctcgtcatgcttcaaggcccaagaaagccctgggcaaaactcttgatgggcttttgttacgtcccagccctcgtgtgagggcgctggctctcagctttcaggatttcacttcaccctcagtcagtgctgaacagttgtcgcggaggcctgcgtgagtgaggcctggcgtgccctggaaacattcccctgagttgaagaaagactcacagttttcagcatccagttaccctctgagcatcaggcagaacccgccggccccaaaaccaggcccccttggcacatgtgggcccgagtgagtccagcatgaggaggtgccgcttctgagcagagctcaggttgtctctgggaggaggagcgagcgttgggtgcggtggccgctgcgttggcagccctgtccctgagcggaacgcaggtcgtctctgggaggaggagcgagggttggactcagtggccgctgcggtggcagccctgtccccaggcgtggactctgccctcagcttcacagtcaccgaagaaatgaagttacaggaggggcacaccgtccttttgtctctgcctttgaggttggcgggaactgaaactggtacggtctttttgaatagaaatttggggtctttctggcgacgtaaaactgtgtgtagtttgcagtagagagtgttgagaacagcctgtctgggctgtgcattgagaaggggcggttaaaatgctgccacgtcgtgcagcccataaaagggggacacagagtagccgaaactgctcttgggggagggggcacgtcccagccttccgtgtgatgctggggtcagcgtggcccctcggctgccagagctcacgaagacggttaaggaaagcttcccccgggtggctttcaccccacggggacagagccccagatgggcccagggacctctgagcagccgtgggccatggggtgacagttgggggttggtgggacccgtggctgtcatataccctgggtagacggtggcttgtccaggcagagatgcccaggggaagtgggtggcacctgagggcagatctgacttttcaagagaagctgaaaacacgggtttttctgtgaaatctctagattgaaaacagtgggcttgaaaagcctggagcagagggagtgaggcctgctccccaccccagctctgcgggcacaccctggccagacagccctgctccagacccggcctgtgtctcagggtggcccaggaggggactttgcaaggtgacgtggggcttggaggtcccgtttccctgtaagcctgggtacttaggggatggccctggtcagactccaccagtcccagacttgggggacacgagaagggagatgggccacccagttctggttgggctggggtggggcttctgaggggtggggaggttgtcccttcccacccacctgcccctgccccaggattctcggctgtgagcaggaggatgtgtacgatggccaagttgcctggactgggtccgcccctcctggggctgtgagtgcacaggacactgggcccacaggcacctctggggctctgtccccgtggggtgaaagccactggggggaagctttccttaaccgtcttcacgagctctggcggccgaggggccacggggggcattcagatgagtcagaaggagctggggcccacccctcctgcttcctcgccgcccccctcccagctgcccccagtaaatcccctcaggcccctaggacctggagggacgcggcaggtttatcatctcagcctggaaaccacgtgacctacctgtttcccaccacagcgccccaggtttcagaagcagctgaggatgcccttcgcaggggagggagggacagtgagaaaggagggtgttcagggcccagggatcccccacggaggctgccccatcagaacttaccggggacctgtggcctcctctgagattctggcctgggcagtggtcatttgagcattggttaccaaggctgcctctgaaatggcaggctgggggcaggccagcgtgaaagggactggcaggagtcctgcggggacaggctgggggcaggccagcgtgaatgggactggcaggagtcctgcagggcagctgtgctggggaggggtcaccctgggccctgagaggcacaggacattgcgatggggtgctggcctgccaggagcacagatacagagctagagcccagcgaggcctgtgctgygaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtstcctcagcaccccagtgttgagtgcmttgacctgcagasgggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctggtgagtccctgccctttgcacccccagcaccctcacccctctacccgggcgcccggggtcaggacccgctcctgaggtatctgtccagctggccgccccctctgtctgggggtgctggacgagtcccactccttgccaaccccagggtggctcctcagctctcaaacaaggggcgggctgcagggattccgagggcccctccagcargaggtcccacatgcatctcccaatgggacacttacctggcccacagggtgggtgtgacactgagggttcctgggggcagattcagggcatgggatggagacagactggttgtgaggggcccaatgcagggggccggccccagcccacagggtcgttctgcagatgggctggtcggggacgctctaccaggtgaagggtctrtggtcggagtcttcgccctggccagggcccaggacgctcayggtgcaggctgagggtcagagccgccgagggccccctgccgggattctgtgcaaagggcctctgcactttatgtgggtgcatgtgaatgcccctcgccaagatgttcctaccctgcacctgacacttcccacgacaagaagtgctgaccccagagggtgtgcgcggaccccagagggtgtgcgtggaccccagagggtgtgtgcggaccccagagggtgtgcgtggagggcctggtctgacctcaaggctcttggggcrcccacacaggatgggctgtgaggggttggcgggggtggggggggtggtctgtgatggccccctgctgagccagagtgacccctacaaccggtccaggggtccacggaccagaaggccaggttctcctggaggtcccatctcccctgggcctcggtttccccttctgtgactccacacccccaaggagggccctgtcagggagggcggggggcactggttaatgtccaggacatggctgtcccagtcaagccaaacccctggaatgtgctgaactggctacactgagcggggctggcctccgagacagaggggcctgccgaggacacggaggctctgtggaacccagggcctggccacactaactggggctggcctccgagacaggggaggtcctgaggacacggaggctctgtggaacccagggaactggtcacactgaggacacggaggctctgtggaacccagggaactggtcacactgaggacacggaggctctgtggaacccagggcctggccacactgagcacggctggtcccccaagacagagggacctcctgaggacacagagtctctgtggaacccagggcctggccacatggaggacacggaggctctgtggaacccagggcctggccgtggcaaggaagccccaagccaagtgtgtgtcagccttgtcctctctgtgggcctcagtttcccctctgtgcaacaaggggagtgaccagctggtttctggagtctcctcctctccctctctgtccccaggggtgggcctgggcctcatgtctgcagggggtgctgacacctgctcctgtggtccgggccttggggagggagccaagtgcagagagaatgtcttgcttgtgcctgctcagcccagagggacacatggcgtctgcacctgcttcccgcttgggcacaattgccctttgagagcagagccaggggcttcttggggacggaagctgctctcagaagccgcgcactggtggtgggggagcrgcaggaaggggccggccagctgtcctagccaagagcctttcaggaaccggtggcccagggcagaggtggctggaggtggagctgtctgtttgggcctcaggtgtcggggcaaggcctgcttgggttttacacgagtgttgcgcctttacccgggtctctgtcagtgggtcccgcctgacccgtgggtgtgcatgggtccccgtcgtaggcaggcgttctgccctggccaggcgtggtgtccggcatccggccatctccctcctccctccttcccttagccccgcatccaggtgcccygtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccaggcaggtcccgcctgcaacaagcagaccccatgcgtgccccaaatgccccctcacccgggccctgccctggtgggtgttgcctgggagcaaactcccagaatggccgccgggccccactcggctttggagcttctgattcctgtgggcgcttctcaggtcagggccctgcaggtgggaagcaccaggcactggaatgagggcactgtggggccagctgcctgcaggcaggggtctgatcaccaagcacctgtcccctgcaggatccctggctgtggctcccccgatgacgttcaggaagtgggagccgatcccctgtccccagagagccccgtgactcccccgatgacgttcaggaagtgggagcggatcccctgtccccagagagccccgtgactcccccgatgacgttcaggaagtgggagcsgatcccctgtccccagagagccccatgactcccccgatgacgttcaggaagtgggagccgatcccctgtccccagagagccccgtggctcccacaggtccctgtgggctcacctctttgtgtctctgctgtggcttccacggtgctgtggcctctattctggggacactgagctcctccttgctcgaggttttgggtcctcattgtccacatgacctcctgctgggcgaattctgggatgaccctgtgtcctgggcacatggctggcagggtcccgggggctctctggccagcctcccstgcaccctggcaccaaccagcctggccgagggtcagctcccagagccgtgttgagaggggaaggggctgattccacagacatttggggtgsagtgggtgcgagggagggtgggggaggggctgctccagatctggggtgagggagtcagaaacagggctgaccccaaggtgggtacaggaagaggcccaggtgtgggcaggagctgtctgcacctcctgagcgcgttccccagtccagaccgggagcgagtgtggggctccctgggcctgtcttgctgacctgtggccctgtactgaccagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcgggtgagtgagtggccgggggctctgtgtgggtgtagtggccggatctgctggggctgcacaccccgggatggggcgggggtggyggcggcaggcagatgcccgaggtagagatgagcaaaccaggctcagcgatcctgggtgccctgcggggggctgtgcccaggtccctggacgtcctggtcagcggaacttcctcctctgggcagtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgagcctcccgtcccagacaaatccctctccccaggaccgtcctgagcctcccgtcccagacaaatccctctccccaggaccgtcctgcacctcccgtcccaggcaaatgggtattgatcacccccagtcacccagtgggcaggagcaggccctctatggctgacccgactctctctcatcccccccgctaatctctttatctgcagaggagaaggctggacgctgaggtgtctctcagctcccaaaccaacagccaccccgccccaccccttcctcttattctttactcccttctcaccctgcccagggcctggccaggcctcacccacaactttccctccaccccatcctctgtggccacctgaccccggcccgtgggagctacagcagggagtgcagcagacacatggccaacccagggaccccactgcagggcctcatgccccccgcctgccctcygctctctctgtgtgggcagcgctcaccagcctccctgggtgccgtccacctgggctcggctgctaagrgctgtgagaggcttgttcagcctgggaggactcagggcggctgggatgagtcgtgtggaagggcggtcagagtgcgatggtcctaacccgaggcaccagcccctccttccccgtccccctgtgccttcctccagccccccgacctcrgggacccagcagcccctcccacctctgccctcctccctgcagactgggccacattcgctgtgggtcccggccacggygtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactcygacctggcgtccatcgggccggcycctgaggggggcctggtttttgcctgcctgtacgagagcggggccaggacctcctatgatgagatttccttttgtacattctccctgcrtgaggtcctggagaacgtgcccgccagccccaarccgcccaaccttggggacaagcctcgggggtgctgctggccctcctgacaggccttctggccgtgcccatgccccttgggtgcctggggcagaggggtggaatacgttggggtgccccacratagctgtggggggggctcttagtgcargatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtrttgtgggtggcagcacttgtttactggctgctttctggctcgaaataaaggaatcgtgcttgtgtcggggtagacgtttctttccttttcaggttccagccctggggaggggagctctgctgtagcccacttctctgacccccatcccaaaatcccactgccttagcaaagctctactcctaaatgtcctggggccagcagagggaaggcgggagggaggaagcggcctccgcccctggcctccggtgacagtgatttgcaagtggtctgccgtgctctctgaacttcctgctggaggagtaggaggtagggcctctccccgcagagttgaacgccaggagggggtcaccttccaggaccagtccagtgtcctgctcccctgaccccaccctggagggggcttgggctccactggggctgtttccccagcgaagttcctttttatttcttctccttttatagtcttcatttctgatgataaaagcaacatatgcttactgtagaaaatctggaaaacgagccgggcgcggcggctcacgcctgtaatcccagcactttgggaggccaaagcaggtggatcacctgaggtcaggaattcgagaccagccttgccaacatggtgaaatcccgtctctactaaaaatacaaaaattagctggatgtggtggtgggcacctgtaatcccagctactcgggaggctggggcaggagaatcactttaacctaggaggtggaggttgcagtgagccaagattgtgccactgccctccagcctgggtgacagagtgagactctgaaaaaaaaaaaaaagaaaatctggaaaatgtagaaaactataaagaagaaagagaagtgagcccccgggcccctgtccccacgggcccttccttctggcttcctttcaacggtcctgcccagcctgctgtcacgcccatggacgacggcgccagccggggggtgcacacgtgtgtcccacccatggatgatggcaccagctggggggtgcacacgtgtgtcacacccgtggacgatggcatcagccagggggtgcacacgtgtgccaccttcttcccggccctgaattgtgtgtgatgggctcctttgcacgtctctgggtctggtcaccccttgggctggcttcggtgaccactcccaagggtggggacccacggccagcccccagcagtgcggagcgtccaggtggtctctgagtcgccgagggtccccaggggagcagagatgacctccccttgcggcccccttttccccagcaactgccctgccaggacggctgctgcctgagaggggacaccactgggttccagacgggggcaggatgggggcctggatccggggcccctgacagccctgagttcccacaatcaccccgggcccctccccacctcaggcagcctcagcccctcataggaggggcccgttgcccgggccctggcagtgctggttttagggggtctgtgtcttagtcccttggggctgccaaaatgaaatacacagaccaggggccctggaaacaacagaaatgtatttatcacggttctggaggctataagtccaaggtcaaagtctgtgatcatgagggcaggctccgtgtctggtaagggcccagtttccggctagtggatggcggcctctggctgtgtcacacacggtgggagggagaggtctctcctgggtctcctgtatgggacactatcccattcatgagggctccaccctcccaggaggccccacctcctgaccttatcaccctggagttaatatttcaacatgggaatctggggtgcacgtgtagatcacgtgctgggtgccttgtgtcacgtgtgtgtcctgacttgtggcccgtgtgtaggtcacatgctgggtacattgtgtcatgcatgtgtcctggctcatggcccgtgtgtaggtcgtgtgctgggtgcatcctgtcatgcgtgtgtcctggctcgtggcccgtgtgtaggttgtgtgctgggtgcatcctgtcatgcgtgtgtcctgcctcgtggtgtgtgtgtaggttgtgttctgggtgcatcctctcatgcgtgtgtcctggctcgtggcccgtgtgtaggtcgcgtgctgggtgcatcctctcatgcgtgtgtcctggctcgtggcccgtgtgtaggtcatgtgctgggtgcatcctgtcatgcgtgtgtcctggctcgtggcccgtgtgtaggttgcgtgctgggtgcatcctgtcgtgtgtgtcctggctcgtggcccgtgtgtaggtcgtgtgctgggtgcatcctgtcatgcgtgtgtcctgcctcgtggtgtgtgtgtaggttgtgtgctgggtgcatcctctcatgcatgtgtcctggctcatggcccgtgtgtaggtcgtgtgctgggtgcatcctgtcatgcgtgtgtcctgcctcgtggtgtgtgtgtaggttgtgtgctgggtgcatcctctcatgcatgtgtcctggctcatggcccgtgtgtaggtcgtgtgctgggtgcatcctgtcatgcgtgtgtcctgcctcgtggtgtgtgtgtaggttgtgtgctgggtgcatcctctcatgcgtgtgtcctggctcgtggcccgtgtgtaggtcgtgtgctgggtgcatcctgtcatgcatgtgtcctgcctcgtggtgtgtgtgtaggttgtgtgctgggtgcatcctgtcatgcgtgtgtcctggctcgtggcccgtgtgtaggtcgtgtgctgggtgcatcctctcatgcgtgtgtcctggctcgtggcccgtgtgtaggtcgtgtgctgggtgcatcctgtcatgcgtgtgtcctggctcgtggctagcagggtcatcacagtccactcttctgccttcagatctgaagcaaaggagccacaggcctctctggggttctggaagccgtggagcccactgcagctctgcatggcccattcttcgtcattctcttctatactggggtgagcggcgtccccagcttcatgtccccctggaagctcagactttgctaccttatttgcaagtagggcctttgcagacgtgatggaggtaagaggaggtcatactggattgcagtgggtttagcccagtgacgtccgtccttgtgagtcacagacgcagggaggagccatgtgaaggtggaggcagaggctgcagtgatgccgccaccagccacgggggctgctcagagctggaagaggctgaaggaccctgcgctggagccttcagagagggtgcgggcctgtcacccttggcttcagacggcctccagagccgcgagaggacgcatttgcattgcttcagccgccagtcggtgagatttgttgcggcagcctgggaagcagcacaccttcctgcctttgccgtctgtccgtccgtccgtctgtccacatgggcctcagaccccgggggatcctggccgtcactgcccggccatgtgcagcctcggcctgtgtcagacagacttgggctcgaggtccccaggagctccggtcgccgtggtggagcctctcgatgtctcgggctgtctgcggctggagcaccctctgagctggggttgggtcaggtctgaagaaggggccggagctggccctgccaagggcccctcctagcagccgtggcctcctcaggtggggcccagggctccgaggccctgactcctccaggtctgggcagctgctcaggaccggggaaggctctgccaggtgtgatgccccaggctgggagagggtgtggcgggggggctgcctggctcagggcaggttgagcccttcctcctgccctcctgccactgccccagctgtggcaggctcaggacatctggtgtctgctggtgggggggtcgctgtgcctggggacagtccttcccccctgctgcactgggagttcctctggcatcctgggaggcctgtgcctcgagagagaccagccccctagattcctcccaccacgggcggctccccggcacccaaccggctcctgagcccctgccccacctccacattcccgacggctgctctcccagcctcttttccttccttccacccctgtatggtttcgatctgtgtcccctcccaaatcttatgtcgaattgtaattcccagtgttggaggtggggcctggtgggaggtgactggatcatggggtggactctcaggaagggtttactgctatcgcctcggtgctgtcctcatgacagcgagttcccccgagacctggctgtttaaaggtgtgcggcacctccccaccttgctgctgctttcgccatgtgacgcgcctgctcccccttctcttccaccaggattgtgggtttcctggggcctccccggaagccgagcagatgccagcaccacgcttcctgtaaagcctgcagaaccggaagccgattaaacttcttttccttaagaatcacccagcctccggtgttccttcacagtagggtgaggggggcgaacgcacaccctgagccttaggggcaactcctgctgctgtgcccaggctgggccgggcagtggctcaggaacgtggcggggaacacggtgccagtgctggggtcagggctctgtcgtggaggcaggatgtctctgtggttccttcctaaccctcatccttttacctcttgtcctggcttactgggctggcaaggacctccaggaagatgttaaacagccttgatgtctgataggccaaacaagggcccggaagccgtctgcatcctcactccggggcctgcaccatgacgtcatggcgaagggctgcgccgagggggccggctgagggtcttgaggtgagaaatcatcctggtcatctgggtgggtccagggtctcaccagggtccttatgggaggggacaaagggtgggagaggagggaagaggccttggagctgggtttgaagatggaggaggggccacagctgaggagccggtggcctctggaagctggaaaagacgggaagcgaagcccggacagcctgcagaggaaccagccttgcggaccccttgatgttagcccggggaggccatgtcagacccccggcccccagaacttctggggatgcatttgtgtcgtttcaacctccaggtctgtgtgatttgctatgcagcctcgggaaacagctgtgtggccaccagggtcccaccctgctcccgccttctgggctccaggacgcaggtgtgggacccctcaccatccgcatggccctctgctgtgcactctccttctcgttcatgtctgtgctgcattctggttggttttccttggcttttttttttttctagttcacgaattctctctttgctgtgtttaatcagctgggagttactctcttgctccctctctccctcccccatcctttctctgtccttgtctctctgtctctgtgtctgtctctgtttctctttgtgtttgtgtctctctctgtctctgtgtctcgggctgtctctctttgtgtttgtgtctgtctctttccgtgactctgtctccctctgtgtctctgactctgtgtctctgtctctctgtgtctctgactctgtgtctgtctgtgtctctgactctgtgtctctgtctctctgtgtctctgactctgtgtctctgtctctctgactccgtgtctcttctctgtgtctctgagtctgtctctgtgtctctgtctctctttctctgtctctgagtctgtctctgtctctttgtgtctctgacgctttctgtccctgtctctctctgtgtctctgtctctgtgtctctgtctctgactctgtatctctgtctctctatgtctctgactccgtgtctctgtctctctctgtgtctgagtctgtctctgtgtctctgtctctctttctctgtgtctctgtctctgtgtctctgtctctctgtctctgactctgtgtctctgtctctctgtgtgtctgtctctgtgtgtctgtctctgtgtctctgtctctgtgtctctgtctccctgtgtctctgtctctctctttctctgtgtctctgtgtctctctgtctctgtatctctgtctctctgtctctgactctgtgtctctgtcgtgtctctgtgtctctctctg

SEQ ID NO: 12572 - DNA, 16457 bp, Homo sapiens
  misc_feature (1)...(16457): n = A,T,C or G, or insertion/deletion polymorphism (see Tables 1-2)
aaccccaacgtgctccatgctctaccaaatgcttggccgtgcgtctctcttctctgaaaaccttccacggccttctctgcccaatctttctctaaaggggaagttgaggccctcaggttctcagcattgatgaggcccctgtctacagacacacacagctccaggaaacaggccagtcatagtgcagagatcaaggagtatggacaggacttacaagttcttacaaagggaaatagagcaagaaccctaacctgggaaaatctgagagcaaaggcagctgcacacgccacaccttctgagactctgagcagacaacttcccttttcaggaaggaaagaaggtggggccgctccaactggccccaagtgcccagcctctcccaacggtccctcgtgccccgctgccttctcagggtccccaagaagacgctggctctgttgccatgtctctgtcctagccacaaggcctctggcttctcctgtgtgtggtcccgacccaccttccaccctaccccccttcaccccctcccctcttacctgctgctatcctttgccacctttccaaacagcagcttctggagacagccaatgaggtctctgatgcagaaggtaaccagagcattgaatgctgcaacgaaaaggcctggatgtactcacgggacagagaacgcaacagacagcctggatgccaggctccccccaagctcaccagcactgtccgtgacctggaatttgttggcctcagcactttcctggtcccctcgggtggtggccacagctgctcggaacgcctgtaccacttcatggaacagctttggagtgaggcgttgctgaaggagcaagagtaccaggggcgtcaggggagctgagactgcacttggcagagtggaaacggcagccccagagaaaggcaccctcaccctcaccctcagacatagggcagaggttggggggaggcacagagccccatactgataacaaaaatggaaacaaagtctagaattctctgggaagaggagggagtctggctcaggagccccaggaaaaggactgggagttccagatcctggactatggccacctccaggtggtatctggagctctccgtatccttgtccctggaaaaaaacactgtgagaggctcagaaggaccccagctccaccaaccaacaaaggcacggtccgtcccacccacagcgggactgactttggggagtggggcgccaacagagcccctggaatctacccaaaagtgaacacacagtcctggggcaaccaagcaagcaggaggagcaacgtgttgtcacttgcgctgaagaaggctccaagcgtcccctgcgtggagaacagcccctcccaccagcacagcctcaggcgcctcaggtgaggcaaggccagatctctgcctgggcacccagctgcccgcccctcgctgctgctcacctcaggtgaggcaaggccagatttctgcctgggcacccagctgcccgcccctggctgctgctcacctttgctgcctgcttccatctctcaaccatggcgacggtcacaggaacagaattcttcttccccttcagccctctggggactctgtccccatcttctccttcctccgctccatcctcctcctcactggcttcctgcacagaaaggctgagctgaaggagagtgtagagacaagtgccccccttctggtttggcccacgccctcacctccagcacatctggcagggagtggaacggcccctcttcctcctcagagctgtccgagtcgctgaagtttagcaggctctggtcattctcctgcaggaacttgtagaactcggggtctctgtccttcagccgagagagctggtctttgtgctcagaggcacggcctttacgccggctgaggaggcagaagtcagcgaccccagtgggaagtggaagtagagggggcggggagtggcctacagggtcagtctactcccttcacaaggattaccaactagcaagacaggattgccaggaggtacgtttttggcagactcacgtctcctacccaacaacctctacaacataccctcaaacacactacacaggccccccagccgcggtcttccctggacttgctgtgcctgcgccctgcgctacacaggcccccagccgcggtcttccctggacttgctgtgcctgtgccctgcgctacttttgcctgatggtggcttcacccttccagaggctcagactaaaggcaaatctctgtctctaatacccagcacgcaacttgtcatcagatctcatcagcaacaccttcaaaaccgttcgtgcctcctctcaaaccaccacatagttcaattctcagttaacctaaaggtctctctgtttccacccttgtcacctacaaggcactccaccgctcaaacccagaagtaactccctgttttacgaggcaatcttatgacggtctacggcacctggctcttcatcacccttctgggctcatctacccctattcaccccctcactcctgccatagccacgtttacctctgtactctccccaaatgctcccactgcaaggcttttgctgttttctgctgcctgaaatcctaagacacgtttcccctactgtctgtgtggcctccttgttcgaggtctttattcagacgtcatcttctcaaacaaccacctccgcttttttttttttttttttttttcctgaggcggaatctcactctgtcgcccaggctggagtgcagtggcgcaatctccactcaccgcaacctccgcctcccgggttcaagcgattctcctgcctcagcctcccgagtagctgggacgacaggtgtgtgtcaccacgccaggctaatttttgtatcttttggtttctttctttttctttttgagatggagtctcactctctcacccaggctggaatgcaatggtgccatctcggctcactgcaacctccacctcccaagttcaagcgattctcctgcctcagcctcccgagtagttgggattacaggtgcccaccacgcccggctaatttttatatttttagtagagacatgatttttccgtgttggtcaggctggtctcgaattcctgacctcaggtaatctgcccgcctcggcctcccaaagtgctggcattacaggcgtgagccaccgagcacagcctccgctccttctaacagagcaactcggctcccctgcaactctctcttcagcccctctgtccttcctttccctccccagcacttatctctcttctaccgaactgcaggcggtgatttcacccaagaacgtgagagttctcctagatcgggaagagatttttgcacaactcaccaacatacgctccctgcctaggacagagtttggcacggaacaggagctcagtaaacatcggatgaaagagtaagttaagctgaaaggactggggggcagaggtcggcgatccttaggccttggccctgagaccccaggcgaggtcagcaacccaaccggggtgggacaggacgagcaagaggttctgctcacgcatgtccccactaacctggccgaggggctcccgcccggcttatccggactccgggcagcctcgcgtgcttcccgtgtctccgcttgtggagaattttcggactcggattcggactcggagtcaaagcccgaagctaggaactcgtccaccgtcagctccgccaggcgcctgcgggtcacgcaggagtcacagctgcccgcacgcccagctcgccccagccccgctgagaggagcaagaaaagcccccttggatacagacacccaccgggaggccaaatcagccctcggacccgcggcttacctcttgcggctccccgcagctgccatgacaccaacccgaagcgtgcaccccacttccggccccagaatgccgcgcggctgcgcacttccgccgcccaggccccgcccctttccccgccccgccgcgccacgcccagccgagtggctctatggttctccgaccgcaacgccggcggcctcagggcgggagggcgcgttcgcgtgctcggtgcgggcagccccggtggggcccagatgcgcctcccgctcggcgcccggctccgtaggacgcggtgacgccggtgtccgccccggggaagacagaccgggagtcccgccgcgcccgcagcccacccggcgctccgaaggcacgcgcctgcgaggacgccagactgcaacggcggggctcctatgcaaagagctcccacaaatcaacaataaaaagcagggagtccagtggaaaacgcgaggggcagtgggaaccgcactgatgtcgccagctcgacaaaagacgggcgacccgagggccaggctggcttcgcctccgatccgcggagaccgggccagcgccacgaacaccacgcagggcgctccccgtccatggccctctgggtgccgaccgcggctcttcccggggacgccgcacgggacgaagacggtggggaggccggcgccttccttcccgctaccagcctgacacccgggcccccgggcctggacagccagaccccgcgacaagggcgccgcggggcgcaggcacggctcccccagccctggcgctgagggggcgcgtgaggcgaacacgggcggattggcctcggggtcccattcgacttcttggtgccgcggggccccggggctccccggaggagagcaagttagggggtcgggggagcggggatggcttccgggggaggaggagggcgaggcctggggggctcctcggaggaggaagagggcgaggcttaggggggctccttggaggaggaggagggcgaggcttaggagggctcttcggagaaacaggagggcgaggcctgtggggggcttcccggggaagaaggaaggcgagacctaggggggcttcccggaggaggaggaggaggagggctaggccgggggcttcccagaggaggaagatggcggggcctggggggcttctcggagaaggaagatggcgaggcctagggggggcttctcggaggaggaggagggcgaggcctggtggggggcttcccggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggacgcggggctctgttcgcggctctgactacgccccgggggagcaggggcgcagcggaggcctggacacggcgcgctccggggcgggggtccttggcggaggtcaggcgagggctgccggcgcccccgtcgcaccaggggctgggtccccgcgggctgcccgggccccccagcggctccagggcgggcgggcggctaccagcggggcgaagcctgacccgcccgcctcctgcagccccgaggcagagcgcacgcggccccggcaggctcggcccgcagcccccatggagggagccgtgcagctgctgagccgcgagggccacagcgtggcccacaactccaagcggcactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaagcaagtacccgcctgggcggcgctgggggctccgtgggtccctcgggtcagctcgtgtaacccgctgtccccgcagatgagatgagcgagagccgccagacccacgtgacgctgcacgacatcgaccctcaggccttggaccagctggtgcagtttgcctacacggctgagattgtggtgggcgaggscaatgtgcaggtgagggctccctcacccggatcccggtgtcccccgaccctgtgcctccctcacctgcctctcggtgccccgtagactctgctcccagccgccagtctcctgcagctgaatggcgtccgagacgcttgctgcaagtttctactgagtcagctcgacccctccaactgcctgggtatccggggctttgccgatgcscactcctgcagcgacctgctcaaggccgcccacaggtacgtgctgcagcacttcgtggacgtggccaagaccgaggagtttatgctgctgcccctgaaacaggtaacagctggcgggcccagccctcgccccccaccccaccccaccccagtctttgtctttgactcccgaccccgttttgttcctgacacagccctgcccacaatccttagtgcctgctgtgtgtccccgagaccttcctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactyccaggttytggaactggtctctagcgacagcctgaacgtgccttcagaggaggaggtctaccgagccgtcctgagctgggtgaaacacgacgtggacgcccgcaggcagcatgtcccacgggtgaggcgcggccgcggggggctcccayagcatccaggagggcatgcaggtggctgagggcctggtgcaccctgaccttccccgagttcagggactccgtgggggtggtgcccccacctgtctgaagaagaatccatcacacaggtggtacgggcatctggggggttgtctcagccctgacgcccagtgtgcccgagggtcccgcctgaccttggcgttccctgcaccccagctcatgaagtgtgtgcggctgcccttgctgagccgcgacttcctgctgggccacgtggatgccgagagcctggtgaggcaccaccctgactgcaaggacctcctcatcgaggccctgaagttccacctgctgcctgagcagaggggcgtcctaggcaccagccgcacacgtccccggcgctgcgagggggccgggcctgtgctttttgctgtgggtatggccccccgcccgtttccctcytgccctgtgccttctactccccaccagcacaagcccaccccacctgtgccggtcaggtcctgacctgcccctccgcccctccattcaggggcctctccaggagcctggggtgtggcccagcagtgggatccactcacgagtccygtctccacctgccctccccaggcggcgggagcctgtttgccatccacggagactgtgaggcctacgacacgcgcaccgaccgctggcacgtggtggcctccatgtccacgcgccgggcccgggtgggagtggctgcggtggggaaycggctctatgctgtgggcgggtaagcctggaggctggacttgggtcgggtctggcacgtgcccgccaggccagtcttgacctgcagtggcttaattccgctagctatgatgggacctcagacctggctaccgtggagtcctacgaccccgtgactaacacgtggcagccggaggtgtccatgggcacaaggcgaagctgcctgggtgtggccgccttgcatggactcctgtactcggccggcggytatgacggggcctcctgcctgaacaggtagttggggttggggccccagtggctttgtacagtccatctgcaagaggcaagtttgtgtcaccatcacaggggtcgtatctgatggggtgttaaaggaggtgatccgcgaggcygtttcaccccaggccactgccacactgggcctgaactcttggctttgctgccccagtgccctttcctctctcgggtccttacccccagtccagaggctgggcccaggtgggtgtgcacccagggttgttcaggcagccagggtcctgtgcccaccagcgggccctgcctggtaggactttgcggtctgagtttgactcctagggtaagatttcagccattccgctggggagggcaggtcctggggccgggacgcctttctgtctctgctgagctgtggctgcggtcctggtgcccacagtgctgaacgctacgaccccctgaccggaacgtggacgtccgtcgctgccatgagcacccggaggcgctatgtgcgagtggccacgcttggtgggtgatggggcctgcctggggggcatccccaccttcccccaccgtggagaccccactcccagcaggagtgccacgggtgtgttgacttccggcagatgggaacctgtatgctgtgggcggctacgacagctcctcacacctggccactgtggagaagtatgagccccaggtgcatagtgcacccctcctggccaccccctcccgtgcgccgcggggccctcctccctctgtttacccacatcccccccattcctgacaccccaccctggagtcggggctgcggcagaggagggatgccagtggcgggtctgcgtccagcccacgccctcgcccccaggtgaacgtgtggtcgcccgtgtcgccatgactgagccgacgcagctcaggtgcgtggccgtgctggagggtgccctgtacgtggcagggggcaacgacggcaccagctgcctcaactcggtagagagatacagtccaaaggctggagctggtgaaagcgtggcgcccatgaatatccgcaggtccgcagtggggctggtggaggggggccgggtccgagtgggcctgttggaggcctcgcgcgtcctcagtgggtatgtttttggttaccggggccgggtcccgctgcggatgtgctgcctgcccggcctcattcccagtcgtgctatctgtggtatccttggcgccacatccgcttctcagcgctccgccctgctcttgcgtgcctcacgcgcctttcccgtcttgccgtgttcttctcttcttccccctcgctatgtgagacgtgcgcccagctgccgtcgagtctggttcgtcgtttcgttcctgttcnnnnnnnnnnnnnnnnnnnnnnnnnnnnnnnnnnnnnnnnnnnnnnnggagttctcccaacctcagcgagcatgtcccgccaccacccctttttgtggtgtggcccctccccccgcatcccttcctgcagccaggggctcaccccgccttccccccaggagcacgcatgacctggtggccatggacggatggttgtacgccgtggggggtaacgacggtagctccagcctcaactccatcgagaagtacaacccgaggaccaacaagtgggtggccgcatcctgcatgttcacccggcgcagcagtgtgggtgtggcggtsctggagctgctcaatttcccgccgccatcctccccgacgctgtccgtgtcctccaccagcctctgacccacctaccaccagaggcctgcagcctcccacatgccttaaggggaccgtggcccccaccagggacgtcctgcgccatccgttcacgtctctgcatccattccttcatgtctttatttagttgtttatttatttagttatttatcttatwdagaggtgaggagtgccacggctgcccgtttacacctttagcgtctggtcctcctgcgtgtcctcccctccactgcctgcatggggggcgcggggagtgaccaggcgggggcctcaccgccccagggccgttgcctgctcagaccttgcaggctgtggagcaagaggccctgggtctctccaagcagctgcagaccccagctcgaattttgcacatggcggggtcccgggaagggtggggagcaggtgtccttcctgtcgtcgtctgccgtgtgccatctttcctggatcttgtagcgggtgcacacgcgtgcactgggaccccacacagcaatacgagtccaacttaataaacacatttctggggttcctcaggctgagcatctctctctggcatgtggggcagctgcgcaactttgggtcctgtctggggtccagggtgaggggtgtgggggggtgccctgagatgcgcaggcatctgggagctgcaaggcagagctgtgcgtccagggagggtgggggccgtgcagttcctgtggaccagcgtcccagtgtgggtggcgtttgcctgggctgggtactgaggccgaggtccccgccacatcgtgggctctggggttagggctggggaggacagccttgcccccgagtgcgctgactgtcttggccgtctagggggcatgtggcctccctgagtccccttaagccttggggaccctgactcgggtctgtggcgagggggcccaggcaggaggggaggctgcggtggctttggccgccgtctcctgtgctggaactcctgcctcagccctccctgcagtcaccggtgactcaggccggccagagtttagatggaaacaggatgtgtgggcacgttgtccgggggggcctggaaggtcgccccgggttcaccaagccggagcacaggcaggtggggtacctctgcacactggaggcctcgtctgggccagaggggtgcttgccccaaggctggcctctcgagtggagggcccagggcagagacctgcacggctcaggtaggggccaggcctcttccagaaaggctccaccctcgcccaggccctggtgccgggcgggacgtcccggagccccgcctgcccgcgggaggcgggggcaggaggctgtggacagggacccagacttgccgacctgtacgactctggccatggggaacagccactgtgtccctcaggcccccaggaggctccgggcctccttctccagaaagccctcgctgaagggaaacaggtgagcggggcgtgggtgcggccacctgggcgcagggctcccccacccgctccggggccaagccacgagaccccttgccttgtccccagagaggacagcgcgcggatgtcggccggcctgccgggccccgaggctgctcgaagcggggacgccgccgccaacaagctcttccactacatcccgggcacggtgagcgcggcgtgcacggtggctgtggtctgggagcgtggctctgcccgcgcgtgtgtgccgtgtgtccgtgcagctcagggtcttcccctcgcccccggggcgttcagaccccggtaggtgaggagccgacgctgactgccccgccctggggagctcatccggccgaaagtctgagcggagagcgaaaccgcgacgcaggactgagtcagtcgggagagagctgggcggggcgggccgcgggcggggcctcccgggacctcctcccgcaggggaccagcgcacgtgtctctgtcgctgcagtggggcttggggtcgtgccggcaggtagtgtcacttgagagtaaggggcctcagatgagcagcgagccagccggtcacctacaccggcctttctccctgggtgtcccgcaggaagttgccgctgggtatggccgcctggtccacagcaatccctctgtgcacgcgccggcctcctcccagcttgccaaggccatgcagcaaggaggtgtctcccaagcacacactaggccacctctccgtcaaaggagcagaagaccacccccatgcccaccccccgccagcccctgtgggactaagggtcttcacagggtagatcccagcccctttcagatgtgtctggtgctgggatgagggaacaggaccaggaacctgggcttcagggcagacaggaacccccactgcacccccgtcaggcagcctggatgggtgggctccgctatgtgcaggccctaggagcatctgcgggagaggacgcctgccctgcactcctgggtccagcagctggcatgaccgtgcagacccctttgccaacatgcccccgccaggcaggaagctcgtgccataccctctcctgacctccagagtttcagggctccctgcagacaagtactggtttcggaaaccacgctgcctcagaggagtgggcagggagagggagccgggctgggttaggggtggggtccctgtggctgcatctcagacaccactccctctgtccaggcccaggacatgcagtgtgaccctggggggtcctatgaggtgtggtgggtggccgtagtggtcctcccttgccaggacatggtagccacagaggcaacaacctgctgaacctcgggaaatggggctgggggaggagctctgggccagtcctagagccagtgctccgcggccctgtacctgggctctgcacccagtgctgtgagctggctctactacggctccaagctgagtcctccccggggccccgaggctgagctgcgctgcagggccagctgtgtggcccttcctggtctgtggcctatttttcatgggtgccaacccggcatcagttcccacgctgggtgtgggtacaggaggccccacccagaggcagaaggccgggaaagccatgcgtctgtctgttcacattcctgggcctgctcaggggcagctaagcttggccagggcacagcagctctgcaggtagctctcgccagctcctagaaggaggaggacaccttcccacttggccctgagcctgtggatcacagaggtctccagccccaggttcacacccgtcccttttctgacttccaacctggtgatcaaagcctgcatttgtagaggactgtgtgtgccaggattgactacatgtggcgtggatgtggagtcccctcccctctcagcacatgcagtgatacccacagcacatcccaggccctgtcttaggctctggggacacagcagtgaacggaatagacaacccctgttctgctagtgctcccattcccacggcagagacacacgacgggacaaatcaatagatccagtgagcggggtcaggtcggtgctaaggagaaaaacagaggggatgagtgcagaggatcagggaaggctggaattttagaaaggctttcagaaaaggaattcttggagcaggtaatgtctgagcaaagctgcaaagcgggtaaggaggggggtcaggactgagcggtccccaaagcaggaacagaacatgcagcagccagagagcatgggtctgatgtgaggagacagtgaggccggggcagccacagagacccctcgggggagacccctcggggcactgccaggaccccgttgtcccctgagtgaggcatacggagcggccaacacacagaggatcgaccccagaaatctcctcacatatttcaggctgggggctggaaatgggcaacggtgaggacactgacaccgaggagattggcaaacgttacaaatcagggcatcggtgtgtttctgtgtctgttttttgtagaaccaggtgttaagcatttaccatacaatactgcagacgtgggagggttttgagtgttacccagacacccccaaattcttctaacaagtcttcagaggttgaataacccaagccatgttacacagcttaggaaagaatgaagatgggtttaatccactgagtccagatctcaccatctctaccactagaccaggcagctctgtgtggggaagtgtgtctgtgtgtgcgtgtgtgtgcacaagtgtgtatgtgtgcatgtgtttgcacgtgtatatgtgtgcacacatctgtgtgtatatgcacaggtgtatgtatacgtgtgtgttggtgtatttgtgtgtgtgtggaaatgtatgcatgtatgcagtgtgcatgtgtgcatgcatgtgtgtgcatgtgtgtataggtgtgcatgtgtatgtgtgcacgtgtgtatgtgcacgtgtgtatgtgtatacatgtgtatgggtgtatttgcgtgtggatatgtatgcatgtatgcacgtgtgtgcatatctgtgtatgtgcaactgtgtatgtgtgcacgtgtgtatccatgcatatgtgtgcgtgtgtgtacatgtgtgtataagtgcgtatgtgtgttcccgtgtgtatgcatctgtgtctgtattgtgtggcatgtatgtgtctattgtgtgtgtatgcatgtgtgtgtgtgtgcatttatacatgtgtatgtgtgcgcatatatggatgcatgcatgttgcctgcatgtgcacgtatcgggtgtgtgtgcgtgtacgtgtacacgaatatgcatgtatgcatatatgtatgcacgtgtgtgtaaattctgccgtgactgttttcctgtggaaaggctgagtgtgcaggttctgtgcctgtggggggctgttcttcacgtatgtgttgtgtggctgtgcacaggttctgtgcctgtggggggctgttcttcacgtatgtgttgtgtggctgtcacaggttctgtgcctgtggggggctgttcttcacatatgtgttgtgtggctatgcacaggcagaccatgctatagtcctgtagctgtgtggatgcgagcggagggggtagggcccaggaggccccatcccctgagctctactcctcctaggacatcctggacctggagaaccagcgagaaaacctggagcagccattcctgagtgtgttcaagaaggggcggcggagggtgcctgtgaggaacctgggaaaagttgtgcattacgccaaggtccagctgcggttccagcacagccaggtgggggccgggctgggtggagcacgctaagggtgcagcatccccatcagcctggggctccccagactccgcactgacgaccctgctccccgcgcaggatgtcagcgactgctacctggagctattccccgcccacctgtacttccaggcccacggctcggaaggactcacatttcaggtgaggcggtgggcaatggggtggggccatggccgcccttccctccatggatccctgaagctcctcctaccctgtgcctggcaggggctgttaccgctgacggagctgagtgtctgcccgctcgaggggtcccgagagcacgccttccagatcacaggtgtttgggatgcttcccgggcccccagaggcactcctgacccaggacttggagaggggcctgccctgtggctgcggagcacgtgtgtgtatgtgtgtgccctctctgccctgcccgcaggcccactgcccgcacccctcctggtgctctgccccagccgggccgagctggaccgctggctttaccacctggagaagcagacggccctcctcggggggccgcggcgctgccactcggcacccccacaggtcagtgccggggaccccacccccctccccaccctgatcctcgcagccggctctgacctcctcctcacaggggtcctgcggagacgaactcccctggactttgcagcgccgtctaacccggctgcggacggcgtcagggcacgaacccggcggcagtgctgtctgtgcctcgagggtcaagctgcagcacctgcccgcacaggtgggtgggaggtgcgtggggctgtagggggatgggaggggtgcatggtggtgggcagggcggtgcaacagcagctcagttccctcatcgcctgaccccacccccacccacccaggagcagtgggaccggctcttggtcctgtacccaacgtccttggccattttctccgaggagctggacgggctttgcttcaaggtgggcccctccccactgtgggcccgccccagggaggcagctgtgtgggggtgggagggggcagccatgcaggaggaacctgtatttcggggcttgttgagacagagcgcagggccctgcccacccagcccgcggtcctggtcagtctggtctccgctgtgacatggaggagcccctgcccgccctgaggttctcaccctgaggttcttgaccgtcaccctggggcgggcagcatggggctgagagcccctcccggggactcccttgtgtgtgcctgcccgtgaggcgtgtgtgtgcacacgtgcgtgtgcgtgtgtcctccagggcgggctccgggaagggggtgtgcactcacggtaaccttcagtcactga

SEQ ID NO: 12573 - DNA, 25673 bp, Homo sapiens
tttattttattttatttttttgagacggagtctcactctgtcacctggactggagtgcagtggtttgatcttggctcactgcaagctccgcctcccaggttcacaccattctcctgcctcagcctcccaattagctgggattacaggcgcccgccatcacgcccagctaattatttttttgtatttttagtagagacggggtttcaccgtgttagccaggacggtctcaatctcctgacctcgtgatccgcctgcctcggcctaccaaagtgctgggattacaggcatgagccaccacacctggccgatccttaatccttctaataaccctacaaggtaggtactacagctatcccccttttcaggcaaagaaatcaagtgacgggggaccttaaagagtttgtcaaaggtcacatgaccaactgcagcaatctaattccagcccacacacccgctcttctgggattgctccatttcctaatggtgctatcagccggcaaaggaatgacaaaaaggcctctgagaggagctactctaaacacaggcaacgaacaaataaaaatcagtgactataaagacagcatcaaacagcagcaaaacaaaaatcctagcaagaattatagcatcaggctgggtgcagtggctcacgtctgtaatcacagtactctgggaggccaaggcaggcggatcacttgaggtcaggagttggagaccagcctgcccaacatggtgagacctcatctctgctaaaaatacaaaaaattgtccaggtgcggcggctcacgcctgtaatcccagcactttgggaggctgaggcgggcggatcatgaggtcaggagctcaagaccatcctggctaacacggtgaaaccccgtctctactaaaaatacaaaaaattagctgggcatggtggcgggtgcctgtagtctcagctactcgggaggctgaggcaagagaatggcttgaacccgggaggcagagcttgcagtgagccgagatggcgccactgcactccagactgggcgacacagcgagactctgtctcaaaaaaaaaaaaaaaaaaaagaaagaaaaagaaaattagctgggcatggtggcaggtgcctgtcatcccagctacttgggaggctgaggcaggagaactgcttgaacccaggaggttgaggctgcatgagctgagattgtgccactgcactccagtctgggtgacacagcaagattctgtcactgtcacacacacacacacacacacacacacacacacaagaattacagcatcaaccactgagatgacttctggcaaatgcttgcaatcttcagctttattattacagcatacgattagtatcactccgtaccagcaatagctccaaccgaaagaacactcattagtgcctcatcatcatcctctcttccctgcttagctttcttcagagaaagactaaagtcatccaatggagcaccaagagaggattctagaatctatacaccgaagcccatgattctgatgtgctgcctctactggacattagtttgatgaggtttttctccatacttctaagtatgtcaaagagaaagtatgtccaaaatcctccttatctatgtgcagtactctccccttatctgctgagggtacgcgccaagaccagtagatgcttgaacctgcagatgctgccactaaccctgtatatgctatgatttttcctacacacacatactgtacagcacggatacactggacaaagggatgactcacatttcaggtgggacagcgtgagatttcaccacattactcacaatggcacacaatttaaagcttatgacttgtttttttctgtaattttccatttaatatttttggactatggttgttgtcaggtaactgaaatcgcagaaggtgaaaccacggataagggggactatagtaatataaaacatctttatccactcagtctatcagttccttctcttgggcatacagactaccacaggattacctaatgaccatgcccttcttctgtctcttgaacgaggcagttttagatagtttcaaattgctatcttcctaatcctccttgtggagctgtgccccactcccacatttctgtgctctcctcttgttttgcagagggttagaaggtcagcaaatcagctaaggctttcgatgtgggcttgtaggctctggttgatgccaccttcccttttgttcctccagcctaggggcagccgtggcttcctgcacttactcatctctggtaaatgtcaccttttcttctagcctttccaacattaacacacaagttcctctgggtaaaatatcttaagtgtttttgttttccctgactgaaaccccaattgctacaccttccaaatccaacttacctcttcacttgtaacgaagtagcacttgcaaaatatattactaaccttcatgccaaaactaaaggacacatctctatgatagtacaaattacctgttttttccttctccctttcccccaaattcatccattctctccatcccccccaattctgccttaatagccttgcttactccccaaaataatgaaaaagttaaattattgagccttccagttccgttttactcaatactgctttggtgagtaaagaaattttttagatggaagaagacgcagctagttcttacgtgatcccacctcagtctaatgtgccctgcacactgctgtgaacaaaagaatccacaatctccccacctcccaatcattcatgacaaggaatggtttattattccagtcccaaactcaccatcttcgaacaactcaagcaatttagcaacatacgggttttcatcatcatccccttcaatcaacacaaactgtccaatctggatgtgaatctcggtggaacaaccttctgttttcacacacatttctctaggaagtaacagagaagcacattaggaaataacttaaagtgggtcaagctcttcagatcccctgggcacaaaggagagggctctccaatcctgatttctttctgctgaccaactctcctactgggaaaccaattcgcccagttatatttaagaataggcaaaatgggttgaatgaattgttttagctgagtaatgaatccaaaggtcttattaggaaccctaattcctctcagttattgacaaagaacaacaaatgcttcccacaacaaatgtttcccaaggctgtcaagctgcccagtaacaatgtcaaattgtcagagatctccagggctgggaaagacatagtaaaaacatctatcatctcgttttcatcaaaagttatatagaactcaccttaaatagacatgacattatcctacatacaaaattttatgagcctgccataattttgctccatcactaactgctatatttatcccaccatcttcttgcatcaaacaaaaccctccttacaatcagttctaatctcctgttcattcatggtcaatctgtagtaattagaacaggctagatacaagttgactgtttagcttgagaagctgtatttccaggacaaccaaaggaccccatcactcacctataggtttggtagtgcagttttcgatccaacaagggcctgccaacccatgaataagtttttctggtcttcagccttgtggggtagtgtgccatggcttctgtggaagagtccaaactctgagttaccatgataaatatttggtatttatctgatggattctaagacatagtcagtccctcccttcaaatgagatcagacttattttctgcccctgctacactcccatacattttagactaagaaaacattttatttgaagtcatggtctacgaagattacacacaggcaatttagtatcatctgtgtccatcttgtactatgccgtatctctttccatccaggaaaacagaaaggtcaattcctaagaaatgaaactgtaacatttagaaatactaggaataaggcagaacaataggtgtaaaacatctaacaaagtgaaattaaaagacagtgatacaggggttgtaaatgtcttcatgacgcttataaaatgcacacaaggataaaacagaaatacaaaggctgggcgcagtggctcacgcctgtaatcccagcattttgagaggctgaggtgggtggatcacctgaggtcaggagttcgggaccagcctggccaacatggtgaaaccccgtctctactaaaaatacaaaaatcaggtgggcatggtggcaggcaaatcacttgaacccgggaggtggaggctgcagtgagccgagatcgcaacactgcactctagtctgggtgacagagcagaactctgtctcaaaataaaaaaaagaaaagtagatgttattatcacttcaaggtgataacttatcctatcttatacaggatggcacagccttaactcaaacccggaaaagccagactgcaattactgtgctcttaactacttcaccttacaacacactgtgtgaaactggataatgttaatatgtaactgagagcttgcttttggtgtacttattacaataaatcaggcttcccagccactgactgaacattgtggattgggcctcaatttgcttacccacaaaatggagaaaatagaatcttccgtttattcaaccaatatttattaagtacccatcgtgtgccaggcactattttaggataatggaagattaagtgaaaaaatgcaaaatggtaaatccactttcccactaccttaatcccttgcatttatttgtaaggtacagtggttttatttattaagtatcatttgatgaatactatggaactaacataattcaagcaaaattttgcattcaatttcggcagattcacaaacctcctaaagtccacatattgccctccattaaagttaaaaactgttgcaaagggacttaaaccattctgtcatattggaaactcctttggcatttccagcccacctaacacagcagagacgagggtactattattcatgtgttacagacaactagaatcgtatataatcattgcagtttcacaaatagatcaggataagaatgccttttccaactgtcacagcagaagactcttcaattccggggttagaaaagagaagtaggaagggggccaccagacttctcttctgaaaagaaggtgaatgacagacagcccagcagttaggagctcatctgaaaaaaagatctgggtaggagcccagactgcttagtcacgaaaagcgacctaagacacgtccctccctgggcgcaatttacgtccgtaaaatggggtaataacctctgctccgccttccctgtagtggttcctacactatagctcaaagaacgaaacaagtagagtgctttacaaatgcagatggagggaaagtcatcactgagcatcagggtgcggagggcaggaatgctcctgcttctaggctgttggcttccgccttcccccctgcaaactcagttccctgcagcgcgggaagccttttaggaatcggagtgtggaacagaggaacgctcttaacagttcagaacagtgcctggcactgaacaggcgcttggtacatgtcagctaaaagaatcaatgactgagtctacagagaacgtcctcagtttcagaggttccgatgcgccctcccccgagtccctcgcagcccgctggacgccacactcacccggctccaaagcttcctccggctagccgcaagccctccgtttcctaccgcctccacttcgagagctccgggggatgcggcacctctaacctgcaccagcagggctccttctacaactacgggccgaaagccaggaccaaagcgtgtgtctcactagaaatgaaaagaaggtggaaggagaaaagaaaacttcgcgccaatcggcgtggccccgcccccagaccgtcccttcgttgcgacaccaactagctcgccccgcccactccgtacacctaagaggggcgcatgacgtacatccgctaacatgcagccgccatcattgattcgataggcgacgcggggagcggaagccctttacactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatgagtccaagtactggaaagaggagtgctttggacttacaggtaagtggaagcgcgcggagcgcctctcagcccccttgtggcccatttctcctgaccgagcgcgggtaggactagcgactggcctctgggggtggtactggaacggagtatgtcgatcattcagaaaaattttgagtgcctgctaagtgcctcgtcttgtgttgagtattagaggcacagatgaatctggtaaggtcatattctgaaggctgtctcagttgggtgttgtgagttattccgtatttaatgatagcaggctgggttgcaacagtgttaagctcagggatccggatataacactttgacacaatctgttgaaggtctttaaggacctaacgttaatatgcctgaaaccaaattcatgatcttactattcttagatctgggccggttccagtatttataaatatcagtgcttcagagaagtcttccaggtaatcttccgatttgaattgtggctttaaatccatgtcctgtgacaatctgtggaccttgagcaagtcactttacctttcttagccctcattttccttacctggaaataagaacattgctagaactttcttcatgacttgttaaaaaaggttaagtgagataatatgaaaagcttakcagggtacctattttattatccattctcaatgtatattagctgttgtcgttactgttattaatacacattcgttctcctaatattacactgttgatgtatatttaggagaaccaaagcttgaactaactccactccaactaggaagagcttagccctaatatgttactgtattgtttttgttttttagctgaacttgtagtcgataaagccatggagttaaggtttgtgggtggygtctatggtggcaacataaaaccaacaccctttctgtgtttaaccttgaagatgcttcaaattcaacccgagaaggatatcattgtagagtttatcaaaaatgaagatttcaagtgagtgcaatgttcactagctaatataagaggtttaattttggcggtttagaattgggctttggttaagaggggtgtacacaatgtatctcatttctagagagttccactccagatttttgcttttgagcccttgagtttgtattttttgtttgttttttgttttggaaacagagtctctctgtgttgcccaggctggagtgcagtggtgcgatctcggcccactgcaacccccatttcctgggttcaagtgattctcctgtctcagcctcccgagtagctgggattacaggcatgtgccatcacgcctggctaatttttgtatttttagtagagatggggtttcaccatgttggccaggctggtctcgaactccagacttcaggtaatcccctccccccccgggcctcccagagtgctgggattacaggcatgagccaccacaccctgccaagtttgtattttatctgttctgattgtattaatcttctactttactttctcagttttggtaatttttccctgaaaaaggatttcacagattcactaaatacatattaagcaaaagtgagtgcctgatatgttggtaggcactggacgctcaggggtgaaaatcaaacaacaaaaggtggtggttaagaggtgtaagatctgggttcacatccagattctgttgcccattaactatgacattggagaggttacttaattttctaaactttgcttatctgtaaaatggtgactataatataagagtgaaagaacgtaatgcatgcagatctctgaacacagcacttgctgcatggtaaacacctagaaaatgtcagcttattaccgtattaccgattctcgaggaaatcacaaacaagtataggagacagacataatagcttcttatgtgccatgctgtaagggctttgcatataataattcatttcactttcacaacaaccttctaaacttttaatccctattctacaggagaggaaactgaggcacagagattaattaattttgcccaagttcaaacagctagtaagtggcaaatctggcttcagagttcatattctttgctacagtattctgcttctcgtacaaagaaactatgactttcaaaagcctcctagttacccaagaggaaatttaagtagttagatataggaaaaagggaagaggaacaactcttttttttgtttgagacagagtctcgctctgttgcccaggctggagtgcagtggcgcagtctcggctcactgcaagctcggcctcctgggttcatgccattctcctgcctcagcctcccaagtagctgggactacaggcgcccaccactacacccggctaattttttgtatttttactagagacggcatttcaccgcgttagccaggatggtcccgatctcctgacccggtgacccacctgcctcgcctcccaaagtgctgggattagaggcgtgagccaccgcccctggctggaacgactctaataaagcattaacagctagaaaatacctaacttttgttaggcacttactgtgtgctctgtgctatacttagcactttcaatgcatttcttgtttatataccaagccataaattaggtagcattatctccgttttacaaggattgagaaaacacatgatttgaccagtagtgtcacagacttagtaaattacggagtcagaatttgaacccagatgacttacttttttccaaaaccagcagtcatgtttatgtgtacttgttcttgtattgttattaaatatatcttctttctgttttaaaattcaatatatggccaggtgtggtggctcacacctgtaatcccagcactttgggaggccaaggcaggtggattgcttgaggtcaggagttcaagaccagcctggccaacatggggaaaccccgtctctactaaaaatacaaaaatatgccaggcatggttgctaacacctgtaatcccagcactttgggaggccaaggcaggcagatcacctgaggtcaggagtttgagactagcctggccaacatggcaaaaccggtccctactaaaaatacaaaaattaggctgggtgtgttggcacatgcctataatcccagctacttgggaggctgaggcaggagaatcgcttgaacccaggaggtggaggctgcagtgaattgagatcgtgccactgcactccagcctgggcaacagagcaagattctgtctcaagaaataaataaatacataaataaaaatacaaaaattagctgggcatggtggcgggcgcctgtaatcctcgctacatggaggctgaggcatgagaattgcttgatcccaggaggcggaggttgcagtgagccaagatcgtgccactgcactgcagcctgggcaacagagcaagactctgccttaaaaaataaaataaaattcagtatttcttttgattcttagagtaatcctgtgaggtaaataggttttattctagttttactgatgatatatttgaaagttgatcaatatgtatgatgttcccacagccataaatggtagcatgggaacttgaactcaggtctccatattttagctgtctttcttctgctgcattctacctccacaattgcagctttcttacctgccaaagagaagaacatgtttatccactactgtcatgagaacagctagttgtaaaactcaggaacttctaggatggcctgttgtttcactgtcatctgtctctcaggtatgtccgcatgctgggggcactttacatgaggctgacaggcactgcaattgattgctacaagtacttggaacctttgtacaatgactatcgaaaaatcaagagccagaaccgaaatgggggtaagtatggtgctaagtctcctgattgtcatttttaagccagtttttattttaccagtacttctacctttgcattgtcatagacagtgtgaatgctccttttcatctacattgttactgtctctatgcaggttttcccttgtccctcaygggagttttcagtctgactactagcttcgtgttggccttacccagcctgcctctgtctgtctccctttccaagtgcatcttatgttaatccctgccttgcatcatatgccccctttacatgtgctccatcccaaaagatctagctgcagaatggcttctccataaaaaccttccccagccctctcagacaaaattagttttccatattttacatcttcacagttctttctactggcctctcctctaacactgtaattcacactgcagcatataagactactcatttttatacaggaatcccactgaaaaataagtatatccaagagaggcagctccataccttctacaaggagattacttaatgtgctaaggagggattccaggtaatgcagtcaaaaccttttctcacttggtgtcataacagaagataggaacatttacctttccccctacatgtatcattaaacagtagaaggttaagaatttggggccaagcacggtgtctcacacctctaatcccagcactttaggaggccaacatgggcagatcacttgaggtcaggagtttgagaccagcctcgtcagtatggtgaaaccctatatctactaaaactacagtaattagcagggtgtggaggtgcacacctgtaatcccagctactcaggaggctgaggcaggagaatcccttgaaccaggaggcggagattgtagtgagccgagatcacgccgctgtattccagcctgggcgacagagcaagactccatcttaaaaaaatagaatttggtattatactttaaacttattgattcattcattgaataaatacatattaagtgccattgacatgtcacatactgtgctatgtggtgtaaataccatggtgaacaagatggacatggtcatggccatgatggagttatttatttattattttattacgtaaaactaagaatttctgaacctattgacattttgggtcatataacttttgtgtgaggattggcttgtgcatcatagaatgagtagcagtatctctagcctctacccactagatggaagtaacacctccttctaagtagggggatgggcatgtgcaaaattgcccatggttgagaaccccagaagtaaggtaatgtttaccatggaagttctcaaaagctatatatgtatatgtatgtatgtatatatatgtatttgtatatgtgtatatacacacacatatatatacattttataattatatttacatacaaatatataaatatacataatcatatataatttatatataacataatttatatataacataatttatatataatataaattgcctgtaatcccagctacccaggaggctgaggcagcagaattgcttgaacccgggaggcggaggttgcagtgagccaagattgcaccactgcactccagcctgggcaaaagtgagactccgtctcaaaaaaaaattttttttctaactctagccaaaaacaatatttccttattaaaaacacctcagctctgccatatactagtagtataatcttacgcaaattacttaaatttagttttctcctatgtaaagtgaggttaatgatacttttatatatatatagatgtatatatatatatacacacacacacacatatatatagacatataatttttttttttttgagatggagtctcactctgttgcccaggctggagtgcagtggtgtggtctcaggtcactgcaacctctgcctcccaggttcaaataattctcctgcctcagcctcttgagtagctgggattacatgtgcccaccaccatgcccagctaatttttgtgtttttagtagagatggggtttcgccatgttggccaggcctgtcttgaactcctaacctcaagtgatctgcctgccttggcctcccaaagtgctgggattacaggcgtgagccaccactcctagccagttctcaaaagctatcactccatgtgccatataagatacatgttctaaattcagaaacattgaaggttcagatgagaaattatatttgagttatatgatctcttcaagatcatccctacataattcaggactgtttgtgcttgtttttgtgtttgtctcctgctaattgggacatcttcattcatcccttaatctcttctaaagaggcctagcacatagatgtcctgatatgaagtcttaacacttcttttactttttggcatctaaatcttttatttccaggttgtttgctctaatgactttttcttgcagagtttgaattgatgcatgttgatgagtttattgatgaaytattgcacagtgagagagtctgtgatatcattctgccccgactacaggtaagaaataaaagtctgttaccagagtcacccttctcttcctagacgggcagacagacaaacacatacacacagcttaaacactgaagcctgtggatcttatgggtcctcttaatgaatagtcttcctgtctgggagtcccaagatagtggattgggagtgagaggaaaatagataaaatatttgaagggtagggctttaaaagtgaatggtttaaaacaaggaaactttgtttttctccatccttttgtagttcaggtgcatgtgtgagttgtgcctccctcaaaccttgttacaaagtcagcacattacctgtctatcatgaaaaaagaaatttattcaggatgttacatcaagggtattgtagctagagtaggtagggagtttttaacttcatgaacgttttttttaaactaatcttcatgtaaaaagccaggacataaaacagataaaaatagggccaggagtgggagactgagccattaattccttaaacttgccttcaccatcctgcttccctttcctagtgataaacgattatccatgaggcatcttttcaggaaatgagtgtgatacagctctcctgttccatgttggcactgtagggcatgtagtggaaagaatgagattataaatttgaaaacctactttgagggcccaattcttatagcaagacaatgtcttgctgtgttgcccaggctgttcttaaactcctgggctcaagggatcttcctacctcagtctcccaaggagctgggaccacgggtacatgccactacatttagccatttggcatttttgaaatcagctttgcctctctgatccttagccactcaaataaacattgctaagccatatcccagattaaaatggaaccagttcaaaatgcatgaatatcaacagctcccgagatcctgggtctactggagatttggtactactctagggctaggcctcttctagtggaactaccagccatgaacttattagcccttggattttctctgtgtgtgaagcccttacttttggttctaggctgtacctatactgattgatattcccatgactttagagtataaggtacagggaatagagtcaatagaaaatgaagatgttctcttcaggtttgtatttatgtttataggagaactttatagatttcaggtctattaaacttgttaggaaaatcttgaactgtctttgaaatgaaattgcctcagctgttgctccttggaaccctgaagcccagtgttgaggtttcaagaaataggggaaatggcaacaacccctaactctcatcattttctctgtagaaacgctatgtattagaggaagctgagcaactggagcctcgagttagtgctctggaagaggacatggatgatgtggagtccagtgaagaggaagaagaggaggatgagaaggtctggcacctgagacttttatggttgtaggggagggagtaatagaaaatgggaatggttttttgtttttagactttaatttttaactctattggccgggcgtggtcgctcaagcctgtaatcatagcactttgggaggccaaggcgagtggatgaccagcggtcaggagttcaagaccagcctggccaacgtggtggtgaaacctcgtctctactaaaaatacaaaaattagccagcgttgtggtgggtgcctgtaatcctagctacccaggaggctgaggcagcagaattgcttgaacccgggaggcagaggttgcagtgagccaagatcgcaacactgcactccagcytgggcaaaagtgagactccgtctcaaaaaaaattttttttctaactctagccaaaaacaatatttccttattaaaagcacctcagctctgccatatactagtagtataatcttacgcaaattacttaaatttagttttctcctatgtaaagtgaggttaatgatacttttttccccaagactgttaaaagtattaaataagattataaacttaaagcccttagcagagtattggcacattataattgcctaataaatggtggcagctattaaatacttggaaagaaagaacactttcataattgcacctatcctaaggaataaaccttgtttaggagggggaaaatgtcaaccgcatagtcatgttctttcagtactagttacggtgctgaaaagttgaaaacaaccaagctgcccagttgttccaggaagcaaactttttttttttttgagatagggtcttgctctgttgcccaggctgaggtgcagtggctcactgcattctcggcctcccaggctcaagcagtcttcccatctcagcctcccaagtagctggaactacaggcacgtgccagcatacctggctaatttgtgtattttttttgtagagatgggatttcaccatgttgcccaggctgcagataaactaaacatacacacatacacacacacaggtctgtttctgttccctctcctatgagtcattttggctgtcttatatagctcataataagttttgttagttaatagggtaagtgcttccctctttgtagtcaggttactgtgctttaaagtcacatggagatggactttgggacaagatggggcgtgaagtataattagtgttcctagatggctctttataagcctgtgcctttcaatgacccaatcatcttgtttccagttggaaagagtgccatcacctgatcaccgccggagaagctaccgagacttggacaagccccgtcgctctcccacactgcgctacaggaggagtaggagccggtctcccagaaggtaaagcctagtcattggccttttcccagaagattttgagcactgtagcctagaagtttggattttagagaaggaaaaatgcacgtctatggagaatgtttgcccaatatattagttatctgttgctgcaaaacaaccacctataaaacctcattggcagacaacaataaccatttgttcctttcacaagtctgcagtcaatgatttaagcagagcttggataggcagtttttaaagtacctgttctgttgtcggctgtctactggctggtatggaattgccttagcttggatgacgggggaaatttctcttctctgtgtcatcctctagcaggctaagttgggcatattctcatggtagtggcagaactcaagagcaaacaaacccggtcatgcaaatgtttttccagtatctgcttttatcacatttgcaaatatctcattagccaaagcragtcatgtcaccagtcctaaagttagaatgggagggtgctagagttacgtgacaaaagacatggatacagaggtgggtgatacagagaagcgtgaagrataagattggggcygtttttgcaatctaccacatccagtgygccaacctaggctttcttcttcctctcctctttataggcggagtcgatctcccaaaaggagaaggtaggccttcagtcatttgtgatgaaggatagggctttggggagggggtggtggtattggtgttatatgtatattgctaaccagatctggtagtctgaccagtcttttctacagcccctcccctcgccgagaaaggcatcggagcaagagtccaagacgtcaccgcagcaggtcccgagatcggcggcacagatcccgttccaagtccccaggtaaagcttgtgggccttttgccacaggttgtcttaacaaagaaatgtaaaaggagtagttagcctcctgcagtacaggagtgcctgactgtactgcctaacagaaaagcaaatggacatagaatttgaaaattaaggttcacagcttgactgtcacttataagctttgctgataaggtttgctttagttttttcatctaaaattggaggaataagatctaacataatagtgaaaacccaatatgatgtttgtgaaattagtcataaagcccttgaatgtatatgtatttgaactggtttcattactactttctttgctccctcttcctccactaattcagagttgcttccactaagaggtgtcccctgcataggccaaaagaatattaagccaatggcaggtattaggggaggtgagaatgacagtttaataagagtagaagggtaggatcttatgcaatggccttttcttccccaggtcatcaccgtagtcacagacacaggagccactcaaagtctcccgaaaggtaatgaattgacctctattttaactttacagaaatagtccaaattacaactaactggacctgaaattttcttgttttgttgggggatgttaggaattctcctgcattacaagacaaaattggtctattgctttgagaattactggggttagataactttttcttttttctcttttttgagaactgagtttcgtgcttgtctcccaagctggagtgcagtggcgtgaacctggctcactgcagcctctgcctcccgggttcaagctgatacctgttttgctttacaggattgcagctttggacaatggatgagctttggtctcagaaaacatggggtttagtcccaagttttaaaacttaacagttgagtgaccttggacaagtcactttcatttgataagatttcattagaaacccccatgtgccatataccgttgggtgcactcttttttttttttttttttttttttttttgagacggagtctcgctctgtctcccaggctggagtgcagtggcgcaatctcggctcactgcaagctccacctcctgggctcacgccattctcctgcctcagcttctcgagtagctgggaatacaggtgcccgccaccacccttggctaattttttatatttttagtagagacggggtttcaccattttagccaggatggtctcaatctgaccttgtgatccgcccacctcggtctcccaaagtgctgggattacaggcatgagccaccgcgccgggcctgtttggtgtactcttaacctctaagaggtcatttcctcaatggtaaaatttggatagtaatgcctgactcaagagtgttgctctgagtcaaaaaaataccaagcagtttaatgaatattgagtgtcagctccatccccatcaatgtcagcataccaaggtctttctcaggactccttttttttttttgagatggagtctcactctgtcattgaggctggagtgcaatggcccaatctcggctcacagcaacctccacctcccgggttcaagcaattctcctgtcccagcctcctgagtagctgggattacaggtgcccgccgccatgctcggctaatttttgtacttttagtagagacagggtttcaccatgttggccaggctggtctcgaaytcctgacctcaggtgatctgcctaccttggcatcccaaagtgctgggattacaggcgtgagccaccgtgcctggctgcttcttaatataattatttatatgtgttgccatttcaggtctaagaagagccacaagaagagccggagagggaatgagtaatggactcagtttggttttagtccacatggcctcctgtggatatraggatatctgtatgtggaaggattaagatctcccccaggcagctataagaatattttagtttttttcttatcaagtttctcaacctttatttttaatgaaggaggtgctgagttttgtatctttttaatcataatcaacatcagtttttgacccaactaaccttgactgtattcaaacttatgagagtataaaggatctggaggttggggatatgactgacaaggaaaggctgtggccacctgatgaccctttccctttttattaaaccggacacacctgtttcccatttcgctgtagtttagtttttggtttgttgtggttggaactgctttgagaatcctgggatttgtgctgctgctgttattcaaagatcaaaggagtaaaacatagttgctcctaacttttttccagcagcagcaagtggtaataaacatgaaaactggtttgtagcagttttgaaagaatagaatgcattcaaatgtaaggctgcttctggatcattaaagccagtttcatcaaacagttcaacagagagcagcacttaataccctttatacagcccattttttcatagtttcatttgttcttgcccacaagcttgaaatccaggttaaggtatccagcctttatcatataagcattgacattatccaggcctagtcagtagcagtagggtaacgggattgaaaaagatttgatggagaggaaagtatctaatattagtcatggttttgacctaaattgctagacagtcgtgccattcacaaagtcagaaaatacagcaggaagagacagcttttagaggggcagagaattagaggatggtggtagtaatgaaaatgatgcattcagtttaacaagtttaatttgagacagctatggtatagctaaaaacaaaagcccataaagttggagatagggaccagagtttaacatagcgatctaggccagaattgacaatgtttaagtaatggtggaatctgtcaataagacttcccagagtgttaatatatatcagaaatgcacacaacagaaccataggcaacaccaacacaggaagaaatagaagtcacctattgaaaactggaatggcccattcagaaagacaggagaattaggagagagtgagtgaaagaagccaagggtcaagaatgcagaagcaaaggaaggactaaaaagcctccacggacatcgataatcaagagattattaagatctttgctagaagagttcctttacctgtacttaactcccttaaaaagagaaaagtgatggaatgacttctgcaactgtagtcccagcaggaactgtgaagaccagctgccctgcaggatccagtttttcttgggaggttgtatctggtcataaggtaaacattctatatattctatgcctgctctagaattgaaagacttcagcagtattaaagcattttttaatcttatttgagctttcatattcttcaatggttcctttcgtaatacctgagttaataaaagtggtctgaaagagctcttacggtttctgatagaactatataggactaccttttaagattaaatataagcatctgtacgtaaatgtattacagtgtcatagcagttatttctttatgaaagtgatctaggtagaaagaaatgtcttctggcatggacagaaatgacccatggaccaaccaagctgtcatccagtacactcttaaaataaaactttgtcttaaaatatgttttaaagtaaaaataaacccacgcacaaagcccaataaattttagtaacagaaataaacctccctaaacaaacattaaaacatacttgtttagacatatggtaatatgtggaccaaaattgaggtaccacagccaatcaatagcaggaaagagaatgtccctattctttaattagaagaaggaggtaagagtaagacatgttgcatgtctgtagatatcgttttgataaaattacacaggagatggagcttgaggacaaaccttgctgtaaggctctttctgtcatctatgtgcttgcctatggatgaagcattttaaactttttgactacagcatacattttaaaaacgtattttacatcttacctctgtacacatctgtattctgtactgagacaaatttcaggaaagaatacttactatgcaaagtgaattctggtgtttcctacttgttaacagtttttaatattggatgaaaccacttaatcgatttcacttccaataatttgaaatacactgacttaaaagctttgccatagggcacaatcgccttttaatactaagaaagtaagggagatgtgttccaaggggcaaaagaaataatgcatttttggccaggtgcggtggctcacgcctgtaatcccagcactttgggaggccgaggcgggcagatcacctgaggtcgggagtttgagaccagcctggccaacatggagaaaccctgtctctactaaaaaatacaaaattagccgggcatggtggcgcatgcctgtaatcccagttacttgggaggctgaggcaggagaatcgcttgaacctgggaggcagaggatgcggtgagctgagatcgtgccactgcacttcagcctgggcaaaaagagcgaaactccatctcaaaaaaaaaaaaaaaagaagaagaagaatgggtttggtgagagggttccaatattaacaacccaacttcaagctcattcctctaacctcttcctgtttgttattcttcagtagaccgaagtttaaataagcattatttagaaaagaacgatcacagattgcccactccctcaaaaaggttaatgtgacagaaattctccacctgctcaaaaaagacagcagacatgatctctttaaaaaaaaaaagttcaaaagagattaagagatgaaaaataagattggtggagtttaaaggccttatactagaaaccacaaaacataaaacagcacagagaaaataggctggaggaaataaaaaatggaaaagagaaatatgtagaataaagaaatattctgatggtttaaaaagaattggccgggtgcggtggctcacgcctgtaatcccagcactttgggaggccgaggcagacggatcatgaggtcaggagatcgagaccatccaggctaacacagtgaaacccgtctctactaaaaatacaaaaaattagctgggtgtgctggcgggtagagctactagggaggctgaggcaggagaatggcgtgaatccgggaggcggagctttcagtgagccgagatcgcgccattgcactccagcctgggcaacagagtgagactccgtctcaaaaagaaaaaagaattaaatggggtcaggatggtctcagatcttataacaagaaggcaatgaagcaaaaggctccaaaggtttgagaaaaagtgccaggaattttatactttgccaaagttgtcttaaaatacaaaggctatagatgttctcaagtttgtaagaacttaaaagtacaaatcatgagtctttgggaaaaaaccgcccaataatgaaattcaactaaagaagaaatgaatcaaattaaggacttaggaacaaagaatcagtaaaaggagtgttagtaaacacttcagaaactttaaaaataatgggcaatgattataaagtcaaatattatgaacactgtctatatagaaataacaagtagagtgtgctggtttcatctttcatagcaggaatcacgtacagtctctaattaaaacatacatgaagctagaaaaaaaaatagcctctttattgttttccgtaattgtccttaattttaggagaaatcttacaagactagattctcttgtggggaaaaaagtatttaaattgagcattttttcagtttcacacttgttttccttttgttaatttgctatatttgttaaatatagcatatgagcccacttttgtaaaactatttgtatatatgtgcctgtatgattaagagagatggttggaatgaatgaagttcaccagatagtacttctttctggctgatgaacttttgaatgatttttaaactttgtacttttatataatgcttattttctttttacaataaacatgttaatttctacaaggaagaaatgagttgttgggagttaaaagcttttttataagcataccaacacattttacgtattgtttgctggaactacagattgataaccacttttatgaagggcaatttggcaatatgtagcaggaaccttaggacttttgatccttttacccagtaatcccatttaggggaatttaccctaatagaataattacatgtacacacaaatagctttatcccatcatcattttacacattacatatataatatgtatatataagaataactggaaacagcaaaaatgtccatctgtaggggatataaacaaatatacagtacatatttatatttttaataaccctaatgtcaagggaaaatactaatctccatgtcattaaacagaacatttcaaaacaatttggtcttaaatgtgtgtgttctccctgtataagattgataattttctacttaactgctctacaatgaatctgaactcataatctactttgcagacttaaaatctgagtttctactatatcaattttaaactatatgtttttcaacagaacagttttgccaattattgaacactggcagttactgaaggaggggcaaatgagatgctgaaaactagtatctataacactatcatataagtaaaacctaggctgttggttactaggttgccagttaataggttttgccaagtggtattttatactgccttccttaaggaagaaaggctgaggggttggggcattctgttattggaagttgttttatttttaatgaatatttcaaatacaatcctccccttggtatctggtggggggttggttccaggacctcccgcagatataccaaaatccaaggatgctcaggtccctgatataaaatagtgtagtctttgcatataacctatgcacatcctcctttatactttaaatcatttctagattacatataatgcctcatacaatggaaattctgtgggaaaagttgttatactgtattgtttagggaataataacaaactgtacaagttcagtacagacacagttttttttaatatctgcaatccgtggttggttgaatccatagatgcaaaacccatggatatggagggcctactgtatgtacaaaagtaaagagaataataaacacccctgtatacgtcattacctgttctccaagatgtggaaggacatgaagtattgaatgttaatttaaatcttgaatgctccaagtcattttaacatgaatgcatagttgggtcaggtatcttgttaataaatgatttaagtccaccacttaataggattctgaaagatgctgacgctttaataagaaaaaatagtaaatatacctaactcaggttaggtaaaaaaaatagtaaatatatttaactcagggctgtaaatacagcatgaataccctcaacctcctgcaataggtttcaaatatcttccatgttgcaaaatatggcaagggcccaagcagtctcctatttaagtaatgtatatcagaggaagcgcagcaaagataacccactgtccttacatttttatctacttattctgcacctttccaaatagatatatagcatcatttagcctaaaatcccaggcaactggacggactaattaaggggttagagaaaattacctcacctcactgctaaaacagctaaaacattatgccaccaacaactcgagtctgaattccaatacccaataataattaattccaagtattactggtaaataattatcatcttggcaagtgtgctttccaggtggaagtataggactcaaaatgaatacagtctgggctgggtgcagtggctcaacgcctgtaatcccagcactttgggaggccaaggcaggtggatcacctgaggtcaggaattcgagaccagcctgaccaacgtgatgaaaccccgccactactaaaaatacaaaaattggccaagtgtggtggtgcatgcctgtaatcccagctactcgggaggctgaggcaggagaatcgctcaaacccagaagacagaggttgcagtgagccgagatcatactacagcactgcagcctgggtgacagacagactctatctcaaaaaaaaaaaaaaaaaaaagtaatcttccctccactctaattgccaatattagtctcagtgttttaaaattctctttccaaatacttttcaattcagactccagcattgtttgctttttggaatttactgactgctttgcatttcagtttttattttcaaagataaaatggaaatggcttccgcttctatcaacctcatatgggtgttgtgaacatccaaccaaataaaggatatgaaatgttacttgaatctctaaaactaaaatctgtgatttagaatgctctattcactgaaattaaaagaaatcttgttacgtaatatttccatcatctatacaacagattaaccaaatttaactcttgtcaaaaagatttattaacttaaaatagaagtacttcaaatacagacaaaatcaactttccattcaagtttgaatgttcaatatacaagtatggaaaagaaaaaaaatctgaatcttcatgttgtaattttattttatttttttaccttttaaaaagtttttggcactacaaggttctgtaaagaatagaagtgacaatttaaaacacatgaaattctttcctaacttttaagaacaatatataaagtctgaagcaaccaaagtatgaatacagctaatagaaaataaagaatgtaattttttaaattctctctttatacaattcatcaaggttaaacaaaacataaaattcccttaaaaatagggtaataaaatagatgaaatttgtatcactcaatttggtgatactagtaaaaactatagttcatatttatatacaaataatacagtctgtaaaaacagtcttagaatttaaataagctatctaaacgtgttaaaattttaaatcaggacctgatttgttttgctttccattaaatgtcactttttctgctgaatgtaactgacattgaggtacggatacccttgagacagcaggattggctggttgctgtgcatcggtagaccagctgaaagaaaatggactcgcattactccgacacgtttcctcttggtgggtggggacaacgctctctacaccgacgggtggcacatctgtctgttggatacaacacagacaggaaactgaaaggcttgtgcctgtttatctgacaacaccttagaattaacttgtagttagctttctttttttctatttatataataggaggtgataaagcatgctgcaaaacatttgagagggtggggagaaaaatgaagaagggaaggaaatacctgtatgtgaaaaaaggagaggacacgaaagatggagaggaggaatcaaagggaaaaaacccactagaa
